United States Patent 10,662,479 (IMMUNOGLOBULIN EXPRESSION LEVELS AS BIOMARKER FOR PROTEASOME INHIBITOR RESPONSE) - sequence listing, part 3

SEQ ID NO: 387 - DNA, 148068 bp, Homo sapiens
gcatacggaggcgactcgcttccttcccgcccctccgccgcgctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagtgagtagggggtgcggtgggcggcggcgcggcccgggctatcccgggaggagtgtgatgcaaaggggcgcgggaggatagcggaggcgcggggcccgcggcgcgcgtagggcgcagggaatctctctccagctccgcctcagctgccttggctccggggctggccgccttttggttgggggtgtgtgcatttttgtcagggccaaagggccaccctggcttctctctggctccgcgagcctgcggatccacaacaaacccacgtgcgcacagccccggggaacacggatttctccacggcaccgtcagtatggggtggggtggcgtgggggcattgcgccttgcagagtctgggtttacggatcgacaaattgaggcccgcggcagcggagggggcacaggcaccataacaaacgcacgtgcgccctgcccggagagctggacgcactgcatacccttaggggccgccctgcggtgccgggccattgtctcagcctcgggggagggagtggctctagaggcgccacttgctggaagagggcgagagagacatttaaaaggtaccgcttgggcatcagactaaactgccagacttaaaaagggaaaccaaaacaagaaagcagctacaaaaaggttactccaggctgagtcggtccccggccgtggcgcattcttttgggtgaagtggaccacccctcaccttcacctcctggaggtctcttagagatgtgggttgggttaagggtctaagggtgcccctcaaaaaaagagagtgctgggtgcactattgtccccgcactccggcgattgcctctgtggggatattttggtcgcctcctcagcctgcgggaagaatgtacgagtcgcccagtgcggtcttgctctttgcctctgaggcccgtgtccgtgtgcccagacaccccagatgtcactagccccttttggcttgttaatgcattttcgcaagcaaggccagccgagacctcgtattctagctggggacgtacaattttcagttctgagtttatttgaaagaaattccgaggtccggaaaaagagaactcttgtttgttttgctttttctttgcttacatatgctcagctcagctttgcagatgttaatcggacacgatctgcagcggggagatggtttcgcggtgaattggtctctgaggcgatggtgttggtgcaggttgtgggcgtgcagtgtgagcaggaatggaggcgccgccgccccagtgtgtgcctgctgagcgggcgggctgctgcctcaccttggctagtgtggctgaagattaacctgtccccggggggggaactggagagcctccaatcctattccgctgttattgaaaaggtctagagagcatctagggagccttctcattttacaggcaggaagctgaggccggagagttcagccacttgtccaagtttaaaccgggtgaaacgggccacagagagaacacttgagtgtgggtctcccaactcccactgcatcgctcagcgggcaactaaaggcaaaaccgggattctgtgattggcctaaaaggcagtggccttaggcagaatagggtgaaacaaagagtaattcaaatagaaagctgcacccttccattatccctttcaagaattctttattctgttgagaaaaaatagatttagtaattccttactctccttcaagcctttcaaaagcttagttatttttctctcctggctgccccttcccctcaaattggaataaggccagctacggagactcagatgttttgcctctcatccttgtgccaggaggcctttgtttgggcaaaagcatgggctgttgacatcagccccacggggaagaaagtgtgtcttagcaagctactcctgagccacttgtgggagaacaaagcattgttttcactgatcttattaaagttactttttttttaacgagagtcccatggaagtagctgcttatttttgtatttggcagagaagtaggaaaaccaaaaaaacactgagaagccggatttccccaaagttaacatgttgttttgcactgtgcctgttatctcctagttacacttgtttcttttccttagagtttccagcgtgtttcactttcaatgtgattctggtagcaacaggaggcagctggatgcctaggcagatagggtcaggtacccggtgaaacccccacctccaggccaaagacagtttaaagcctgaaagccaagctacgagttaaatcctcagaccagagtgagaacttgtttggcgtgctttcccctaattgattcctacatttcgcctgttttacatatacccactttttcctaattggttttctacgctgccgtgcccacctttgagtggtgtctttgctttcatcttttttgcatactcacaaaccggtcagcatgcactccctattctgagtccataaaaggcccctgacccagccacattggggaacttttccgtcttcaggtaggggaccaacccggtgtcccctctctgctgaaagctgttttcaacactcaataaaattcttatctgccttcctctcccttcaatgtccagtgtatcctcattatcctttggtgtggtgcacgagctcggaaccaccgaacgcgggtacaagctataatacagtgagctgggacacacctgcatggccgagcgagcacaggtggggcattgctggcccgaggaccaagaagaaaaatcctacatcaattcctcttggcactgcagtatagttttctcaccaggacgctgaccctgtaaggaacttcagaaatcatgtgactggacccttttactttccagatgggaaaagtgaggcctagagaagagaaattgcttgcctaatgatacacaacaatgcgtggtctacttttagtgcacctttttgcgtaaaagggaaatggttgcatcaaaccagtagttgttggtactccagagaaaagccaaagttatggttgttataacaacaccctttaagtcagagaaccaattccttatggatttaaataggtttggttattaagcaaagccagggatcccagtagtaggtatgctgaatagtgcaattatctctggggatcagctttctttagtgtttgctgaacggttcactttactcttgtgctgggttcctccatgtctctgtcttgtgcttccccatttaggggctgctttgtatgaaatcataaggcaagaggcagtgagaagacagaagagagaggcgccacttagctgttcatgctacttaacctcttgggctccagtttccttctttgtacagtgagggttctccttgcccagtctctgcacaggctgttccagcggagcggaagatgctcaggccataggaggggtttggggtcatcttcctgtctctagtattactttaaaaccagcaggctgggccaggtgtggtggctcactccagtaatcacagcacttcaggaggccgaggagggaagagttcgaattccttgagctcaggagtttgagaccagcctgagcaacatagtgagactacctcccccaccgccatctctacaaaaaataaaagaacaaaattagctgggcatggtggcgtactcctgtggtcccagctacctgggaggctgagacaggagaatcgctggagcctgggaggtggaggttgcagtgagccgcgatctcaccactgtactccagcctggggacatagcgagaccctgtctcaaaaacagaaaataaaacaaaacaacaacaacagaaaaccagcaggctgcctctgcgttgtgtaaagtgaggggagtaaggcgtatgaatctcctggggttgttgagggcattaagtcacatgatgcattcttatgactggtcagacctcttggcaggcttgagtgcttaccagcttttaaaaaattttatttatttatgtatttatttatttatttattttttcagatggcgtctcgctctgtcacccaggctggagtgcagtggtgcaatctcggctcactgcaagctccgcctcccgggttcacgccattctcctgcctcagcctcccgagtagctgggactacaggtgcccgccaccacgcccggctaatttttgtatgtttagtaaagacggggtttcaccttgttagccaggatggtctcgatcaaaaattttattttttttaaacttttattttgggttcagaggtacatgtgcaggtttgttatacaggtaaacttgtgtcacgggggtttggtgtacagagtatttagtcactcaggtactaaacctagtacccagtaatgattttccctgctccgtttcctcctcccaccctccacccttcaagaaggccctggtgtctgtcgtttcccctctttgtgtccacgtgttctcattatttagctcccacttataagtaagaacatgtggtattgattttctgctcctgcattagtttgctaaagataatgacctccagctccatccctgttcctgcagaggatatgatctcattcttttttatggctgcatagtattccatagtatatatatatatgtaccacattttctttatctaggctactgttgatgggtatttagatctttgctgttgtgaatagtgctgcagtgaacatatgcgcgcatgtgtctttatggtagaacaatttatattccttcgggtatttactcagtaatgggattgctgggtcaatggtagttctatttttagtttttcgagcaatccccacactgctttctacaatggttgaactaatttacactcccaccaacagtgtatcagcattgccttttctttgcaaccttgccagcatctgttactttttgactttctgataatatccattctgactggtgtgagaccagcttttaaagtggtagggaatgttagtgggagaatgaccccgtagggtaagctcatgtgctcagattagaagacctcacctgtcacaaagaggtgtaaagcaaggcctgccaaactatcaagggaggctttgagcagttgtgaagtttgtgtgactctaaggtgactagaactagtaaaaaaaaaaagaaaaaaacccagaaccttcacacataagtgagtaatatctcaagtcattctatttatgtattctgtatttaccgacaaacaggtggtgggagtggagggggtcttgtgcttagcctgggattacaaagagcatggagacccacccattctttgtccgagggaagtccagcctagctccaccacccttgcttaaaacacttttggctctcccttagaaattgccctcaggagctcagagaaaattgatctaatttgtctcagtattgacctctggggtccccttctcttcatgaataaagggaagagcaggtggtaaatgacagaatacaagagggaaggcttcagagaaaatctggccctccataaatatgaggacatggttgcattaaaaatatacaggaataattcattaatgaaattcacagtaattgttctggaccattagattcctgagaatttagacagggaattagttgctctgatgtagtatcagtgatttgttccataagaactgaattagaggcaaatgaattttttcttgcttgtctgcagaaaactatacgatggcagtctgactcctatagatgtatttttgataggcttatatgtaacagtagcattgagcagtacagtttcaccatattaaaatactgagatgattttctaagtaattattacaccagaaaggtcaggttagccttcagaatcaatgtagtgatttaaattttatttattctgattataaaaataaagctaggggctgggcacagcggctcatgcctgtaatttcagcactttgggaggctgaagcagctggatcacctgaggtcaggagttcaagaccagcctggccaacatcgtgaaaccccatctctactaaaaacacaaaaatcagccggacatggtgggcaggtgcctgtaatcttagctactttggaggctgaggcaggagaatcgtttgaaccctggaggcggaggttgcagtgagccaagattgtattactgtactccagcctgggtgacagagcaagactgtctcaaaaaaaaaaaaaaaaaaaaaaagaaaaagcttgaccattgaggataatttggaaagtactgtacaaaaaaacatagagaaacagaaaaaaattccgctatccaaaggcaacccctcttaacagttggcaattttccttcttcttttttttttaaatggatatattttttgtaaatggttgagaacatactgtatgtgcagttatgtctcttgccttcttgcttaaccttcccatatatacatttcatggttaacattgcattaaagctgtattctttcattcgtcacccatatcagctgttcggcgtctccaaggatgtgtgggcccctgggatctgatcatttcagtgagggcctataaaatttcaggagcctccaactgcctctgcctttcccaccattgcctcaggtgttcagccatcacccgtcggttctttagaagtctacaggtactgacagtacagtggggagagaagaggcctgcacatggccttgagttccagtctgcccttgtgaccttcaaaaacttaactttaataccccagtcttcaacgtctgcatatgttaaatgagcaactccaaggtcacttattaatttattcaccacatatttgagtgcccactctaaaccaaagacaaataagaagagcttagttttttagaagctcatagttcaaaggaggaggcaggggtaacaagagattagtgcaggatgccgtgcgaccttgaggagggagtcaccaatgactggagcagtgggaatggcctcctgcatgaggccacactggacagccaaccacatctaactttctcttattgtaattgacactgtgattaaaatatctgtgaagagccaggagtggtggctcactcctgtaatcccagcactttgggaggctgatgcaggcagatcacctgagatcaggagttcgagaccagcctggccaacatggtgaaaccctgtctctaccaaaaatacaaaaaaacagccaggcgtggtggcgggtgcctataatcccagttactcaggaggctgaggtgggagaattgctggaacccagtaggcggaggttgcagtgagctgagatcgcaccactgcactgcagactgggtgacagagcaagactgtctcaaaatgaaatgaaatgaaataaaataaaatattcatgaagaaatctctgttcattttccagatgattcccatagggtagtcctaaagttgaaattactgggttatactttaaagggtatgaccatttttaaaacttcatggatttagttcaattacctataaagtcttaaagtagctaaatatatattgtgggaatgggaaaaactaacagcgcaagcaagtcgggatttgctttcttgcccactatgtatcgcctatgtagacttggacaagctacttaagcttactaagcttcaatttccttctctgtaaaatggggataacagaccttatctcatagggtgattatgagcattagatgaaatcgtgggtgaaaggctcagtacagtgccaggtatacaagaagcattcagttaagtaatagctgttattgttataactgaggttttcacaagccgcacacttttgctcctgatattttttcttaccatgacagcaggccattgtttggttttctgtgctgagggaagcagaaagttaattaaaatggaaacccccaccaagtgacaagttgagagagaaaaatgatcgttcacatgatgcataaaaaaagaataaaaggtcttttttattagggaaaatttcaaacatacaaaagcacaaagaagagtgtaaggaaccctatatcatatcccttggcttcaactatgactgaaacgcatggctgatccgtaaccccatggtcaaccccagattacgtgcaagtacatcccagacatcttatcagccgagccatagctatttcagtcacatgatacatatttgaggcactgagttgtgctggctaagagcctgcctctgctgtcgcagtcatgggactgtgtgtgtgtatgtgtgtgtagggaggattgggagtcaggagagagacagaaagtcaacctaggacctttagggaggattgggagtgaggagagagacagaaagtcaacctgggaccttttttttttttttttcttttttgagacagggtctcgcactgtcacccaggctggagtgcagtgggatgatcatgacttgctgcagtctctgacctcccaggcacaagcgatcctcctgcctcagcctccgagtagctgggactacaggcatgcaccaccacacccagttaattttatttattttttttgtagagatgggtgtctcaccgtgttgcccaggcttgaactcctgggctcaaccgatcctcctgccttggcctcccaaagtgctgggattacaggcataagccactgtgcccagcttccaacctgggcacttcttaagctttactgcccaagtaaggaggccttgctgtgtcacaaatagacagggtggaaggagcactgaattcggagtcaggaaacctgatttcaaataagggccccaccccttaatggatttatgcttttagaaagtgacttttgaatttcttggagcatatttgtaaacattttgtgagtattaaatgagataacccatgtgacagctcaagtggctcaatatgagttggacctaaatcagactcgagcccagccttcccttcctgagaggcagcctccatatgcagtttaggtccctgactgccacctgcagcctcaccagaatgcattcagggagcgttgctgccggtctctcatgccgaagatgtggtggtagctcagatgagcacctgacacacacaacgccccatgcttgcaaatctcccatcccctctgttagttagccccttccctctgctttatggatgaggatgggggacctagagaaggtcccagtccttggtagcaggccctctctcacaccccatctatgggaagacagggtcccttttctacctctgactttgatgattcttggtctcctctaacttgctgttacacccaagtaggaatttttgactcaaataaaataggaaagtcgatccgatttagtaatcaagtcaaagtcctctccttaatccactgggacacccattatttcaagacctggactgtgacttgtggtctctggctgttggtggctagctctgtgaccttggacaaatgcatgccaccctgggtatgccacctcagagaatcaactctcagccctgtgcagccccttccagctctgagattatcaaatgaaacatacatgtaagactgggaggcttcttcacataaataataaatgaaatggttttttttttagagtattcaaatggggtaaaaaattaacccctcagcttatgccattcctccctcattccacttctctttgcaatgactactgtttgcagtttgatgtctgtccttctaacccctttgtacacatttatatatgtatttgtggctatatgcaaatacatttttaaaactcagtagatggattacaatcaaacttgttcaacccgtggcgtgggggccgcatgtagcccaggatggctttgaatgcggcccaacacaaattcgtaaactttctttaaaaattatgcgtttttttgtgtttttcttttttctttaatctcatcagctatcattagtgttagtgtattttatgtgtggcccaagataattcttccagtgtgggcccagggaagccaaaagatcggacattcctggcattatactagtccatttacaaacttgccttgttcattttactgtgtgtattggaggtcttcccatgtcagtgtttttttttttttttttcatagctgcattgcattctatattttgaatgtgtttaccttaccaatcttctgttgatggacatttatgtattcccataaaaatatatttctaagtgtttttagacctcaaacatatggagagatggttgtaaatgtcagtgggttaaatgaacctagtccatcaagttctggaaaggatggtgagagagtgggcacagaaacactggggtctgcactctggaaagctgaattgaagggctctcaggaagctaccaagaggctgtttgcatggaaggttatttttggagatagcctgcctggtttggtgtcctcagcttcaagtgcaaacactgagctgcgtcatcacgttcccctccccttcccaccatccttgggccttccaagtttgtttctggtctcagggtcaggaacaggacctcgtgggagaactggcacttaagtggtagggagggaggagagagaactgaagaaaaggagtgtttgatctcgggctctggaggaggaattgttacagttatattgtactttgtctggttgttcaaacctacctggagtgttatgcttccctgggtccctccagagagtgataaaatgatgcacacccagaaattggctacttggatgacagtggcttaggacaacatatcggaggtggaataaatgtggaaactaggactttctagtctgcaagagataaaaataagaggcatccttttcatgcggaagaaatcacacttcattacagtcacactgagtggctgctgcagacgggagaagcaagatgggcggggggtgaggaggggaaagagttgcaggaaaacaaataaggaagaactgacttaacggagctacccaacaatggaacaagctgtgttacaaggaagccactgccgtgttataaagtgatccaagcaaaagttgcaagtaggctgggcacggtggctcatgcctgtaatcccagcactttgggaggccgaggcaggcggatcatgaggtcaggagatagagaccatcctagctaacacagtgaaaccccgtctctactaaaaatacaaaaaattagcccggcgtggttgtgggtggctgtagtcccagctactcgggaggcggaggcaggacaatggcgtgaacccaggaggccgagcttgcagtgagccgagatcatgccactgcactccatcctaggcgacagagcaagactccgtctcaaaaaaaaaaaaaaagttgcaagtaaacttgtttgccatcagaggacttctgcattgcagaggggttgacctcaatggccacttaggccccctgcagctttgagagtctgtgactatggggcaagaagcagaaaggtgcaaactagaactaaaggggtgggacaagttatagacaatgtagtgaagtagttttcacctgctctgaaaaggtggaataagatggaagccatcaaaggaggcttaagccttgtttcccttggatcttggcaactctctccctgttctgtccttggcttcagctccctttgaccttgtattcttaaattatttccacaggaataaataccttacgtacactttagatgatcaggaaatctggcacctggaaaagaactgcatgtcccaggaggatggttgtaagttttttcattgcagtctttgtaaatctgcatccgtctgttggttgatggagttttccttagtacagtgccgagcttccagctttaattttaggaatgctgtaccctttacaacctctcgatggtcctctgtgctggaatcgagggcacccaccgtgtttaaggctgatccctttctttcctgcaagtgaagaagaatgttttgacttaagtcttaaccaagtctggtgaaggaaacgtggcaaaatttaccatcttctgggcttttgctgtgtgcctggccctgattaggcatgttgtgtgttctctcatccaatcatcacaggaagatctgctgtgtcggtatcattagctccattttgcaaataagaaaaccaagcttcagaaagggctagaaactcatctaaagtttcaggtgcccaccactacgcccagctaatttttgtatttttagtagagatgaggtttcgccgtgttggccaggctggtctcaaactgctcacctcaggtgatccaccgacctcggcctcccaaagtgctgggatcacaggtgtgagccactgtgccgggactgcagtgctcatttttagaacatagatccaaataatccccatagtctgttgcttccagagcttagttgaaggcagatatgcacatattaattacaatatagtgtgataaatattatgatttgggtgtgcacagatgatgggaagaagatccagtaagtttgggaaagatttctggaagaggcaacacacaagctgtgtcttagaaagtagtagctgttagcctctgggaaatgagcatttttgaggcaggggaaggctgcaggagcaaagatttgagggtgagaaatggctcattgtatatgtcagggaaacactagcaggttgatattcctggagagaaatgcatgaggcatgaagtggcgggacttgaggctggaaccattacatgtgttatttaatagaattttcataacactgcatacactattattatctcaattttttattttattttatttatttatttttagacggagtctcgctcttgctcaggctggagtgcagtggtgcgatctcggctcactgcaacctccgcctcccgggttcaagccattcccctgtctcagcctcctgagtagctgggattacaggtacacactaccatgcctggctaatttttgtatttttagtagacatggggtttcaccatgttggtcaggctggtctcaaactcctgacctcgtgatccgcccgcctcagcctcccaaagtgctgggattacaggcatgagccaccatgcccggcctattatctcagattaataggcgaggaaacaaaggttgaaggagattcagtgacttgctcaaagtcagaccgtgagtgtgttgagttgcgtggtcttgaacataggcctgcttgcctccagagcccatgtctcagcctccacttcagtgcctgcagaggcaggctgtgaaagtctggcttgctggctaagacgattgttccctctcttttaatgtttcaaggacaacatcccttgccgaatcctcttctttcaacctgcctcatggtgttacccaactttttgttaaattgggactagtgggtctgatgttgacaggttttctgagtcttggttctagggttcaccttcctttttatccagccaatcagtaatccagaagtcttcaaataaaatctttatgtgcccaaccacgtgtgaagagggagaagattcatctcgtttctcaaaagatccaggtttatttgtgagcccaggtagtgcctgcgaatcctttagtttggagaaacactttggggactggaacaggaacaatcacagctggctggaggaacgtggggtaatgggccttgagctgtccctttaaggatgagtaggagttgggaaggtggagggcataacatatgagcaaaattattgtctcacttaatggtgaatgggacatcttttgcctattctccccatcctccaagataattcctgggttagagttggctctcgggtaggagaggcagtatggggaattcattcatgcaaaatcaagattattgaaaactaattaattggatcccaaagacaagatgatgaaactactcaatgaaataaaaaaggtaattacagagccaaggaagacattggggataaaaacaatgtcattacagaaaaagttaccaggaaacataacagaatctgttgaaaatgaaattgctaacagagaaggaaggcttgaggaaaatcacagcctatgctgagaaaaaagataacgcacttaaatcagagatctaaagatcatacaaaggtgggccttcaaaagggtaattggagagtctgcggaggcactcgtcgcttttgctcatattccattggccaagacttagtcacatagatagacacacctggctgtaagtaactctgggaaaaagtctccagctgagaggccatatgccttcttaaaactcagttttggggaaagctttctactactgaaaggaaaacctggatattgggatcaactagtatctgctttaagggaagtcatgttggtctcagacatgactgaacaggtttacagaggccaggtgaggtggctcatgcctaaaatcctagcactttgggaggcagaagcctgcggatcgcttgaggccagaagtttgagaccagcttgggcaacatagcgagaccctaatgaaaatcatcagctgggtgtggtagtgcatgcctgtagtcctagctacttggaagactgatgtgggaggatcccttgcccaggagctcggggctgcagtgagctatgattgtgccactgtgctctgggctgggtgaaagagcaagaccctgtctctatttaaaaaaaaaaaaaaaaaattgtttacagagttctggggcaaaggcaatgggactgaagaattttacactcaaattactttgcaagtatgtcaggcagacatcctcacacttgcaagaatttagggaatctagcactgaagaggccttctcaggaaacccacttgaggaagaaaaagattaatcgacaaacatacttagaaggcatagtggaaggtcaattggtgaactcttaatccgttcaaatagagaagcaaagctaagcaggggcagggatgggcagtgaggactaaggaacagaatgtgaggaagtagaaagaatataccagaaatagggggttaggggagacgtgaggagatgttaagtgctaactttaattagaagtgtaccttttccggctgggcacggtggctcatgcctgtaatctcagcactttgggaggccaaggcgggtggatcacgagatcaggagatcgagaccatcctggctaacacagtgaaaccctgtctctaccaaaaaaaaatacaaaaaaattagccaggcgtggtggtgggcacctgcagtctcagctacttgggaggctgaggcaggagaatggtgtgaacctgggaggcggagcttgcagtgagccgagatcgcgccactgcactccagcttgggtgacagagcaagactccgtcaaaaaaaaaaaaaaaaaaaagaagggtaccttttctggccgggcgcggtggctcatgcctgtaatcccagcactttgggaggccaagcgggtggatcacctgaggtcaggagttcgagcccagcctaaccaacatggtgaaaccccgtctctacgaaaaatacaaaaattattttgtactgggcatggtggcgggcgcctgtaatctcggctgctcggtggggctgaggcagaagagtggcttgaacccaggaagcggaggttgcagtgagctgaggtcgtgccactctagcctgggcgacagagtgagattccatttcaaaaaaaaaaagtgttccttttccttataaaataaaataataaaattagctattttattttacttttaaaaaacttattattattattttttgagacagtgtctcattctgtcacctaggctggagtgcagtggcgcggtcactgctcactgtagactcgatctcccgggttcaagtgatcctcccgccggcctccgaaagtgttgggattacaggtctgagccactgctcctgacccaaaacagctattgtgtaaagcaatccccatctatcctttcacgcatgctttcttccatctttcacacttctatccatatacagatatagagacttgaggaatgatactaattcatttattttttcctggatagagggctcttgggtgatttttagctctatatagttttgcatattgattgacattttataaataatgaactagtcttacttaaatcagaccactgaagctattctgaaaggcaccattaaaaactggttcctggggagtgaagagtgggaacggagatacagatggatgaacactgtgggggatttgagagtcagttatgcaaacacctcactctaggcagaacaaaatacgttatcaatcagatggacagctggggattggggcccacacgacaatggaaaaggtttcacccaggagaccgatggagttttgataggtggagaatgggagaaaggacctttctggcctgggggcagcaggaacacaggcctggggatgaaggggcgttggcatgtctggggttactgggagcagtttgttggtggttcgtggttggagaagcaaggatgaaggaaaacatggctgctgttaatacagtgtgcacagcacactagatactacacgtagatatctctaggttgcccaacaaccctatagcacaggtacaattatctctactgtacacatgagggaactgaagttaagggtgagagatctgtgcttgcttcagcagcacatacacgaaaagtgcaatggtacagagaaggtgagcattaaaaaatagtgatgtttatctgcccagaggcgcatggtggtgagactgatttgagctccctgtgctgcctgcacagccatgcccatggtttttctattgtgctatgatttgtggtgcacagagaccggaatcagccacctttatgaaacacaaaatgtaaaaataattgtataggtaaatattttataagtaagtctattttatacatttacgtttatgtttagattggtatttattattatttacatttacctataaaataaaacatggtttagatgtaaattttgtaggtaaatttttaggtaaatataagagcctacatgatggtccagactccaccatccagcagccgtgtggccccaggctacttaatcagaaccctaatttccttgcctatagaaggggataataattgtgccactgcctagcctgagattagtttttatgttcaaattagatcatagacgttaaggatgagacagtttgaaagaggcacacagaagggtttgttattgcggacacaccccttgctctgctgagagcatacatctgttcaagcacccacaggtgtctgtgaaaatgttcacagtcatagacacagcccctacagggttgacacaaacaacctggtcaacaggcaagaaactgcttccctgactcagttaaccagctggaggctgtaatgaaaggcagcagagagtgagggagggaggaggcagggagtgtgtctggctctctccctgcctgggtgagaatccgctcttgcctgccttcctggttgctggggaatttctgggccagagttgcgtcgggatggctgtcaacagcttggtgagggtggaggaggctgttccagacgtgccaagctacaggaatgaatgttggagctgccacgccggcaggccctgccatgtctggtagacgccagtggtctgaaagagggaccaggaaggatagggttgtcaggggacttcggtggccagctttattctccagaagtaccgatgaggacaaagcaaggccctgacctcaaagaaattgggcttctgacaacacttatcaaactgggcgggcagccagacctctgctctgagctagtgtggctggaggcacctgacgtttgctccgggaaggatcaggatggttgtagggtgtgggctggggcctggtatgctcttgggggttcagaaactctagtgtgtgtgtgtgtgtgtgtgtgtgtgtgtgtgtgtgtgtgtctgtgtgtgtatgtggtcgttggagagagacccaggctattccatatcgctgaagagatccgtttcttccttatctcactggtctctctgctataccaacacctttggctcagcctcagctccagccagcctcagttccggaggagccccctcaaattcatggcccacaaaggagagagaagacctccgatctcttgtgccatgctcactatgctatgtgaaatttgctatgttagaccttgacatcctggatggtggggatgatgactggtttctctgcacagccctgggcccagtatcctgcccagcccttaggagtcctcatggaatgagctcagctcccgcgatgctcctgtttgtccactgaggtaagaacacatccagccaccagtgagttgagtgggtgttctctcggtaagatcaaggtgtgacagcaggcagtgaatttgcagtagcccgtggtgggaagcccgtgaggctgtagtgggccctcctgctccaccagagagtcatttttcctacctgccaattctagccttggaaataaaagccaagcaggcgggtgaaagagggaaaattctctgggatggttcatggatctgagccctggaggagagtcaagcttgggaccttgttcttcttgtcttattttgggaaccagggtcataggaatttgttccaggtgagagagggaagaaggcagctagggagctgtgacgtggcagccaggctgagttatcagttacctaagagtctgcctcagggattgcctttgtggactgcacagtgctggttctgggaggaggctggccttgggcctgagctggaggtggtggctgacagtgtgaggaatgaatccccagaagatgattcctgccagagggcttgtgacggctccttttttgcttttcacaatgaacatcttattctgggctgcaaatttggatgaggggaaaaaactggccaggaggagatgaaccaaaggcgtctcacagggaatccttctgtacttgaagagtcctgcccttgtctccccagccagatccagtgactcacagtaggagggcttggaggcaactcactgccttccctgttaactaccgtttgcaatgtcaccttcctcagaaagaccttatcattcggaaaaaaaaccacatgctttgtagccagacagacttgggtttaaattccagatatgccacttctcaggtgtgcaagcttggcagcttggcctctctggtcctcagtttcctgtcttagtctatattcatcctttctgccttgtagcattggtgtgagtcctagaggtagtgcctaacctagttttgggcacatggttggagaccaataaatcgtggttattttcaatatcacagcacatgtgaacggttattctcagttattgtccacctgatgggccactttgctaggggctgtgaatagaaagagaaatgagatacagcctctccctggaggagctctccatctaggaggagagccaggcctgtggaagggggcacaaaggaaagcaagttgcacaagctgtggagggagctggaggcaggggcagagaaggccagaaaaagagatgatatcctcaaaggctttaaaagaatgaagaagaatctgccaggcagttggggcgggggcagcattggatccactcataagggagggcagagctaacagtggaggctccctggacaggtgagccctcgggcttccccctctctgctggcatttgatcctactcagtttgggtcaggatagagtctgcagtcattttccagcaggtggttttacatgggcaggaatccagccaggcctgactgggggagagggtgttgaggtggcacttgtcatcccagtgatctctccataggtatctgggctccaggcttagggctaggagcaggagtgggcctcctcagagggagtgggacagattaccaggcaggaactgcaaaggcagagctcactaaagtgcaggctccaggtcatgtggatggaggggcttcacaaaatggtacaaagcggttgttatcaaattcagacagcaggtaggtgggaggaggggtgacctgtgacttctgtgatttctgggaagtccactgaccctttatgcagtgctcagtgtcaaataaaaagaaccggagaagaccaccttgatagttaaggatatacatttgtggttttagttattcacaaatgactctaaagttctgtgatatgatatgattgggtgaatcatttggatgagataaaaacaggattttatttgctgcatgcatgttgtgtgtcacctaggtggtgataaaaacaaacgtagaagctttcatttactgaactcttaccatgtctgggcatgctatatgctttacaagtatctcatttagccctggctaaatccagctctttgaacaccatacctactccacaaatctgagtgtgactgtagaaaagcatagtgtcatcctgaatggtcccactctaattcttttttgtttattttttttgagacagagttttgtttttgtcccccaggctgcagtgctatggcgtgatctcggttcactgcgtgcagcctctgcctcctgggttcaagcgattctcctgcctcagcttcaggcacctgccaacgtgacccgctcattttttgtatttttagtagagatagggtttcaccatgttggtcaggctggtctcgaactcctgacctcaggcaatccgcccacatcggcctcccaaagtgctgggattacaggcatgagccactgcgccaggccgtaattcttggccatgactcttaaggggacattggtgttgtaggccatgtcgcttcattttgttggtccattggttctcaaccctggctgtcattagtgttactggtgggaattataacacgtattgctgcctgaattcctctcaaactaacgaaatcaaagtctttgtgaggttgacctgggcaccagtatctctttgttaacctgtgctgttaattccaatgaatgatagttgagaagcatgaccattcctctgtcatctagatgactgtttcgcacctttttctctctcttcaagtctctaacaccttccctatccatactctcagttgataccttgttttaaacttacctgaaaaaataatggcagtcggaggaaaactttcataccttttgtcttagtccattcaggctgtgataacaaaataccgtaaacagggtggtttataaacaaaagaaatgtattgctcatagttctggaggctgggaagtccaagttgaaggcaccagcagattcggcgtctggtgagagcttgcttcctaatttatggatggtgctttttcaccgtgtcctcatgtgctaacagggctcactagttctccagagcctcttttataagggtactactgtatgagtccatgttgccttgctataaaggaaaacctgagactgagtaatttataaagaaaagaggtttatttggctcatgattctgcaggctgtacaggcatggcacccacatcatcttctggtgaggcttcaggaagcttttactcacggcaggaggtgaaaagggagggggtgtgccaatttttatgctcctggagagagttgtctgcatttgcaccctgcactccctcttctctcattctcatttaaactcaacatgatcagtcttttgtacccatcacaccaccaaaaccataccggtcaggctcaccagtatcctctcttgccaaatccagtggtcagatctcagtccctatcttgactgatcagcaacttttgatacaattgaccattccatcctccttgaaatagtttcttctcttggcttctggaacatcactgtctttgcttttcctcttctctcactaggttctccttctcagttccttttcttggctcattttcttttcttttcttttctttttttatttttattgagatggagtctcactctcttacccaggctggagtgcagtggcgcgatctcagctcactgcaacctccgcctcccgggttcaagcgcttctctgttggctcattttcacttggtcactgtggagtgcctctgggagtggcccttggacttggcctcttctctgtctcctcatgccctggccatctcatatcatcaatttcctgacaaccctcaatttatatttccaacccacacctttcccctgagttccatgctcagatattcaaccatctacttgacaagtttccttagacatctaatatacatctcaaatatgacaagcccaaaatcgaactgctgcttttctccctaaaagagccatcctcatttcagtggacaacaatttcatctttccatcttttagggcttaaactctggagtcattctaaattctctttctctcatgctgcacccactctgttagcaaaccatgtcagctgtgctttcacaataaattaagaaacaactacttaattcatcaaattcatgttggtccaggacagaagacctgttctttctcttagaatcgtttcacaactgagcctcctgcttgtagtcttgctcctgtggtatgttctcaaaacagtaaccagagtgatcattttaaaagctgtagtgatgtgtcattcttccgctcaaaaaccaggaaaggcttcctcttttactcagagcttagaaaggcctacaggattctgtgtgacccagccttcagaccctgcagacttcatctcctgctcttttccaccgcttcattctgcttcacctcactgagcctactcctcagatataaagcacactttggtctcagagcctttccactgcttcctccaggcaggacaccttccttcatgtatcctattgttttcgtctcttcttcaggtttctatttagatgtcaccttgtcaaacaggccatttgacagccttatataagattataatctcctgcctgtctcctcccaccgacttggctctctcccttttatccttccttgttgctgttcaatagcgtaggtggccatctgagttactaccctgtgtcttttctcactaggaacttgcttccatgagggcaaggatgttatctcttttgctcacagctatttctttaggacccagagcaatgcctcaggtatcataggcataatccacatttgttggctgaatttaacaaaatcctcacaatgacatttcaaaattagttggaataacccaaaatttatacatgaagaaactgagacacagagaggttttttttttttttttaattttattttattttaagttccaggatacatgtgtaggatgtgcaggtttgttacataggtaaacatgtgccatggtggtttgctgcccctatcaacccatcacctaggtattaagccccacatgcattagctatttatcctgatgctctccctcccccaggccccctgacaggccccagtgtgtgttgttcccctccctgtgtccatgtgttcttattgtttagctcccacttataagtgagaacatatggtgtttgattttctcttcctgtgttagtttgctgaggataatggcttccagctccatccatgtccctgcaaaggacatgatctctttcctttttatggctgcatagtattccgtggtgtatatgtaccacattttctttatccagtgtatcactgatggacgtttgggttgattccatatctttgctattgtgaatagtgctgcgatgaacatatgcgtgcatgtatctttataatagaaggatttatattcctttgagtatatactcagtaatgggattgctgggttacatggtatttctggttctagatctttgaggactcaccacactgtcttccacaatggttgaactaatttacattcccaccaacagtgtaaaagcgatcttatttcttcatagcctcaccaacatctgttgtttcacggctttactaattgccattctgactggcatgagatagtatctttttgtggttttgatttgcatttttctaatgatgcatggtgttgagcattttttcatatgtttgttggccacataaatgtcttattttgagaaatgtctgtttatgtcctttgcccactttttaatgggttttttttttcttgcaaatttgtttaaattccttgtagattctggatattagagctttgtcaaatggatagattagattgcaaaaattttctcccgttctgtaggctgtctgttcactctaatgatagtttcttttgttgtgcagaagctctttagtttaatcagatcccatttgtcaatttctgcttttgttgtaattgcttttgatgattttgtcctgaaatctttgcctgtgctgatgtcctgaatggtattgcctacattttcttctagggtttttatagttttgggttttacatttaagtctttaatccatcttgagttaatttttgggtaaggtataaggaatgggtccagtttcaatttgctgtgtatggatagccaattttcccagcaccatttattaaatagggaatccttttcccattgctagtttttgtcaggtgtggcaaagatcagatggttatagatgtgtggtcttatttctgagatctctgtgctgtcccattggtctgtgtgtctgtttctgtactagtaccatgctgttttggttactgtagcgttgtagtatagtttgaactcaggtggctggatgcctccagctttgttctttttgcttaggattgtcttggctatatggactcttttttggttccatgtgaattttaaagtagttttttttctaattctgtgaagaatgtcaatggtagtttaatgggaatagcatttaatctattaattattttgggtggtatggccattttcatgatattgattcttcctatccacaagcacggaatgtttttccatttgtttgtgtcttctcttttttttttcttttcttttgagatggagtgtcactcttgtcacccaggctggagtgcagtggtgtgatcttggcttattgcaacctccacctcccgggttcaagcgattctcttgcctcagcctcctgagtagttgggactacaggtgcgtgccaccatgcccagctaatttttgtatttttagtagagatgggatttcaccaggttggccaggatggtcttgatctcttgaccttgtgatccacccacctcagcctcccaaagtgctgggattacaggcgtgagccaccatgcccggcctgtgtcctctcttatttccttgagcagtggtttgtagttctccttgaagaggtccttcacttcccttgttaggggtattccaaggtattttattctctttgtagcaattgtggatgggagttcattcatgatttcgctctctgcttgtgttttgctggtgtataggaatgcttgtgatttttgaggcgcagagaggttaaacaactttttcagagtaacacagcttgctagtgtagaactaggactcaaacctgccaagtgactgtgtcgttagatcgtctctctgtggagcctggccttccccctgcacccacatctcaactgcctcatttttttcatgtcttgttgcaagcagccggtcccacagagtgagaaaaatccctgtgaaaaatgtcgcaagtgtgactggaggtgtgggaaatgcatacacaaacaagcccttatctgcaactttcaagtccaaaaatttgtgaaagtcaagctttattcttaacccatttggtggcaaaacctgatttggactgatgtgaggctatttataaatctatgcctgtaaaatgtttgtgtttgtttttttttcttcctggtaaattagtatttcctttaaggctctttccaggaacatgctcagttttaagacccgattaagatcaggcacagcaggccaggctaagaggggcatgtgtgaaatgcagttctataccagagggaatgagggaaagtccacatgctcaccagcgaggcctctcgctgctcccagcactttttctgcttctgtcacacagtgctggatactagagtcaaattctgctttccctagtcatgaggctagaggagtctttctgcataaacttaagagcccaagagaaaaagcctatagatattgatatttagggtgttccaaacaaaatttacagctgactcacaatcaccctcccgtaagatccaccagttcagaagcactgatcatgcacacagaacatccggtcagtttttagtgtctcacttttcaatttaaaaagacagctaacgatcaccagatatttgagaaaagtttgaaacatgaaaggcagaaattaaaagagacaacaacagcactagaaactcacaagaaatagagaaaatatagggagcagaagaaaacttcacaaaacctgtaattactagtctaagagagataagagaatatgttgcattaataaaataaaagcaatgtgcaacaaagaggagtttcagagactaagaaagaacttttggaaattaaaagtgtgatagaagaataaatcagtagagggtttggaatatagaattgaagaaaacttacagaaccttgcagaaagtcaaagaaagaaagaaaatgtgctgggcgcggtggctcatgcctgtattcccagaactttgggaggccaaggtgagtggatcatttgaacccaagagtttgagaccagcctggccacatggcaaaaccccacctctactcaaaaatacaaaaattagccagacatggtggtgcacgcctatagttccagcaacttgggaggctgagatgggaggatcacttgagccaaggaggttgaggttgcagtgagctgaggttgtaccactgcactccagcctgggcaacagagtgggaccctgtccctcccgcctaaaagaaaagaaaagaaaaataagaaggattattctaagaagcccaacatcagaatagtaagactcgcagaaaaagagaatagagacaatgaaagggaaaatttattaaagaaataatacaagaaaaactttgagaacattgaaaggacattgaaaggcccacttgagtacctggggctgtgacttgaaaaaaagacatacaccagaagaaaagcttcttgacaggagaaaatcctccccccaaccaaatggattatatataacaatagaaatatgattgacatcatctatctctacagaagctaggagacaatgaagccattccttaaattctgagaggctagtatttccaactgagaaattatatcctgacaaattattaatcaaatatgagggtggaataatggcattttcaggtatgagaagtctcaatgattttatctcccacacagccttttttgaggaatctatgatgcatttgtttctccaaaactagacagtaaactaagaataaatgggatcttcctttaagcacagaaagcaaccacttcaggttgaaggaggagaatggaaggttccagaagggagatttttaagaattaaaaaaaaaaaaaagattagtacataatggtatatttagtgtactgtgatgagttttatagttttgttggaatgttgagggctgaattcgtgacaagtacatagaaagttaagcagacaaacaaatgaggtaataatggactctacaaatggcaactaagaaatatacatgaaaggaattaattgtaacaccacacatggctcagctatgaataataatttatctggttataataatgtaacttaataattacttgacaaaataatgtaacttaataatatagctattagtgttgacttaataaaaaatggtataactattgggagaatgtgggacaggagaggtggtatatagaatggtggtaaggagctaaatccttattttctataataggaagttagtgaataatatctaatattgaaaaaaatccagagccatataagcgtgctatttagatacactgagatgactctggaaatagatacaggagttgaaagacagaattagggatatggaggggtggggcagggcctgctgtttctccttacagccttgcagtaccactggaccttaaaaatcattggtgtgtgttgctttgatttaaaaaagggctcaatgtgccgggtgctgtggctcatgcctgtaatcccactaatttgggaggccaaggctggtggatcacttgaggtcaggagttcgagaccagcctggccaacatggtgaaaccctgtctctaccaaaaatatcaaaaattagccaggtgtggtggcatgcacctgtaatcccagctactcgggaggctgaggcaggagaatcgcttgaacgtgggaggcggaggttgcggtgagcagagattgtgccactgcactccagtcagggtgacagagcgagactccatctcaaaaaaaaaaaaaaattaaataaataaataaataaataaataaaataaaataagttaaaaagggctcagtgtctccccctgtatccagattggcacctaaaataggcacccaatcaaagctgaatgattgtttgctgtagagaacatattaacaacacaatcaaataaatgtgcagaggtaccctcctttggaaattttgcatatggcaatggcagaagagcttcccttttctggttctctaaatgcagacaccttttctctttttgtcagagctcacccatgtactcagtgtgcaactcatacttagtttcagctctttgctggaatctcttggcctagcactaaagggaagataaagaaaagcccctgggaggcagctctgggaggcagctttgtgtgtggaactctggcttagtcacttacctgctttgtgcccgtgctgtcaccaaagctcttgtcacctcatctgaaaatggagaagacactcctcgcttcataggcttgtgtgaagaataaatgaataacttagtacataaagcacctggcacacagtagttgctaacaaaaaaaaattgaaattaaaaataaaggaacatttatggtgaatattattaggtctaggacaggagccccgtaatgttggatctgggctccccatatgaaccatcaagaagggatgtgagccctgggagaggaagagggggacagaaataatccggaaagtctccttatcttagcagacgttcttactgtgttttgggtgcagtgtcttctgatttgactgctgtgttcagcagatttgtggagacccagatcctggaatgttttatgcacaaggatcaataaaagctcttagcttatttcacttccatattcaaacataatcaaaaccattgctcacatctcagacaatgtggaagaatggctccagggttaaaagggttatctcacgctgaggctcctgggtgctgagtggggatggctccttgaagccaggggcttggggccacagccttactgctgtgacaggtgaacccctcctctgagtcaacacagagcactcgagcaatggttctgctttgaggggctgggccatgaaattcttggctcaatttatgaacttctttgggttccttggttcctggtgagctctccaaatcctggttctgggtctgtggttggtgcctcacacatggtacacttacttgaaggaaacacttgctggaggcaagaaggagtcactgcgcccaaggcagcctctcatttagccaccctcttccttagaatcatcttctgtgtcatctagatgcttctgggtctaagggcagaggagaaaggggattggctgagctgctgccaggggctctagagttgggggacagtgcagtaagggctgccccaagagataaaacagagaacaggccctgaggagaaggaaggagttgagcacaatcttggctggctgggcctcgagaggaaagtagagagaccaaatctgggtgttaggcccagtgacccttgtgggataggagggaggtcagagagcagaacttgtggtgacagattacagagcgttatgaattaagtggaaactatattaaaatggccaggaagcacgtgagtagataggaggcttggggaccctatgatcagctgaatctgcagtgctgagtatggtgataggaggaagttatataatctacttaatagaaaaaaaaaactttagaatttaagatagaagagtcatccaactacactttagcaatctagcgtggtcctgtcagtagatttttgtttcgttttgttttctgttttttttttaaattttttaaatcttttttattttgagatggtacctgccaaccctagtggcccgcggccactagactcactacatacctgctgtcctgggcctgcatggtgtcctgtctacctctcccagggcctctgccctgctctctttgtaggccagcttcctctccttccatagagtccctgtagctccatcatttgatctttttttttttttttttttagatagagtctcactctgtcactcaggctggagtgcagtgattgatctcggctcactgcaaatttgcaaattccacctcctgggttcaagcagctctcctgccttggcttcctagaaactgggattacaggtgcacgccaccatgcctggctaatttttgtgtttttagtagagacagggtttcaccatgttgaccaagctggtcttgaactcctgacctcagatgatcctcccgccttggcctcccaaagtgctgggattactggcatgagccactgcgcccggccccatcacttgatcttgtgcatggcatttgcttgtcatggttccaccactacctttcccttcactctagggtctaccaccagctgactagagtcttttttcacagttgcagttttgaaagagtgtcagattggcccagcttccttatgtatggacgaattgtctttaagtcagagttctaccctttgtccatcaggggaagtccagatgaatgagcaagtggggtaggggcagggtgggcaggtagaatgacttgcctaaatattggagatctgcaaaccattttccaaaggacttaagaagcacaaaaggaatcccccattccctcatgaagctgcagattgctatggctggagtgtagggtgcatgagagtgacagggcatgaggctggtcagctggaaaggggcatgagacaggtccccaaggcttttgcctgggtcacagggctgagaaacctagttatctgtgtaggtgaattctccatctctcactgaaagtttggcctggagtgaaaggaaggatacaagagctggctagggagagatggagagtggagtcttccttcctgttaaggaggcagagcagtcagcccagcagtgcccactctacctccaccccaggagcactttgctcttgttcccccaggagggctccttgtgggtggctcctagctgaccactagctcagctgtttgcctgtaaagacctcttccctgactgctctcatttccccacagtgaccctggctcctggtgttttgttggcattaattacaaacagcagcaaagtgcccgaagcctcaagcaacttgttctttttccgtctcaccagatgcctttgttgttcgccctgttctgtcctgaatctttgtgaggtcttgacgttaccacccatcgcatggctcacttcagcttcagttctgtctatcagcatctcccgtctcatgggatgactcttgtttctctttgtatctaagggtttctttcccctggacaccgtccttgtgtatctatcactcccctgtccctccacgggtttctctttctctccttacgaattgtcattcatgtacccctctttcccaagcttgattagcagagttcatttagcataatgggtcttatcttaggctggggctgagctgagtgtgagcatgaaaaatgaaaagtcagacttggagaactgcaccttcatttccactagaaatggttacaccaggtgaacgaggatatgtgggtgagggaggggcttgggggagagaggagtgttaggggaatgggcacatttctccattgctgggagcagtttctatggtaccagtagtcctgaaggtagcatgctaagactgttcagaagcctgaagaatttggaagctctttgacccagcacagttttattcctaagactgtgtccaaagaaaataatcatgggactccctggaagattttgtttcaaacactatttgccattagccaaaaacaaaacaaaaggctgaagatgacttaagtgtccaggcttggagggttgggtacaatttatggtacagctctgtggggcactatacatggctcattggagatccttgggtacgtatatattatgcagccattaaaatgatgctgctggagattacttactgacacggcacttactaaaccatgcctagctttattacatctttataaaaaatctgaaaaataaaaacaagaaacaggtagagtatgttatctgtagttatcttggatgaagaaagaatgggtacattttgtctttttcatttaattatattttctaaaatttatagattgaacatactttttctgacacaaggaaacacaattactttaaaaacaaatgccctctattcaggcaactataataatatatgggttgaaaatttaggatcagttaaaaatgcttccaaaatgaattagaaattaaattcactttaaaaaaaactttttttttgagacggagtttcgctcttgttgtccaggctggagtgcagtggcacgatcttggctcactgcaacctccgcctcccgggttcaagcgatgctcctgcctcagcctcccaagtagctggggttacaggcatgaattcacatttgtaacagcataaacaacatactataggtcaaaggagactgtgaacaagcttgatgtagttgttgattgaaatccattgtccgcaggccttctctaaacacgagacttgggcccgatctgtagctttctaacccttgctttttcttaccacaagtagtgagtagcacaaggattccacgactgtagcagagtttgctttgcccaatctgcaacttactctcaaattgtacaaccccagagggatgagtctgggtgaacatgtagctcgtttaggtcctggaaaggaggctggctgccccggagctggcagtgggaggagcaaagactctttcctcctgaatgtattaacgtatgtgcttctggtgaaactttgctttgttgttgttttttaaccctctgcaggcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgaggtaagaccccctgaagcccagcctgaggaagagaggacacaatgccttttttgcaggggcaggaggcagagggccttctcaggaaagaaggagcagttagttgtttctggttcagtcaaaccatctgcttcagcctcagcccgttgggaggcaaggtcaattggtggccaaagaggcttctgctttgtcagagcaggtctttggaatcttgatgggagttgtattttctcagttgctggtgaaatttgaattcccaagggaatacatttatcctccaggtaagactgcaccggattcaggtgaatgcttaagtatacctcctctgctctgcaagggagctcttgggaaacacacacacacgcacacacacacgcgcgtgccacgctctctctctttcaacccaagggtgacagagtgaaacattatgcagagaggttattccaaaacattctgggaagctcactaaaaattgattttaattacctagatatgttctgattataaaggtaataggtgctcatagaatgattggaaaaattctgttgtggaagaaaatacaatatatctgaaaccctgcccctgttaacaatcctccaggtggtattctattaaggttactctttaagcttccacaggatgttgatttttcctgtgtggaggtagaaaggtgaggcagaaggagaacttgtccctaatctggaaactctgtttcccaatttttatatattcaagaattttgcaaactgcttgttaaaaacgattaaaaacaatgggtggcttgaaactgaccacgatggggaaacttatgccatggaaatgggcaagtgctacaacccagggcttttttgttttggaaattccgattagataagcaagctgctggtttcagggcttaccctaccccaggctgtggggcatccggcaaatcacctcccctatgcattccttcatttcctcacctgtgaacggtaggtgcccagtaacatgagttgcgtgaataaatgaaagtgagatttccgtcattatttcatacaacaatcgtgagggtcccataaaataatgaaaacagaaatgttttgcgtacagtgagcctccctgcccctgtagagaggggcttagttgactgggcaacctttggtttagtggtagaagttggctgcatttccccctttggctcttgctccttggggagccttcggattactgacacccttttataaaggcagatgaaaacccaccatttactggccaacatctggggcacatttccttcccggaaaagtcacgaagttggtcagagaagtgtgaaaagggagcctcagcaatgcaggacataagagccagaactgaaatcagagtttttgactcataatctctaatgcgggtgtgggggacttcctgccaaatgtgaaattgcaacaaaagcctctttcttcaaagccctgctgttgcagcagattagagctaataaattagcataatgaagtcccagcctctgtccccctccctctgcttcctgaatctcttcctgtgtcccaaaggagggatagggagcgggtgggacatccgttaagcaccagtttatccttgtagaattgtaggttcagaaaattataaaggtggtaaggtctacagagtccatctggtcccacaccctcattttaagaacctcaggccactgagctggtgattaccagtgactgaggcgaaagtacgtactcctgggaggaagggagctcaggtggaggggtggaggatggagcactgctcaggaggccgcctcctcacagagcttacatataactggcagggaacgtggtgggtggtctccaggtgccagccctgcctcttctcttcctcgtccttcccctgtatctgaagtcccagtgtacttcctgaggtgcctctctagtgtgtttggacttaaggccatcagaggcctggttttctggtcagcaaaatcaactaagatcttattttttattttttcgggacagagtgtcgctctgttgcgcaggctgcagtacagtggtgcgatctcagctcactgcaacctccgcctcccaggtttaagtgattctcctgcctcagcctcccgagtagctgggattctaggcatgggccaccacgctggctaattattttgtatttttagtagagacggggttttaccatgttggtcaggctggtcttgaactcctgacctcaggtaatccgcctgcctaggcctcccaacgtgctgggattacaggtgtgagccatcgtgcccgacctaactgagatcttattctgagaatctttagatctatttatgacaaagggaaggaagggaagaggctgttgattgagctcatgatggttcccggcacagtgttttgtaatctgtctacattatcttatttaattctgcaatgagctaacaaggtatctatcccatgtcacggatgtggaaattgggtctcacagaggtaaagagacttctgcaagatttcacagctcataagcaaaagagatacactaaggctgtctgtgacctccacagcttctcaaagctagtgagtgctctttatggcaagcacttgcccacgtggtagttccaaaatgcagttcccacacacagagtctctcccgtcggggaatatcattccatctcggaagctctgtgaacagctgcagctcaaagtgcttggagctttgcaaaatgctacactgttcctttcaaaccccaaggtctcttccttgtagtgtaagatagcaccagagctgggagcatttatagagtgctatagtgtagtcctctcattcagctgatgccccaggaggtgaggcccagtggtgctgggcccccagatctccccgccagttagaagcaacaggcgtgtcagtccctggactctcagaactgtttcccggggagcgcacaaagacagatatgcttgcgtttcctctgcaactcgggaagagattattcctctggctagggggatttaattcagttccacagatacttactgaaagcctactatgtgccctgccaaatatctcagcttgtttgggcaagaaactctggcccacacttggacatacagatctgacagggacaagaggaggagcttccatacttcaaggctgtttagtaccttctttttccgtccgttctgtcaccactcatgtccagcctttccttcaagaactctaaaggagaaattatgtctcaagtagctgtgtgtccagggtttccagactcctgaagaggtgtttttttgtttgttcgtttgttttttagacggtgtcttgctctgttgcccaggctggagtgcggtggcgcaatctcagctcactgcaacctccgcctcctgggttcaagcgagtctcctacttcagcctcccaagtagctgagattacaggcgcctgccaccacacccagctaatttttgtatttttagtagagacggggttttgccatgttggccaggctggtctcgagctcctgacctcaggtgatccacatgactcagtctcccaaagtgccgggattacaagtgtgagcgactgcgcctggcccgaacacagagttttaagtacctaacttgctaactggggaacaaaccagcagatgggggagggagtcagggtctttggaagatacctactgagggacagggctgaggggaggaggcagagtggcagagggagtgatttggggaggcactgctacgtggaggtggtgccctgccttcagctttggctcagcagggcactcagaacatgaattacagccgaaagagctccttggaaggcttgatcgttagccatcacgtctttcacttaaggaaatggaggcccagaaaggggaaggatgttatttgcagcatgagaggaattggagtctgttctgctgactgtctggtcaggtccttgacacaaaaccaccgtggcagtagaggccagggtgtcctggggagccggcacagcccacttcctgccttagcccatctggcccgggatgggctggctttggctgttggaggtatttgtggcagtggcaatccaagagagagagggtgtcattttagtgatgccagagatctcctgcagccccagcccctcattctcatttggagccttctttgaggtcttgcttaggccggggagttatggcctgtggcttcaggttgggaatttgccactgtagaaaggcatcacagtacggagaaaagtggcccagctttgaagccatttgacttgggtctgagcctgacctgaccatagctgcatgacctcccggctttctgatccagtttcatcatctgtaaaatgggccgaataatacctaccttgagtgaagatgaataattatttatataaagttttttccccacaaagtagatgcctattagatggtacccattaatcttgttttatatacccttattgaggtgtaattgacagacaaaaccctgcacatacttaaattgtacaacttggtgagttttgacatatgtatacggtcatgaaactatccccacaattaagctaatgaacataacgattacccctaaaagtgtccttccgagctttatccctccttcctgcccccttccatctcctgccctccatcctcaggcaaccactggactaagctgctttctcacactataggttcgtttgcattttctggagctttatgtaaatggaattatacagcatgcatttttttttcattcagcgtaattattttgctgttcatcaatgttgtgtgtatcagtagtcctagttgtggatataccacaatttatttatccatttacttgttgacacacatttaggttgtttcaaattttggactattaaaataaagccattagaatcatttgtggaaaaaaatgttgtggggacataagtatttatttctcatgagtaatctcctaagagtagagtggctgggtcatgtggtgggcgtttgtttaacttttaaagaagctgccaaactgttgcctagagcacgggtaccattttatatcaccaccagctgtgtactagaattccaggcacttcacttccttgccaacacttggtatgatctatctttttctttttctttttttctttcttctctttttcttttttttttttttttttgagacagattctcactctgtgggccaggctggaatgcagtggcgcaatctcagctcactgcaacctctgcctccggggttcaagcgattctcctgcctcagcctcctgagtagctgggattacaggcacctggccaccatgcctggcctatttttgtatttttagtagagacggggtttcaccatgttagccaggctggtgttgaactcctgacctcaagtgatctgcccgcctcagccccacaaagtgctgggattacaggcgtgagccacagcgcgcagcccatctttttcattttaataggtgtatggtgatatctcattgtgtttttttgtgcattcccgtaaacactaatgatattgagcttcatttttatgtgctttgtttgccacctggatggctcctctggtgaaatgtttagatttttttacccatttaaagaaaattgggttgtttgtcttcttatgattgagttgtaaggtttccttatatattctacagataagtcctttattggatatgctttgcaaaattgttctccaattctgtggcttgtacatgacaggagatggaagcaagtaagctaattattgcaattcagttgaataagtgctgtgcacaggaagtgcagaggaagagcggtgatctcaggatggggagtcaaggaagcttccttaaggagaagctatatgaattggatcttaaaggaaatgaaaagttatctaggcgagggaagggtagcctcagtagaagttcgtatgtgccaaggcatggaaacaggaaacgtcgtggtacacacagtactatgaataatttgacctggttggaacaccaggattttggagcgaagagtctgaactggaatcccagttttcttactggctgggtgccttttctttttatttaactttttatttggaaacgattgtagatgcacaggaagttgaaaagatagtacagagactcctgatgcatccttcctttagtttcttgtttcttcttacataattatagtacaatatcaaaaccagccatctgagattggtacaacatgtgtatagtttgtgtcattttctcttgtgtgtaggttagtataggcatccctagaatcaagatagagaactatttctttttcttttctttttctttttttttttttttttaagacagagttgcactctgtcacccaggctggagtgcagtggcgcgatctcagctcactgcaaccaccgcctcccaggttcaagcagttctcctgcctcagcctcccaagtagctgggtttacaggtgcctgccaccacgcccggcaaatttttttttttttttgtatttttagtggagacaaggtttcactgtgttagccaggatggtctctgtctcctgatctcatgctccgcctgcctcagcctcccaaagtgctgggattatagatgtgagccactgcgcccggtggatacagaactattttatcatcaaaaaggtcttccttgtgctgacccttttttgtcaccctgcccccacctctgtttttcacttctataattttgcctttggagaatattctctaaataggatcatacaatatacaaccttttgaggttggcttttttgcactcatcataatgcccttcaggtctactaaaattgttgaatttatcaatagtttgctctttttgttaaattaccgaatagtattccatggtatgcatgtatcacagtttaattgtttgcctatggaagggcattttgcttaatttcagtttttggctattacaagttaagctgctatgaacaattgtgttctgatttttgtgtggacataaatttttgcttctctgatataaatgccgaggagttcaattgctaagttgcatggtgagcatattattttgtttttgaagaaacggccaaaccatttcctagaggggctgtatcactttacatgcccaccagcaacataatccacttcctccacatgcttgccagcatttggtgttgtcactttttctcaactttagctgttcccttgtttttggacacggagtttcactcttgtcacccagcctggagtgcagtggtgctatcttggctcactgcaacctccacctcccgggttcaagcgattcttctgcctcagcctcctgagtagctgggattacaggtgtgcgccaccatgcctggctaatttttttgtatctttagtagagacggggttttgccatgttggccagtggccagtctggtctcgaactcctgatctcaggtgatccacgtgcctcggcctcctgaagtgctgggattataggcgtgagccactgtgcccccccaacgttagctgttttaatagatgtgtagtgatatcttattgtggtcttaatttgtgtttccctaacagctggttgtgtgcctctctttctgctcccccagtctggctgtctgaatctagaccacagcctgtactccttaagtgttggaagcaagaagatttggtgctgacaaaccccctcccatcattttcagagctgccccaggaatctgacttccttgttcttcagcccagttcaccagttataggaaatctttagtcattgtcctgggtagcccatgaaaagtgatattttatagagctgtgtatttttccagggaggattgtttttgttcacagatgagcaaacatcctgtaagtgctgatttttcactgtgctttccaccctgttcctccctggtgccagcgtgccaacatctctacttactggcagcctagttgaagaaacctctagagttggcccaggaggactgttttctcagtgtttagagatcatacagtgccaagggcagctgccatggcctcaagccttccctagctcagcatcttctactctttcctcttacagatggagaggcaacttcaatgcactggggaaagaaacgaacaatgacagtgaatgatgatattgcacttcttatggaccaggctctaagtgttttatgtatattaattcacttaatccccatgacaaccctaagaattgggtacaatttataactccattttataaatgaggaaacaggcatagagaggtctcatagctagtaagttggaatttgaacctggggagtaggacacccaggtctgtcctcttagtcattatgctatgctacctgctactttcttactttctttttttttttttgagacagggtctcactctgacacccaggctggagtgcgcctgggagggatgtcatctcactgcaacctccacctcccgggttcaagtgattctcatgtctcagcctcccaagtagctgggactacaggcacgggccaccacacccagctaattttttgtgtttttagtagagacagggttttgccatgttgaccaggctggtctcaaactcctgacctcctgtgatctgcccgccccggcctcccaaagtgttgggattacaggcgtgagccaccatgcccggccactgcttgttactatgtgtacattacctgcactagggtggatagaacctcatgtggcacacacatgacgccacataacacggctcatgtgttcacagtgcccagcacagaagcatgcacatagtaggtgtttatttaaaaaagttgattgaatgctgaatgagtgagtgggcactcttcactgacgaactggggtaaggcacatactccctgtttgatttcagtgtagcactgccctatagctgggcaaacaccttggtgtctccccttaggagcatgtgggaagaagaggaggatttgccatgagctttctctgggacaggagcagtttgggatgttgagatgggaaatggagtattgagaagtgagtgtatttccagggggaatggagaggtctttggagacctgcattggccatgggctccccagttgtgagtgggctcaggctctggatcaccgctgggaagatacccttctatttatttattcattatttttatttttgagatggagttttgctcttgttgtccaggctggagtgcaatggtacaatctcagctcactgcaacctccgcctcctgggttcaagtgattctcccacctcagcctcctgagtagctgggattgcaggcgcccgccatcatgcccagctaatttttatatttttagtagagacagggtttcaccatgttagtcaggctggtcttgaactcctgacctcacgtgatctgcccgtcttggccttccaaactgctgggattacaggcgtgagccactgcgcccggccctcttctgttttctgagtctcctgtgcactcagggctggctcacatatactgcaggaagaggcaggaggaggatgacacaggggactggaccttggaggatagcacatgattgcactggccctcagattttcaaccccctgcctgtgcagcagtaaccttgactgcattgtagagactcccatccacttcatctcacccttgcccatcaggggtgtctgggaaagagaggtttctagcctgacagatctgagttccaattgcaatgcctcagttgcctcacctgtagacagagcaataataatagctggtttgtagattgttgtgagggcaaagtggagaagtgtcttagggagtgttggctccctctcctaactctttgcctctcctcctctcctggaggccctcttcatgaacacccagctgtagggcagtgctgcactgaaagaaaacgggacatgtgccttacccaagttcagtcagcgaagagtgtccattcactcattcagcattcaatcgactttttaaatgaacacctactgtgtgcttgcctctgtgctgggcactgtgaacacatgagccatggcgcttgacctcctgtagcatgtgagctaaagagagagagacaaatgctaattaaatagtaacacaatcaaatgtgaaaccgtgaattgtgggggttgctgtggaggaagctctgtggtgttgcgtgaatgaaccacagcctgggaagccagtggatagatacttcctcgggaaagtgatttcatcctggggtttgactctctagctttgggccactggagaggccagtgtggaagattcagtaggatcagtccactttatgctatatcctgactataggctgaccaggcgcctggccaccccagggccctcaccccgcctccaacagcctagaccgttccttgagattacccatatccaaccatccacaggtgctgccgatactgcaggaaccgactgagcttggatcccacaccttacagacccggagcatcttttctgttgtttatttttgggttagctcataactcactttatcactcagccgaacagtgagccaccatggaccatggtggttttgatcatcatacagatatttaaagacaactttattgaggtacagtttatattccatgaaatcaacccatgttaagtatacaattcagtgattttttttagtaaacttactgagctgtgcagttgtcaccacaatccagttatagaacatttccgtcattagtggggtcagctttagatgcaaaagacaggagaattatttttgtttttatgggattagttctgtgctcccagcaggaagatctcattaattaattaattaattcaattagtatttactgagagcctggttggggggggggcgcccacagcagggttgggtgcaaagggaaataaataaataaacaagtggtgggggctgcttcactgtggctgatgagcttccactgtcaagtgtagcctaacttgcctgctcaggtggggttcatggcagctgcagggcaggtttctgctttctaccctgtaactcttattggaaggcaaggcaaaggccttcttttgcaatacctggtattgcagtgaattattgactgagcagacagagagacgtgtcctcgccaacatctacaaatagctctgggctttggcaggcctggatgcaggatcttggaaaagaggagcgtgggtctgctgtttacagtgcaaagatttgacaggtgaaattggggcgagggtgcgctgagggaggaaaggagtgcaggcaacgtcagggccggtggccagggtgaatccagggaagcgggtgcctgtgtgcacggtgggtgttgcttggaggctggggagtgagtgggagtatggccttgtatactagactgagaggcatttgcacttaatggagtaaacatggaagatgcaatttcagtgtctgaggaggagcttaatgattcagagctggacttcaggagattaatcttttgtgagaagataagcaagggatgggttgggagactgttgtgagggtcctagtattagatgatgtggacttgacttggacaggggcattgaggcaaggaaagaagaagtgcaggggagagaaagttctgccaggtgatggggagtgattcttctctgtccctgaggttcgtacctgcctggccatctgccttttgctgttcaaccagtctccctctgcctgtccacaactgaacttccccacagtgtgttcttccatggcctctttgtactctcccatccacttcttccctcttgttctacttctcttgcccaggaggaaggagaggatccagcgaaagagatggagagaaacagaacactgtacccatgaaaggcagtgccagggcaggcagtggagagagacttccagagagggtggctggctgtgccaaacgccacagaagtgagtgaggctggcactgaaggaggtctgggggactcacgattgggactagggtgagacctcccttacctcatcccaatcctggccctgggaggaactggggacctcggagaaagcattagtttacaacaaactggaccaagtgtgggactgtttcttctgaggacagcctcccagcctcccataggaaactgcctgcaactgctcgggacccactggtctccttcttccccaccccaagacagcccctcagggtctccacgggctcgctagagttcctgcacacagtttcaagaccacagatcaaactcacctccctgcatcctaccacagagaactctgagacccagcaaagtacctgacttgtccaaggtcatccagtgaggtgtgaccttgtgggtctttcctttgctttcctttgatttctcatcttcagttggtttacgctctccttttattcacctcccccaaccttcccctcctccgtaagaattggaaacagagagttgatagttgaggtctgatttatagctgaggattgaggtcaaatttgtagctgaagattgaagtccatttactgagtgcctacttctaccaagcattgttttagaggtgtttacatacatcattttatttcattctttttttttttatttgagatagcgtcttgctctgttgcctaggctggaatgcagtggcactatctcggctcactgcaacctccatctcccgggttcaagcgcttctcctgcttcagcctcccaagtagctggaactacaggcatgtgcccccacacccggctattttttacatttttggtagagacagggtttcaccatgttagccaggctggcctcaaactcctgacctcaagtgatccacctagtttggcttcccaaagtgctgagattacaggcatgagccactgtgcccggccttaattcttataagaccctttcaaagtaggtgtcattaccctattttcctgatgaagaaatagaggctcctagagactgaatggcttgcttacctttgtatagttactaactggtgctgctggtttatattctctccccacgcatgtatttcttcagtcactcatatttacctagtgctttaatgccaggcactgttttaggtgctgataccatatgaataaaggacacaaaaatcctgccaagaccttctccatttgtggcttgcttgccagaggagatcggcttgttctttataaagtctcctgtgctagatgtctcagggctgggtatagcagctgctgtgtttattggctattgctgagatgaaattcatgacccgatttgctcctcagccagcaaggcatgtggacttctttctgtctgcttccgggggtctctgaagccttctgctgaaactgcccctaggcgagatagtttattctgtaaggagtgtgactgtggctccctcccccacggcttctcccccatttctttgcttttatcaccagcggtttcccttagccaccaccgctagcagaaccctgatttagttccacgatttagccctgataaaggcgagctattttggcttcctctgccctaagccccagggagaatttggactcagtgttttcacttgtcattttagactgttggccagagtttgcggaagaaggcctgtattattaatgcccttgccgggaacagctgcaccctgccaggttgtcatgtgagacctctgaaaagctcagagctacaaggcccacagctctcctgggcccactgggtcaggtgggaaatatgatcctacagaaactgcaggcagccaaggagggcggaaggcaacttggaaggaactgatcagtctcacgcaggagacacagccgtcctctgagcgcctcaggagggctaattccatcccgtgcctccaggggcctgctgtatttgaagatcttttagcctgagggattttatcacatcatataaaagacacataaaataaaaatgaagatattaataatcagtttaataatatttagagagccattattccttgtagtggtcactatcctcatcacttgaaatagttttaattttcagtacaagcctttgaagtgaatgggacttgttattgccatttaatagataagaaaacagtctcggccgggcgtggtggctcatgcctgtaatcccagcactttgggaggccaaggtgggaggatcacctgaggtcaggagttcgagaccagcctggccatggtgaaaccccatctttactaaaaatacaaaaattagccaggcgtggtggcgcacacctgtaatcccagctacttgggaggctgaggctagagaatcgcttgaacccaggaggcagaggttgcagtgagctgagatcatgccactgcactccagcctgggtgacagagcgagactccgtgtcaaaataaaaataaaagaaaaaagaaaaaacagtctcagagaggttaagggaattacccaaggttatgccaggtagtaaaggtagaggtggaatttgaacatagtctatctagctggaagctcctgcccctttcaggatgctgtgagccactagacacatcatatttctctgactcctcctcagtttatctgtgcagttggttcccactcctctctctccacgttactctgttaacagcttctggagcctggtgttccaggagggacttgaccagagttcactatctgctgagccaggggttagctgggtggatggtggggctgcaggccagaccaggagccagaaaagatggtctctggcaccctttcctttattcacggaaatggcccctcttcacctcttcgtgctccatcaaagctcctttttagtgctgggagcacaccacggagtttagagaaaacaatctaataatgttatttgcttgcttagaaaacctccaccagtcccagttgcttgcaggataaattgggactagaaatacctctgtctggagcagatgtcctgtcgaagaccatttctcatcactgcagcccttataccctgtcccacctcacagcttctccccatccctgaacacaatgggccactttcatgactgagcctttgcactgctattctctgttgggcatgccttgctctgcttggtgaactcctgttcaaacttcaaaacccaggatgaactttaccttttctgacttctgacttcctctagtagagttggcaccacctcctcggcccttagtttttaatgctttacatgattttccacccactagtttatggtcttttctctaagacctcagcagcaggagctgggccctatttatttctgtatcatctgtatttggggcatatttgtgtgaacaaatgaatgagggctcattgtaaaacaaactgtatataaagtgtgagtcacaggtggccccactttaactgaaatgttaggttaggttgggggaattcagagaaaggagaggtgataccctgaggcctagcgttattgattagttgaccagtgagctatgcactctgcctggagcattactgcaaatgagcctaggacctattgagagaaggtcccaggggtgaagtaacagtgggaggccttacagttgggaagtgaagcttaggtcttccctgttctccaggccagactcaaactctgtgcctgatctgcttcccaagagaggaactccttgggcagacctggagaaaaagtggggattttggatggtccccaaaggagggtaggggtagaagaggagtcgaaacagagacaggaggaagtccaagacaaactttccttccttaatacatagtgctcgggggcatccttctggctgtagcatctgcgtaatagctgctcctaagaatgcaacgtgagctgaattcaaacatgaatttggagccagtacctgaatatgtgggttgttctatgccaccgggccccctgcctgtttaatttctccttcccctgctgccaaggcttccgagaagttgctgtgtaggtgcttaatgcttcggagatggtcaggtatgagtttaaatcctggtctcgggcactttaattgctaattgtgtagcactgagcaaaaataatagggatgcagcttttatagcaccaatcaggtcagtgatgttggtgatactgttgagagcttactatgtgccaggcattatgctaagtggttgatgaccattatctcatttattcctccgtataccctacaggcagatgctgtcatcattctgaaattccagatacgtaactgaggttcagagaggttaagtaagttgcctgaagccataaaacaaacgatgatggaatcagatcatggatcctgatatgtcacaccttaaccattgtgccattggtctacaatttgcctgatcctaagaatcacctgagactcttgttaaaagagcaattcccaggccctgtctcagattcagattcagcccagctggggtggagcctggggagcagtggatgcagcgggcaccctggatgatactaggatctggcaagtttaagaaacgctatattgtgccttcctgcctgtaagttgtggctcatggttggccctcaagaaatgttagctgttagtattataatataaatgaattgaaaggacagcttattgtgaaagaatatacgtctttaaaaagcttattagtcctgacactagattttaaagatagaggtcggatgggcgcggtggctcacgcctgtaatcccaggacttttggaagccaaggcaggtggatcacgagatcaagagatcgagaccatcctggccaacatggtgaaacccattctctactaaaattacaaaaaaaaaaaaaaaaaaaaaattagccaggcaaggtggcaagtgcctgtagtcccagctattagggaggctgaggcaggaaaatcacttgaacctgggaggtggaggttgcagtgaggatcaccccactgcacaccagcctgggtgacagagactccatctcaaaaaaaaaaaaaaaaagatagaagtcaaggggaaatagattctggatcaatgaatctatactctaatactctaaactcaaaactatctgcaagtgggatgtgtgcctttataggtccctgtcactagtggtcaagcaatcagtgccatcacgtgttgggtgtgatggctgagctgttcttcagggacccattcctcagtcagtgtctgctgtatacatgcagctgcagaggacatttgtgcactgaggagggctttgggtgtgttaatattctagaagaggtggagtagagcagctatgcaaagcaaggaagaaggcaggaggtgttaaaagaaaaactttagagaaaataaatgtagcaaagttcatctgagcaaagaaccatgtgtgaattggacagcactcagaaccagaagaggttcagagagctctgctgccgcagtgaggacagtgagcttttgtaggctgaacgtggaaagaaggctaagaaaatatattttattagagtgggaagaccctagttagaggttagttggtggtttctgattggtgaagcctctagttacattttactgtttacattgatttggattttggtttgcttatgtagaagctctggttatggagacaacctcaggctaacggcctccttcttatttgctttaacagagggatggcagaggtagaagacagcagatatttgagggccatcactactgccttgtaccgtgggtaacctgcatgaagtcttctctgtagcttcagagcatctagatccgctgtcatgccaccaatacactaaggcacttcattttcctcagggagactgatgatgtcttgttatctcttattagcattccaagtcttatcttatttttgaattctcaaggtccatttttgggcatataaattactgaaggcagtcaggaaatattgttccatcagagctgggagaaagactcaacccttatcctggtccattgacctatttccaacctcagctttgatgacaaaactcagcagaagctttcttacagactaagagcactttataaaacactgcttaaagctgaaggaaaccctctgaatgaccacccttgaatacctcctttactaagacccatgattatctgggagttagaatccataataatagctgccactgtgcacagtgattgtgtgctgggtgctttacatctattttctcatttaattctcctaacaactctatgatagcagtcacgctatgatacaggtcacactggtattgtttcacaaatgaataaacgggcctagaaaattcaactagatttccctaggttagcagtggagttggacttcaaacctaggtctgtgtagctcacaaatgaacacttattatgcttataccattttgcctcattagaataataggaagtccttccttttttggtgaggaagaaatttagagattggttaccctgactggtgatacagagcaaagctatgtacaaattgcatcaaagggtggcagatccctacattcccatctaacatcacatcattcctaacctttttccatgtggataagcatgaccttagtcaagtcatttcttagtaagatagattgttggttgctcgtgactctcagtgaagacccagtaatgccaagaatcatggcagacagttagggggaatatgtatcttcaactatggggcagtatggcaaagatattgagggccaggaatttgactacttttgaggagcgatgacaactgagtacaggaagtgagaggaagggagcatgtaccgtgtatcatttaatcaaccttgagcttgagaccaaagggaacataccctaagtttaactaggatgggtttatccagatataatggcatcacatcgtaaattgaaaagtgtctgtgtgtaattctctctgtcttatttcttcgagaaggagtttcgctcttgttgcccaggctgcagtgcaatggtgtgatctcggctcactgcaatctccgctacccgggttcaagtgtttctcctgcttcagcctcccaagtagctgggattacagtcgcccgccaccatgcccagctaatttttttatttttagtagagacggggtttcaccattttggccaggctggtcttgaactcctgacctcaggtgatccagccacctcgtcctcccgaagtgctgggattacaggcatgagccaccgcgcccagccccaattctctctttttaatagtaatctaattacatttatttggctgctttgttttctgtctcaggtacgctaagtttgtctctcaaaactctttgtgggcaggaattgtagtttatatggtagtgatggttgtattttaatttcacagagtgtctagcaggtaataattagccaataaaatgtttccattcattcaccaaatatttactggatagttaccacggtttgggcactggacataaaggtgctagggatacagtgataattattacttggcagttgaaatgcttacggttttaagggaagacagacatgtaggcacattaaaatgacattttaatttgattagaatataattgagatttaagtaaaacttattgggaactcagatgggaaataatgagaaaacaaagagagggaggcagatttaagaaatattctgagagtagaaaatagaagcttgcgacctattcagttggaatcaacactgtttataggattgctctaggggcagtgaggcactggcgtggacagtgatccaggggcactcagggtgagggatgagttgaatatgaggtgagaaaaaagggaagttgaagataccaagcttagcaaggtagtaagaggtggagagaggaagggaggggattataatggttattatatagggagtgcttattactatgtgcaaggtaattaacacgaattgcctcattttttcctcataataaaagaagtaggcacttttggggatacagacactgagagcagttgagtagcctgtccaagatcagacctttgaggagtggaggagttaggtttacgcccaggaatccttgctccagagtaaacagtcatgcagctgggtggagaaaaattccactagctgatcaagaacatccgaaaagctctcatgctgataactcccaaatatggatctccagctcacaccttctccctgacctctagactttcctatcaggcttcctactttacgctctgtttgacagtctcatctcaaactcagaatatccaaagctgaactccagatttcctctgcccccaggtctgctcttcctttgtctcctctttttccattaaagtagcaccatccgtctagttgcttgggctccaacccttggaatcatccttgactcttctctctctcacactcacatctaaaatatcgggcatgattttcaaagcacgtctaaaatatacccacttctctgcctccactgcaaccagctggtctaagccatgagcatcgctcactgggactgctgctgtctccttactactatccctgccccctattcctgttcccacatggcagcctgagcaattctggcatattaagtcagatctggttgttcctctgctcagcctcctgcagcagctcctattttatttgctaaaagccagagttcttgccaagacctcaaaggccctgcccagactcctccacctccccgacatcgttgtttgttcctcccggaccccgtctccatgtaccctcttccttgatcctttccttccaaccagtgcacaccagtgcactcctgccttgagccttgccgcaaacacgcttccccagatattgtgggactcattcctccactatctgcaactctttgttcaaatgtccccttctcagtgagttctcctctgactgccctttggaaaatggaaacctacctcaacccagtacttccgatctcccctttctttccttcccttcctcccttccttccttccttccctccctccctccctccctccctccttccttccttcccttcctcccttccttccttccttccatccttccttccttccttccttccctccctccctccctccctccttccttccttccttccttccgtccttccttccgtcctttctttctctctttctctgtctctctcttttctttctttctgagatagggtctcgctctgtcacccaggctgaagtgcagtggcacgttctcggctcactgcaacctccacctcctggattcaagtgattctcctgcctcagcctcctgagcagctgggattacaggtgcccaccatgacacatggctaatttttgtatttttagtagagatagggtttcaccttgttggtcaggctggtctcgaactcctgacctcaagtgatccgcccacctcagcctcccaaagtgttgggattgcagacgtgagccactgagcctggccctatcccccctttcttgtactctactttgttctctaagcacttagcatcttttaagataccaaataatttttttaatttgttatatttacggctcttagtgtctccctctgctagtatgtaaaactctaagggtgttgatcttcatctgggttattcactgtagtatcctatgcactaagaattatacttagcacttagcaaatgtttaatacatttttttttaaagtgagtaagcgtagaatataaagcttttgtgcaggtctctaaaagtttttgaaaggatatgatctgaggctaggcactcccagcactttgggaagtcaaggtgggtgcatcttgagctcagaagttcgagattagcctgggaaacatggcgaaaccccgtctcttcaaaaagtaaaaaaaaaaaaaaaaaattagctggtcctggtggagcatgcctatagtcccagctactcaggaagctgaggagggacgattgcttgagcctcagaggtggacgttgcagtgagccgagattgcgccactgcgctccagcctgggtggcagagtgagaccctgtctcaaaaaaaaaaaaagaaaaaagaaaaagaaaaaaagacgaggtctggagtctgagggagatgtcactgggggctggtcatgtggaagcaggaatcttccccgtgtatgtgggcatttcaggactggcaggaagctggtcccaggggaggctaagctggggaggatgcctgaaaggcattagtgggagggagtttgaaaaagacccagagacgcctgtttgaaataagtattggaaaggactctttagattttgcaattagaaaggcagtttcagtggaatgatgtgaaccgacttcagttatttgaggaaccagtagaaagtggggaagtgtaagcaagtcaagagaccccgccataaggaagcagagattaggttgccgtttgaggaagtgatttgtttgaggtatttttttttagctccacaaaatatcatgtttcgggtgtgagtagggatggggtaaatgacacactaagctaataacatccaaaccagcttgtgaaacatcgtgcaagttatatctggttcataccaaagagtcgctactcagtccaggcctctatcatgcctggcacatagtgttgaatattgtattcaataaatattcaacagtaaatatttgttgaatacagtattaaatactatagaatttagacaggtccctgtatcaacaacagcaacaatgaccaccaccaccaccaccaccaccacaacaaaataacaagaatgtccaatgtagggggttgctttttgatccacttgcctttggctagtggtgtctttctctccttagcgccatattcttcagcacttttcggcagctgtatgtggttctattttggtctcctctttactgcacggcgattatgttttcaagaggcaaatcttcagggtgactagagtgacacgttatctgagttctggatggaggtaaaggaatatcacggtgagtctggggaagcaaggggacaagagagttggccaaatgaggcggaaagaccccagacttgcgatcagaagaacctgatgtcaaatcagatgcatcttatagcaagtcgagccacctctctgaaacttgaatttaaatgatctaaggtcatttcctttggattttatagaaagaatagtgtcaggagaaaaagaaaaacaaggaaccatgacttgctaaacatactcagaaccaaaggttttctttctttccttttaaaaaaaagtgatatacagtgaatacaggcttagttccctaatggtggcaaatgatgtaatgttcacagatgtcctgggggaaaacagaacaatcaacttctattttactcttaccatttctgagagaagtcaggcagactgcataggaaaggaaggaaagaaagaaggaagggagggagggaggaagaaagagaaagagagacagggagggagggagggagggaaggaaagaaaaggaaagaaagcaaggaaggaaggaagaaaggaaagaaaggaagaaagaaagaagaaagaaaagcccctaaggttagtaagtatcttatgtccctggaactacgctaggcacatacataccttaccaccttccttatccagtgaagggtattacatcagtgttttaggtaacctacccaaggtccacagctaacaatggggagagaggatacaacaagcctttgggggagaaaattgaagcccacggcccacaagaaataaagccaagaaatgtagttgcttaaagtcagccagattccccagcacccagcatagtgtcttattcttaggagaatttgagaaatatttatttatctaagggatggttggttggttgaacgaattacctgaggaaacctgaaaatgttttttgctgaagtgctgttgaaggtcctcaagatcttacggagatgggagaaacctagggggagagaaataaaatttaaattttcaaaaggaataattataaaccaactgtatcaggcagtaactgagttgacctatggaaaatgcatagcacatggtagtactcaacaagtgataactatgatatttaagggaattattattatcattaaataaatatgtttctgctgctgcttcttatgctagaacttgagacacagagttattggggctcgtatttaaaagcactttagtttttctgtatgcataatatcccatggtgtaaggtaacctcttttccagttggcagtcatgcctagcttctcatacctctgctttagttcctgtttgtggtgtcggcacagtaaaatttatatatggccatatagcctatatgttaaagaccatcccaagtatctcctcagtggtcaggcatttttgtatgatacagaagcatacactttaattgacattggttgtggtggtaattaacttaaaactcttcgattagacagtgaacatctttgtatcctcagtaacaggatttctgttctcatagacgacatggtaaatgtggactggatgatggttcagttggtttacacgtagggcttctggaagtgtctctaacgggtgctaatttgtgttggtcatggggataatgcttcctcagctctaacctgtgatttagattaacacataaagggcttgttgatcacactgacggaaaatttgaagctgagaggggtagaagctattgtatatgccagaatcgagattccctataaatttaacagcttacaggaaggactgagtgaggaaagacaggctgcaccaatataaatgtaaagacctagctgtaggctccaaataccaatggttaagccaggctgtgtgtgtgttttggggtgggggggtggtggtgggggcgggtggtggtggggttaaggattaggacttgtaagaaaagttagtgaggttatcagttgctcacactctgtaatcccagcactttgggaggctgaggtggggggaatcacttgaggtcagaagttcgagaccagcctgggcaacatagtgaaatcccatctctacaaaaattacaaaaattagctggaggtggtggtgtgtgcctgtattcccagctactagggaggctaaggtggaaggatggcttgagtccgagaggtggaggttgcagtgagctgagatcacaccactgcacttcagcctgggcgacagagccagagccagaccctgtgtcaaaacaaaaaaccaaaccaaaccaaaccaaacaaaacaaaaaaaggctagtgcacctgatttcaactaagtgagaatcattaacatgaagctactaaaaactaaccagaaactttcagtatttgcatcgtagaggtgtagtcattcctcttgttttacagtaattgggtcacacctggaactgagcttattgtcattcttttaagagtgaggggggcaaatggaaataggcccagaggacaataaacagaaaagttaggagattcagaaaccatattatctaaagaatgattcaaagactgagactatttagcttgaaaaagagaaggtttagaagagtgccatagtcttaaaaggttgttttttggaaaaaagaacagacgtttgttagaaccaggaaatggatacttaggggaatggggaagagttcagtccaacgtataaaaacatttcttaattaatattttgctctctgcagacaggctgtcttgaaagaagggttgtcattattacagatgtggaagtagatgctggctggccactttttgttgctactgagtgggggatttttattcatcagatagaggattgggctgatgtccactaagatcttttctagctgtgatggtgtgttgctagacctcacagagcatgaagccctatgcaccatgttcgagggaacctggataacattgttggcaggctagtgggagctggcagaaagcttgagctttggatgcaaagctaatgattaaaagctttgtgtatttgacttgctgtcagcatagagaacatatcaatttgagtttatgtaagataattagtattccaaggtgcccaccaggtagcatttactatttgaaaaatagcagaataactgagggcatttgattttgcatgtcttctcccaagggatctcagggaccctgtggacctcctggatgtccttccagcactgctccagcaaggtcccggtcaacactcttacttcacaggaacccttccttatccacccttatctgtaggggcagtctttcctctgggtgctgtagccacaagctttggagttagatgagttggtttgaatcctagctctgtaccagctccatgaccttgggcaagtggcttagttcttgactgcgtcttgctctgtcgccctggctggagtgcagtggtgcgatcttagctcactgcaacctgtgcttcccaggttcaagcgattctcctgccttggcctccccagtggctgggattacaggcacattccaccatgcctggctaatttttgtattttcagtagagacagggtttcaccatattggccaggctggtctcgaactcctgacctcaagtgatctgcccgccttggcctcccaaattgctgggattacaggtgtgagccaccaagcttggcctaaagcttctcatctctatctattgaatgcaggtgactcatttccacctgccagattcttaatgatcattagagcgagagaaactgcccagcagcacagcactagcatgtgttcatgttcagtccatggtgttaatatttgtgatgataggcatagactattgatagacttgatgactatattcagtcatctgtgggtagctacttggtgtgaagaattccttggctggggctgaggagagttctctacctcacctcaaccccagccgccttctcccatccctccctcttagaccaatcccttcctacaggatgttctttttttttttttttttgatttcctctaaaaaatttcaataaagaaaataaagcaggaggtagaaagcaggagaatcgcttgaacccgggaggcagaggttgcagtgagccgagatcgtaccattgcgctccggcctggtcaacaagagcaaaacttcatctcaaaaaagaaaaaaaaaaaggatataaaccagcttctggcattacccaggagcagctgacctagatgcttgttccagtaagttctcctcactccctctcatgcttgtccgcctccccacctcctccacccctgcttccaggctgtctgcagaccgctgggccgggtttcacagtattggcgtgaatcagcttgccaggcttctaccctttgtgcttggtggtagctaactgacttttttctttttctcatgtggtcaggatttttccactgaagcatttcttttatgatgtgggagagacagatagcacctggctagttgccttcttttggacttgctgtgatttgacttttcagccaggccaggtatttattttcccttgggtggagtgtggttctcccagagatgcctcattcatgattcatttgttcagggcatacaaaaggcatttcttaggacctaacctgggcctagcggtgtggtaggtgcctgggcttcagagaaggctaggatggttgctaattctctgaaaggtcatgccctaatagaggaaacggacatagaaactgtgaggggcgctgtcttggggtctgtacagggtgctgtgggagcacagggaagggttcctaactcacactggggatcagggaggctttggctcctgatactaaatgacctcttatttgatacactttttatgtcagacttgctggttctttccacacattgagtcaaagggtgtctctggttcctccctggatggactgatacaggccatttcactcactctcccaagggtttatctcctctggcctctccgagtctcacctggaggtgtgtgttcctgtggcgtgggttccttgggagcgtgggtgattcaccggctggcctcatcccatactgatcctctggggtgatccctattcaccttgtctcctttgctgtcataactccactgctgggggcagaggtggagatgttgagcttgtgggcaggaataagttccactgagccacagagcttgactctgctcaccttcccacaatagaactcagagttggaatcctttccccagccacctcccctcccatctgaggacagagggtaacctgcccgtcatctctggggttatctccaattttcagtctccctcatctccagctgacctcccatatggccaaatcgatcctgaggttgggaatccagttcttcaaactgagcccttcagactctgctgtggtacgtgaaaacagtttcagtatcccgccataaataccttccaaaattctaaatgtagtacatgaccattgatatggtttggctgtgtcccacccagaatctcatcttgaattgtaatccccatatgtcaagggagagaccaggtggagggaattgaatcatgggggctgtttcccccatgctgttctcatgatagtgagtgagttctcacaagatctgatggtattttaagtgtttggtacttcctcctgctgccttgtgaggaaggtgccttgcttcccctttgccttgcaccatgattgtaagtttcctgaggcctcccaagccatgtggaactgcaagtcaattaaaactctttcctttataaattacccagtctccggcagttctcacacagaagtgtgagaatggactaatacaatcatgaccttaaaaaataaataaataaataaataaaacatggccgggcgcggtggctcccgcctgtaatcccagcactttgggaggccaaggcgggtggatcatctgaggtcaggagttcaagaccagcctggccaacatggtgaaaccccgtctctactaaaaatacaaaaaaaattagctgcatgtggtggcgggcacccataatctcagctactcggaggctgaggcaggagaatcgcttgaacctgggaggcagaggttgcagtgagctgagatctcaccactgtacgctagcttgggcaacagagtgagactctgtctcaaaaacaacaacaacaaatatttgaggcctacttttttgagaacagaaaagcaaattagacgtggtccttgcccctaaggtgctcacagtccactatctatctaggtcagatattttccactgctggtcagtgtttatgaggcaaactgtttactaacttgcctaacactgcctgtcccgtgcagttcttcctggattgacggcagctagatcctgtgacagaggacagctgttccccgctccctcccatcactcccctcctctgtctcctggccatagctgtgggctgcaactctgacttgagtgtttgtgtccctagtgcgtttagcttcgggtgggggctgcctttgcaggtactcgataaacacctgcatggggagttgaaataacaagttcttaaaggaatctaattcgagggcacactgctggtgggccctgtttggtggcccttgggctgagcacatgctttgatagttcactctcagaaacatccagtctggttcttaagtggccagaatgacccgatggagttaagatttcccgtttttggcatagggtcacctgtacgtctttcattctaaacaaaaaagtcaagcatgtcttgtcctgttctctcaagcgtgttagcgagatggaagacataatggtggccagagaagctggaagcaaaactaaacagaggtgcagatttgcagaagctaccccttggcatcacggggtgcagtttttctctgcttctcagttagataacttgacagagttttatttatttatttatttatttatttatttatttatttatttatttatatgttttagaaaactaagaggcctaggtaaataactgtgccttaaagcccttctttccaaccaggagtagcagcatgctagaaaagaaaagggtgggcctgggaaactagatttgaattttggttttgtcactttctagctgtgtggtctttcgaaaatcatttgattcctctgagcttcagcctcttcacctgtaaaataatcaacccacagcattactcagaagatttacaataaaagagaaaacctagcacattacgttatgtaagcgatacttataacaatgatgataatgataataatcatcatcataataacaattgaatggtgggctctctgctgctgcatgtaggtagacatggctctacttcgtcatcagagagggtctctgtggcctgaagcactcggcaggctccttgccttccacatatttctatgtgttgggatgagattgtcttcaatccttaaatatcaactagtagaagcctagtacagcttcaccttggaggagaaaaatatgtcgattcagctctactcagcaacttttttaaagtggagagattgagagagaaagagagagtaattgaaataatgcccacagttctgacagcctcttgatcagctgaaagcccacaagtgcaggtggggagacatgaattcgagttctctcagtctctgtagggtgagcagcttgttggtccaggtgtgatcccagtatttaaatgtttgtctttttagtgtaacatggtagtaaactgaagacaattacttcttctggtgcacatcctgatccctttcagggctggagtctaacacagctgtgttagattcactgagtgaattttatatgagtgttcagggctgtataaacagaccatatattctgtatttcataggtgattcaaagtggggggactttttgtttgtttaactttcatttactgcacatgaatagtcatacaaaataagatgttattttaactgacttcaaattcagctgtttattttttcatttttgctgtagatatttcagtatgtatatttaaaagatagagaccctttaaaaataggccggggcgcagtgactcacacctgtaatctcagcactttgggtggccaaggcggccaaggagtttgagaccagcctggccaacatgatgaaactccgtttctactaaaaacacaaaatttagccaggcatggtgggcgcctgtaatctcagctacttaggaagctgaggcaggggaatcgcttgaacccaggaggcggaggttgtagtgagccaagatcacgccactgcacactccagcctgagcagcagagtgagactccctctcaaaaacaaaaaaaaaagagaccctttaaaaataaaaactacaagatactattatcacattcaaataagtaagtaagtaagtattccttaataccagatatggagtcaatattcaattttcctcaattattatatatatatgtgtgtatgtgtatatattagtgtttgagtgtatgtatatagatatgggtgtgtatagttttaaaatagtttgtgtattcaaattaggatccagataaaatccaagtgcaatagattgataagacctttaagattgttaaaatgggccaggcatggtggctcacgcctgtaatcccagcactttgggaggcctaggaaggcggatcatgaggtcaggagattgagaccatcctggccaacatggtgaagccccgactctactaaaaatcaaaaattagctgggtgtggtggcatgtacctgtggtcccagctacttgggaggctgaggcaggagaattgcttggacccgggaggtggagcttgcagtgagccaagattgcgccactgcactccagcctgggtgacagagtgagacaccatctcaaaaaaaaaataataataaaataaaaaaaaaataaagaaattgttaaaatgcaggctgtgcatggtggcggctcactcctgtaatcctagcactttgggaggctgaggtgggtggatcacctgaggtcaggagttcgagaccaacctggccaacatggcgagaccccatctctactaaacatacaaaaattagccgggtatggtggcttatgcctgtaatcccagctactggggaggctgaggcaggagaatagcttgagcccgggaggcagaggctgcagtgagccgagattgtgccactgtgctccagcttgggtgacagattgagactctgtcttgagaaaaaaaaaagattgtttaataaatgcttttaatcaataacttcccacgggcggggacactgatttgaaatataatctttgggtgaggtgtgtggctgccctgtctctgtataggtagacacaggcccacaggtgcagtggccatattatcggtgcgtgtttactcccatcgcatgtaccattcctctcacaaacacctgcttcctgatcatttgtctttttaaataaaaatatgatatttgagattcttttattctctttaaatatttgaatacagagtctatttgaaggaccagtatattgaatagcagtaatatttgaaggactagtcagctgtagaagccttgacttcagatcttcacccaagaaactctgtgtatttgcttttcctgggccactcagatagacaattgtgtttttgatacagtaagagtttgcagcttagcttaactagaaataatccggatcttattttggaattaggaagaaacatgttatgatgtagaaaagcctgctctgttacctacatgatggcatagctttgtgcttttcatgctttgtggccttggaagggggtagatagagtgtaggtggttaggagttgtttcctggctaaaaataggaacagcatactgtgagacaggagcttcttctctcacaagcctctgtgcaaatagcggagggttacgcatttgctgcaggtggtacttaagctccaagaacttacggcacacctgcttgagtggatcatgggtgagctggagaacctgaagtagcaaaggcaagaaggcaacgacgttccatctgtggaaggacctaccaaccaggtatctctggtgacagggctcatctcataggtggcccactgtacatcataccctgatgttttctttgcatgacgtgctatagaattccaggctcatgcacacctttctgctctcctgttttgcaaatgtctgcactctagagtccttcctgttggccactacatacgtgtcccccgcttcttgcccctctctgcttgggtccctgctacactggtatcctgcactttccaccttgtattgccagtttgtttccaaggccatctccactttgagcttgttcatgaccacctcacacagcacacttggtctgtgtggtggtttgaggggttctgtctgtacactgtgctttggctgtgttggaggcgggcaggtgggaaggaagaaatgtattcttggggagatttgtttttagagacatgagacatggaaaatagttaagtaataatataatatgggaggcatggactatcagaggaggcaggcaggactgcccaacctcctcactgggcacgttacgctacttcctcctgacctctatagtcctttgcatttatcaagcactgtcatacgtgttatctcatgcaatgaccagggtgtcaccccctgttttgtaagtgacaaaactgtcactcagagggatgaaatgacatgctaaaggtcatctagttagtaatggtggaatcagggctggagcccagtcttctaagcctagttcctattctgctcttcatcatctgtctcaggatggtaaactgaggcctggaaaggagaaggaactcacccagcctaaagattaagggttttatgctggccacggtggctcatgcctcccaacattttgagaggctgaggtgggaggattgcttgagtccaggagtttgagcccagcctgggcaacatagtaagaccctgtctttacaaaaaataaaaaaaaatagccaggtgtggtagcacacaccagtagtcacggctactcaggaggctgaggcgagaggatcacttgagcctgcgagatcgaggctgcagtgagccgcaacggaatcattgcgctccagcctaggacagagtgagactctgtctcaaaaagaaaaaaaaaaaaagattttagacagtgctgaccatattgagacaatgctgactggtgagtggggacggagaaataaagaactaacattgtgcagaactgtgttctcagccagtgctatctaatggaaatagaaagcaagccacaagtgtgggctgcatacgtagttttcagatttgtaatagacacattaaaaaagcaaaaagaggccgggcatggtggctcgtgcctataattccagcactttgggaagctgaggcaggaggatcacttgagcccaggagttagagaccagcctgggcaacaccctgtctctattgttatttttataaaatttaattgtttaaaaaatacgggaagtaaaaagaaacagatgaaattaatttaaacaacatagaactacacaggggttaagggcactagctccctgtgcagttgaaagtccatgtatattttctgaaagtagactctgaaaaataagaaaaagaaagaaaatccacgtataacttttgacggtccctaaacttaatacgaatatcctgttaaccagaagccttactgataacataaaaaactgatgaacacatattttatatgttatgtgttttatatactgtattcttgtaataaagtaagctagggaaaagaatgttaggaaaatcataagaaagagaaaatgtatttattatttagtaagtggaagtggatcctcataaaggtcttcatcctcatcatcttcacattgagcaggctgaggaggaggaagaggagggattgggtttgtttcaggaatggcagaggtagaaggagggcgagggggaggcaggagagacaggcacacttagtgtaacttttattgaaaaaatctgcatataaatggaactgtgctgtttaaggatcaactgtattttatttaactcaatatattcaaaatactcttactttctcatgtaatcaatataaaattacgaatcatactttctacattcctttttccataagaaatcttcagtgtgtatttttacacttacagcacgtctcatctggcctagccacatctggctagtggctgttgcattgtggagcccagttctaagcattttacgtatattatttcatatagttcaataatcacgtgaaaagtttattacagaactatctaatggttgaggaaatgaagcccagagaggttaggtaacttgcctggggggcacgaagctggaaagcaacagaactggatcctggcctctccctcctcttcccactgtggccaactgccagccgaccaggaagggggcccgggggcaatgcaggggtatcttatttccaaaccattgttaaacttgctcttgtggaggcagctggccctggggaagtaaagggaatcctcctttttaaatgcatatgcgaaagttaagggaatcctttcactaggcggtaagcctctgtctagggccgtgggaccattaacaccactcgcctcgtagaaggtgtgtgtcattcaaggtgataatgcataggaacagctcagctatgtcagggccaggccattatgggtgctgaataaatgtgtttctgtcccctatgctaaggcaagacatccggggaagaagtaggcccggatttgtcgccttgaaggaagactactataatctcttttttttttttttttgagacggagtctcactccgtagcccagactggagtgcagtggcacgatctcggctcactgcaagctccgcctccctggttcaggccattctcctgcctcagcctcccgagtagctgggactacaggagtgcaccactgcgcctggctaattttgtatttttagtagagatggggtttcaccgtgttagccaggatggtctcgatctcctgacctcatgatcctcccgtcttggcctcctaaagcactgggattacagtcatgagccaccgtgtccagccaagactactatattctaatggagggtaagtggagtaggagggccatgtgcgtgctctgggggcaacaaacttggtgctaaacttgtttttcttgttttactcacaaacattatgacagcagtaaagatacacttttatttatttatattttttttagagacagagtcctcctctgttgcccaggctggagtggctattgtagttcactgcagccttgaacttgtgggcttgggatcctcctgtctcagcctcctgagtagctgggactataggcgtgcactatcacactgagctattttaagaacatttttgtagagtatgttggccagacggatcttgaacctctggcctccagcattcttcctgccttggcctctcaaagtgatgggattcataagcatgagtcatggtgcccagccaagatacatttttaaaatgtatcctgcctcctgacacattactgttcacttgtaacaatggtcacttgtaatcatagtctgtttgcaaagcaagcttttaatagaattacaattttagtgttgaccaaaagtttattttgggccggatgtggtggctcacgtctgtaatctcagcactttgggaggctgaggtgggtggatcacctgaggttaggagttcgagaccagcctggccaacatggtgaaaccccatctctactaaaaatacaaaaaaaaaaaaaaaaaattagctaggcttggtggaggtgcccgtaatcccagctactcgggaggctgaggcaggagaatcgcttgaacccgggaggccgaggtggcagtgagccaagattttgccattgcactccagcctgggtgacaagatcgagactctggctcaaaaaaaagtttattttgtttctataaacattgtttttcatctttatagtgcatgtcttttgttaatggcttcataggcaatcgatggacttctggatcacaattttgcttgttcctatggctagatatttaggttgttccaaattttctcagcattacatttgatgctacagtaggcacccacacatttatgtttcttttctgtttttcaactattgttggttgttctgaggtattttcgtaaggtttcacttctgttttcccagccatgagtgatacatgagcacaactgttttgctattaatcaccagcattgggtgtgaaaatttactcaaagttttgctaaatttaactggagtagaaatgggccatgcatttgtgcgtacttccccagatgctttttagaacagtgcttgtgtaactgaccagagtgtcaggtgaggccattgttggcagaaaggtgccttcctcgggagaaggtgggttacacagcttttctttgcagatgaatggtgagagccaaacccgaagacccacaggtttcaagctggccatgtggcttcactaagtttggcctcaacttcccacagtggcacagaagcgaggtagaactcagtgttcctacccgaaccctggacattctgaaatgtccacagcccgaggaaagggatgacctgcatgtcactttccataccctccactgcacatagatctgtctcaggcattgaatcagagggatgtgtgactttggacaaattattttacctttctctgcctcatttcttcatctaaaatcaggtgacagcaatgtctccctgtaatattgcagtggggattaaatctgttaatacttgaaaagtgctgagatcagtgcctggcacataagtagtgctcaataactgttgtaaacctgggtttggatctcacttccattgctttctggaggcccactttggtcaaatggctgacctttctggacttcagcttcatctgtaaaatgggattatggcatctacttcagcatcatgttaggggtttaagtgagaaaatgcatttcacacagtgtcctgcacataaagggcccaccatatatgtaatgaaaaacaaacaaacggccgggctcagtggctcactcctgtaatctcagcactttgggaggcccaggcgggcagatcacgaggtcaggagtttgagaccagcctggtcaacatggtgaaaccccgtctctactaaaaatacaaaaattagccgggtgtggtggcgcgcgcctgtaatcccagctactcaggaggctgaggcaggagaattgcttgaacccgggaggcggaggttgcagtgagccgagatcacgccactgcactccagcctggacaacagagtgagactttgtctcaaaaaaaaaaaaaaaacccaaaaacaaaacaaacaaacaatgtttttagctttattttctactctaccaaagagagagctttgttgccttatattggtgttgtaattagctgttagatctgaccatattttctgttatggtgtatttttaagtccacattctaggtttaaggccatcttgaaacaaatgggaggcaaatcaacattttcgtgtgtctgaagcttttaatgtaattttgttttggagatgaatgagctcataattccacaaagaagggatgatatttcatatacttattagtttagtgatttccctcccacacttagtgtcaaactgtcaggtttatggaagctatcaaatgtttctttatgctcagcagcacagatcaaagttgtctacatgataaggtaaaaaacatattctttaggaaatgcaaagaaatgacccaaaagacccttgagcacagctcattcctctccctggtctgtccaactttccctcaggaaaagtcaatgtagtcattatgtctggaaaatgccaaggacttctttccctcattttttacatggccttgcactctgtgaggcattggctgggaggttcattgtggctttcttgccgctaagcatctcctctctgccaacatctcatcaattcctgtctgtgccaattacctttgcttaggatttggggtgaggaaagttgtgtgatttgtctgtttctgtttctgggtaaaatctcaactctgggcgtatcagcagaaagggttctgaaatgtcccttgattcagatgattctgaatcaatagcatgtatgtgtgtgtgcataattacccttacccagaaaattctccattataattctttaaaagcacaggttcacaaattattagaaagtatattttgtatactatttacggtagcaaaatatcaaatgcaagaagcaagtttaattaaagataggcaagacattttactgaagaatataaaacattagtaagagaaataaaacaatggcttatgcaattatggaaactgacaattaccaagatctgcgactggcaaggtggaggcccaggagcagcaatggtgcagttccagtctgagtccaaaggcctgagaaccagggaaagccaatggcgtagttctagtgcaaatgccagttggcctaaggcctttcagtttgagtccaaaggcagggggaaaaaaaccccaaaaccaaaccaaaccaaaacaacaacagcaaaaacaatgccccagctcaaggcagtcagacaggaggagctccctcttacctgtgggaaggtcagcctgttttactgtattcaggcctttaaccgattggataaggcccaccgttagagagggggcaatctgctgtactcagcctgctgattccagtgctaattttatccaaaacaacctcattgaaacacccagaatatttgactaaatatctgggtactctgtggcgcagtccagttgacacataaaatcagccatcaccatcaatttgggggaaaattgacattttaacaaaattgaatctttcagttgatcagcatggtatatatcctccatttatttagatcttttattgctctcactagtgttttgtagttttcagtaaaaagtcttgcctatctttaattaaatttgcttcttggcattggatactttgctactgtaaacagtatataagatatattttccaatgatttgtgaaattttgcttttgaagaattataatggagaatttttaggagaaggataattgaaaatccgtcagacagcagtgaagtttaggaactaccattctggacataaccatacatcattaataaaatattccttacatccctatgctactttattattgccaaaacatttttttttcctttggtcctcgtaagggttcttagaaagagacagaagagctattatttctactttcatacaaggaaatgtggcctcagggattgatgtggtttgaatatatgtccccaccaaatctcatgttgaaatgtaacccccagtgctggaggtggggcctgctgggaggtgtttgggtcatgggtgtggatctttcatggcttggagctgtcctcacaacagtgagttctcatgagatctggttgtttcaaagtgtgtagcaccttccccaccactgcctcttgcttttgctttcgccatgtgatgtgcctgcttctgcttcaccttccaccataactaaaagctccctgaggcctccccggcaagtgagcagatgctggcaccatgcttgtgcagcctgcagagctgtgagccaattaaatctcctttctctgtaaattacccaatctcaggtatttatagcaatggaagaacagactaacacagggagactatctgaaagtcctatgactagcaagtggcagagccagccccagagcccaggacttttcctaagagagaggtcctgcttctgataccaaagtttttctatagaaagatggccttttataagcattactgagaagatacctccaggtgcccaggaagaatctcctgcttgtagcctccataggcagtgtaggaggaagggaagaaaacagcagagtggaccaaggtagcaatatgtaatacactagagtcgggagcgagaatgatgtcctgttagcttatacggcactttcgtgctattaagaaaggatgccctttcagccagtaccagatgccattatgcagtgaacaacttgtacagtcatatgtgacatcccagagagaaaacaacaaatacagaaaccttacttattcaggaattaattattgatgaggaagctaaattggtgtttctttcctttagagaaattgattgaaaatacttcaagatgattcaaagctaaaagagaagaaatcatctttctttcttctcccttttacaacctttctatcttctatcctttctctttctcctcttcttcctttcattactcagcacttattgagtgccagggcatgaaaatgcagagataaatgaggtggcatctctccctaggagcttctaagtcttacaaacgtttttgactgccaccatcaataagaagtacattttatggtattgcagttttttttttaggtctttcttttttaaggtttttatatattgaaacatttattaatgaaatgatgagttcaggatttgtttcaaaatctagggatgtaggcgtaagtggggtatacacaaaacaggactgaccatgagttgataatactgaaactggtcatgggtctgtggggttcattatctgtcatccatgtttctttttctttttctttttttttttttttttttttttgagacggagtcttcgctgtttcgcccaggctggagtgcagtggcgcgatctcggctcagtgcaagctccacctcccgggttcatgccattctcttgcctcagcctccccggtagctgggactacaggtgcccgccaccatgcccggctaacttttgtattttttagtagagatggggtttcaccgtgttagccaggatggtctcgatctcctgacctcgtgatctgcccgcctcggcctcccaaagtgctgggattacaggcatgagccacggcgcccggcatctgtcatccatctttctaatgatctatttgagacaaaagtttcatgaagctctactttctcttattacatgcagtggattctgatattttaaaatcttgtttattctctttttaaaaacctggtccttgtgcccaaattgcttttgagatccactgatgtaaaataatacgtattttgaaaaacactggtgtatcgagggagagagggacctataaaataattgattactgtcaaccagaaagtgctactagaatatggtcagagggctgtgggagcacacagaagggaaggaccgaccaacagggtcctggggagtctgggaaagcccttcagtaacttgcatggaagaggagacataggcatctttgacaagatggtggggggatatctgaccttgaggatgagggaagtggtgcaagtggggtgagccaacctgagttcagtatggctgcaatgtgagggctgttggggagtggcaggaaatgaggttacagatagcagcagcagcaaaagtcactagtcttctgggacagcctaaggaatttatattttatctgtgtttcagggaaccattggaggataaactgagaaatggcccagttccatttgcctcttacagagatcattccgtcggctccttgtagatagaccagtctacctctgtggtctgatttagaacataaaacctagacccaaaggagagccagtctggaagccagatctaacctacctcatgtaatcatgtccccactctgccacatgacttctcagatctacacagaacacaaattgggctttttcaagtatttatcaaaacaaaaattatggtcactttcaggacataggaagaggtgaaaatagagccaattccctgtgtgctcctttccccttttccctgcatagggttctctcatctgtagagttacggcaacctgtgagagattcatagtaatcacctacagtgtggcatttttctaggtgctttacaactattaactcacttaatcttcataataattctatgtggtaagtattattattattaatttcatagatgaggaaactgaggtaaaaagaagtaagtgatttgtctaaggtcacacatctagcaattagcagagctggaattttggcaatctggccccaaagtccacttttaaccaccattgtgcttcttgattaagtttgatttcattccagtcatctccttagactcagatgtttgaacaaagagaatcgtgaaaaaaatttggctttaagttttattctcaagattgccaaatccctttcttccctaatgagaggaagaggaaagttttctagctgggagaaaaaggatggcttcttagaaggaagtggtattttagtggagttttgaaacatggatgagaagtaaattgctgagaaggatgagttgctagtacagccaagatgaaataatccaaccacaatctctaccaatgtttacaacagaaagctgaataggatgcaaaaaaccacatgaaaactctgaaaagtaatagcaggcaggcagagtactgggttcaaaacttgaacaatgactcacgatgaacatggatttgcagaacagtgtggaaagctaagagtccgagataactccatctttctaactagaggaagcaggggggaaaagccactggaagccagagagtgtgaggaaatccctgagaggagagaggtggaaaaagggatccacaaattggactgacaaaagtcctgggcacactacaaggtgtgcatgcatggaacagacccaggaggcacagaagaggttttgagaatctaactatgatattaacaaccacccaagtcccagacaaactcttgaatggagcatgtgacagattgactcaaatggcataccaaaagctttgaaaactgatctgacactggagctaacactcataaaaagtgagacagtactttcagtctgaacctaagtggattaatttcctggtaaaacaaacaaacaaacaaacatttttcagatgatttttaacaggattcagagtctcacaacatattaaaaaatccaggatacaattcaaatttactcaatatcaaaacaacctggaaaatctaaacagtactcaaaggaaaagacagttcaataggcagtaacactgaaatgacttagatcgtgaaattattagacaaataaagtaggtatgaccattctccactcttgaaattagaaagttcttgaaattaggaaagatagaagttctcagcagagaactagaaactgcagaataatcagatagaaattttagacctgaaaagatgatatgggcccagtagcggaataaatataacagagaaaagagtcagtgaacctgaaggtagatcaatagaaagtatacacaatgaaatatacattatgaaacaaaaaaaaattggagaaaaatgaaaagcctttcatggtactgtgggacaatgtcaaaaggctgaaacttcttggtattggcattccatctcagaaggtaaaaagaaaaatactggtgcagaaaaaaatatttggagaaagagtggctgaaatagtttcaaatttaaagaaaaacgtatcttcacaaattgaagaatctcagtaatttcaaacaggatacatttaataacaactcctcagccacctcataagaaaacttctaaaaaccaaggattaaaaaacattaagagcattaaaatatgacacattatacgtaagaaaagggaaggaagaaaagagaagaaaggaaggactcaagaaagagagaaagaaagaaaaaagagaaaaggaaaggaaggaaggaaggaaggaagaaacctattcgaatgactgtccatttctcatccaaaaccatggtggccaaagacgaagacagtgaaaccccgtctttagaatgctggaagaacaaaaaaactatccacccagaattttatatccagaaaaaatattctttgggagtgaaagcaaaatagagatattttcaggtgatggaaaaccaagaggcttcatttccaggagctctcctcttaaagaaatactaatggaagtttttcaacctgaagggaagctgtactagaggaaaagttaaaacttgaggaacaaaagaagagcaggagaaataataaatatctaatacattccccttgataaaaatacacacaaacataaatctcatgacatgggtaactacaaactactggcgatattttagatttatttcctttaagtcttttttttctgtgaatatgcgtttctctttttcttttttggtttttctctctctgtctcttcctttcatgtggacatttcataacatatttaaatattcctttttgttgggatttgaggttgtttcaggttatgcatggactgaagtcaaactacagtctttggcagcatttctgataattcttttttggagatagaattactgaattaaaagaagatggacatttttaatgctttgattctatttgtgaaattgcccaccctccctcccttcttttcttctttgcttccttacctcccctctttcttcctccctttttctttcaactaagattatgtagtatatagttttataatattctttatttattcaatctatattgtgagcattttcctgttttgttaaaaagtcaataattaaaaaaacttttaagtttttaaattatttttaatggtactatggtcgtatttttttaaaggtacataattacatgtttatggatggaatgatatgtctgggatttacttaaaatacttagggataggtggctatgaataaaacattattgaccctgaattgataattgttgatgctaggtaacggatacatggtggttcattattgctactttctatagttttctatgagtgcaattttttattttaaaactttatctgagtgtggtggtgtgtgcctgtagtcctagctacttgggaggctgaggagggaggatggcctgagcccaggagctcaaggctgcagtgagctatcactgtgccactgtcctccagcctgggtgacagagtgagacccggtctctaaaaataagtaagtgaataaatgttttaaaagtaaaaactgtaagaaatgtttatgaatttatttttaattgttcaatcgtgacccattgtggctgggcatggtgactcacggctataatcccagcactttggtaggctgaggcgggtggatcatgaggtcaggagttcaagaccaccctggccaagatgctgaaaccccgtctctactaaaaaatacaataattagccaggcgtggtggtgggcacctgtaatcccagctactcaggaggccgaggcaggagaatcgcttgaacccgggagtcggaggttgcggtgagccgagatcacgccactgcactccagcctgggcaacagagcgagactccatctaaaaaaagaaaaaattataaccctttgtgtggacatttcataacatatttaacttgtcctctttaaaggaagaggacaagttaaattgtcctcttgggaattgaggttatttcaggttattcatgggctgacataaaactgcagtctttgcttctctgaatacttctttttttgagatggaattactgggttaaaagagaatggtcatttttaatgctttgatatatttaatcaaattgtccttcagagaagacgttccatgttatttttccatgagttacttaaaagtgaccttgtcagctctattgtaattttttagtctattaatttggtgggggaaagtgtatgttattattttaattgaatttcttttatttccagtgacattgaatccccagcctgtcactgaattggttcccacccgtttagggaggaggcagagacaagagtagaagaaaaatgatttatttattttttgagatggagttgtccaggctggagtgcagtggtggtgtaatgcccaaccttgtttttactaaccctgtttttagactctcccttttcctttaatcacctagccttgtttccacctgaattgactctcccttagctaagagagccagacagactccatcttggctctttcactggcagccccttcctcagggacttaacttgtgcaagctgactcccagcacatccaagaatgcagttaactgataagatactgtggcgagcaatatctgcaattcccaggaattagtctgattgataacgcccaaagccccgcgtctatcaccttgtaatagtcttaaagcccctgcacctggaactgtttactttcctgtaaccattcatccttttaacttttttacctattttatttctgtaaaattgttttaactagacccccctcccctttctaaaccaaagtataaaagaaaatctagccccttcttcggggccgagagaactttgagcgttagctgtctcttggccgccggctaaataaacagactcttaattcgtctcaaagtgtggcgttttctctaacttggtcaagtacaacagtgtgacctctgcttcccaggttcaagtgattcgcttgcctcagcctcctgagtagctgggattacaggcatatgccaccatgcccggcaaatttttgtatttttagtagggatagggtttcaccatgttggccaggccggtctcgaactactgacctcaagtgatccgcccacttcggcctcccaaagtgctgggattacaggcgtgagccaccgtgcccggagaaaaaggatttattttctcttcctcgttcttcactttgaagatgagaggcaaacacagacagatcccagattcaaatcctggctctacaacttactagttactgattttgtacctttatttttctgaccctcagattttttactgaagaaatcagtgcaatcatgaactgtgaagtaatagacatttatagagaaaatgcctggggtgcaatggtcattctgaaaatggtagcttttgttgtccttgggaagctgaggctcaggatgtgaaacaacctcctgctctttttcagaggcggcaaggagctcagagctgggttccttcacacagggaaggccccttgcaggaactgctgctggtatctgcgtcattaattctttaccttttattcttccaggctcctgtaaccatttatccttttaacttttttacctattttatttctgtaaaattttatttctgtatcttccatgccctgctgggcatgaaggcagctatcacaggccaggaaattcatgttagggaattgggtcatcttagggaactaattcaaattgctaatggtatttatttgattcagtggaaatgcaccttgcagtacttgattcggaggactgggttgaatttcgggagggtttgtttgacattgtctcatcttactctctggagcaggattcagacctggaacgctctctttccagggcaacctagccaagctatggtctctgcctcaatttattgccctttccccaggactcacatcttcctccccactcactgtttgcccaggctccggtcatctatgttagtcgtgctcttgctacacatctgccacctctttcagaaggttgagagcagccaaaacagaaacgggaactgtggctctcaataaactgtctgctcgcagaccaagagagaagcgggagtgctttgtctgtatttactgcattttttttcattttttttttctttttttgagacagggtcctgctctgtctcccaggctggagtgcagtggcacgatctcggctcactgcaagctccgccccccaggttcaagtgattctcctgcctcagcctcctgagtagctgggataacaggcgtgcgccaccatacccagctcatttttatatttccagtacagacggggtttcaatattggtcaggctggtcttgaactcctgaccttgtgatccatccacctcagcctcccaaagtgctgggattacaggcaagagccacctcgcccagctgcactttttaaggttatttgaacaccaagcaattagtgcttctgggcccaggctaacagatgaggccagaaaaccccaccacactctctcagtcctgagcaagggtgctgctgatcgggcacagagccatttctcctgaaatcaagactgggtgccaggccgtagggctgccagcctgcctgtgatttctctctgggaccatctcagtgatttcctgttttcttcccctgagcacattcagtgcaagaggtctaagcatgagggtgggaggtgcggtgagtttggcctgttttccaaatggaggggaaatccagggaagtcagcaggcttcactgtgagtcgtcgggtctaccagcgtttcctatgtcaggccgtgagcacctgctctgtggaaatgaaagcaaatcttctccaccaggcaggggctgcagagggctggcaggggtgaggtggaagggctcagggagaatttaacaatgttgtgttttcatcttgatgatcacacaaaaatgattctgtaccagtcacgaagacttcaattcataatggaggagacctttagcgtcttaagtgtttcttgaacactgtttctttttcctctttaaaatgggagctgacttaatctgtaagccttatttcttatggctctatagaagtgatgaaataacagcactgtctggagagacttaaaataacaaacatttcctctgcacagtttaaagccttctcccatctattacttcccctgtgctttcccataactctgtgaaatagggactattaagcccttttttcacatgaggaaacagagactcagagaagataagtgacttttctgaggacacacagtgatttggttggagagctggaggacctcacatctgtgccctggtttcaggctttttctattagttcagtcttcacagtgacacacccttgaccctgcctcccacgagggtcccacgttcctattctctttgctgtggagcagtgtttgaaatagctaacactaaaagtggcaactattgttttgttttgtttttgtttttgagacagggtcaccctctgtcacccaggctggagtgcagtgatgcaatctcagctcactgcgacttccacctcctgggttcaagctattctcgtgcctcagcctcctgagtagctgggattacagatgtgcgccaccacgcctgactaatttttgtatttttagtagagacggggtttgaccatgttggccaggctggtctctgactcccgacctcaggtgatcctcccaccttggcctcccaacgtgctgggattacaggcatgagccaccgcacccggccgcaaatactggttttgttgagatgaacatcaaggtctcgtgtttagccaaagataaatactgattcatgacactccggaaaatttcatctcatccttgaaaatgaagacttttcacacccaacagcggtcaagccgggcctcagccttctgaccctcctcccctgcttcctggcaggtacaggtttgccagctctcatttattaagcacctggcatgtgccaggcactgcacaatccttacttctaaccctcactgcagtcctgtgaagtaggtgcttttgcacacattttacagatgaggaaactgagaccccgactgtcatgtaatttgcctaaaattgcatgctgattaataataaagccgggatccaaatctagatttgtctgactccaagtcttggtgcaaatgaaattcagcaccattcctccaaactgagccttgtctgagggtcttttgccttctcagtcttggtctttggtcccctttagttttttctgggcccaccgttttgagctcccagttaccagcctcttgattgaattgattgacctggatggatgtggtcaaaacaggcaacttcacagctctgcctttcccaggccagcactggggtgaggtgtggggagggcaggcagcccaggggcagctctgttccttctttgggcctgcttcttacatctccatcctcctaagtccacattctgtgcttggtcagcatgcaggagttgggactgttttgaggacttgcttatgggttgtggggagggaagggcactggcatgattgcaatacattcctgggcaagacatctggcctctcccatttgcggttccttcatctataaaatgttaacacagtgtgtcaaaatgttgatgttctcgagtgacttttcctgagatctttgccaattctcaaatcaacatccttatggtcattgttgccaggatctcatttattgtgtacagtagcctaagaggaggcattttgttcttgcttgacacatgacaaaatcacacacatgccaccagagcacataattcccccttacaccgtaaatacaatcaagcacacctgaaaatctaagtgatttcttccttattgattccacgaataaaaggcagtagggatttctaaatttgttaaaggaaattcatcactgagtgtaaattctccctaacatggactagcaattttgtttctctgggagccataattcacaagccaacaggtatttctgtcacttcctaatacatggagggtacagcatcccctgcacactgggttccagcctgagtgtgaactctcttgcgtacgaagggactggcccctgtgtgcttcttactgcacgcacttcataattactccttagcagacttaggctgtttcatgtctaggaccttcggagttattctcaaaagtaaaaatcccaaatgttgattctgtaaataccaagggtcaactataatattagcaatgatccagggctgctggaggattcaatgagataaaatgctaagtgtccagcatcctaagtgtgctctgggcttgggaccttgcacattcactgaaaatcactgaaattccagggttaggtgggcatggctttggctgaaagagtcacaggtcaaacaagatgatcatcttagtacaggcattaagagtgcagtctttcctgggtgcagcagctcacgcctgtaatcccagcactttgggaggccgaggtgggtggactggttgagcccagggggttcaagaccagcctgggcaatgtgatgaaacctgtttctacaaaaaattacaaaaattagatgggtgtcgtggtgtgtgcctggagtcccagctacttgggaggctgaggtgggaggattggtggaggctgggaggtcgaggctgcagtgagctgtgattgagccactgcattccagcctgggtgacacagtgacaacttgtctcaggaaaaaaaaataaaaataaataaaagagtacagtcttggattcagacagttctgggttcaaaccttggccctgccatttactagcagaagtcctttaacttctttgagattcaggtttcttatctgtgagatggaaaggataacacggtaccggctttggaggactgtggtgagattgaatgagctgtcggatgtccagacctggcacagtgcctggcacgtgggaaccccctaggaggcaatcacagtcacttttcatccttcctttctttctgtacagagccgcagacccagcaggtgcttcatgcttgttgatgatttcagttcctgtctaaaaccattttcttgtttacaaaataaccatcttccaccccaacacacaccacaagcccccgcggtggatgccagccagacattctattcatcaagcgccacttgcctatcctgtgcttggcagtgctaaaaaggagacagagaagggatataatcttatttttctgactggaaaaataagtttcccacacgcagcacctggagaagagtgcgggagtgcaggagagtgtgtgtgcatgtcaggagtgtgagtggaagtcgacactggtggaggactcctcactgcaggatctgagaagcttcctccagggacatgggctggatctggggctgcctttggggacctaaagtgaagggaaagagtaatgcgggaggcagttcgaggttgagatgaaccattgagtgatgacttctgtggatctgtcccccaaagaaaaatgtccaaacgttggtcaacatgctccattaagcacccagaaagtgcagatataaaatgttcttcaggtgtggtaaggaggaagcaaatgtgaaaacccccagagaaccagcccctgcctcccaggaggcaatgatgtgggccaagagcagaagttgagttctggccttggcctgggattgctcagagggtagcagcccctttgcccaagagattgagctgcagccgtgttgctgcctcttcatttggtgaccaaagacaagacaagatcaccacgtggggaggagacagaagtgaaaggcccacctcaatgcaagggtgattagctctttctccagcagtactgactcactttggcctactaatcaatgtgaattcttcataacaggcgatcccctttgagtccaggaggacagagttgatgacagtgtagcctgaaattcctggggccctggattgaagctgtggccctgccatttcctcagtaactctgagctgttattgggcaacagacttcctaggttgtggaggaggctgggttaactggggactttaaatgcttgagccgtgtgttgactcattaactatgtctaccctaggctgaactggtgttgcccttcccttcccaggaaaggcctggcctctcccattctgcccaaggaaaccctctgtgaacttttacattcttccaaactattctgatgtttattggtctggatccattacatcagaagctactgagggtaatatcaggcatctatattttaaaaatgcttcctaggtgatattaatgcccaggtaagatagagcaacaatgttctaagtggttcccttcacctacaccactcaccttcatggctgtgagattaggggtgggagggcaggggagggttacaccaagggccttgaagctctcaggacagacttgaacaacctttttctcctccatgttcccttcccctttttctttgtagggggtccatttggccttggacgggttctagcaatgacgtcagtttgttaagacgagcgaggtaaacagttgttgccttggtgactttaaggagaggtagttgcacttcagtgattctggcaattagaaaatgtcaaggaacactggctcagacttcctcctgcccagattgataacacgaaaaccacgacggacatggttggaaagaacggccgcctggcgcgatccccagccctggaattcctggaggacatgatatttaagaagacattagtagacattgtcctcactaaagacagagttaaagtggagtttgaataatcagacccacgttagtaggatttcagaggaaatccttatcttcggtatttcagtagaaatcgttcctgttttgttgccatttggttctcctttgcaacttagcatgtgagaattccgggcagcctgattccttgcccatctttgacagctctgctgctgtgtcccgggggaggcaggtttccaacataactgctactctgcctttgcctggtgagtgctgagatggagaggcaggctggtatctgtttgatctgatactccagaaaaatcgtaattttacattgtttttttcctgatttctaaacacatgaaaccagattcttctggagaaacatagagtgccttaattttgcctagttaggggctgttgggggtggtttttctaagcacccttctgtgtctagccaaccagtagaacctgatttttgggaggtgaattagccagggttctctagagggacaaaactaataggatagatgtatttataaaggggagtttattaaggagtattgactcacacggtcatggaactatgtgaggtcccacatagtccatctgcaggttgaggagcaggaaagccagtccgagtcccacagctgaagaacttggagtctgatgttcgagggcaggaagcatccagcacaggagaaagatgtaggctggaaggctaaggaagtctagtctattcacattcttctgcctgctttttattctggctacaatggcagcagattagatggtgcccacccagattaagggtgggtctgccttccccagcccactgactcaaatgttaatctcctttggcaacaccctcacagacacgcccaggatcaatactttgcatccttcaatccaatcaagttgacactccgtattagccatcacaggggcatgctaagcaagaattgtgtctatggctgtaatcacaaagttacgattattggagtaagctccacaaaccagagtcccttgtccagggcctccagagatccaccagacacttgagtatctcgaaaagccagatgggagaagcacgttcaccacggcaaacctgcgcagccaagaaaatcaagtttctttgttttatgctaaacttttatcaactgactgtggtagtcgtggcaatctcatgccattcagaacctctgattggcaacagtatctttgttcatttgataacaaataactcaaattttaaattaaagttagtcgacaacatctttcaaaatcttggaatcgtgtcgggggaaacaaaatacaagagatatgatttgatgtgaaagaatttaggacctcttggctttgattaaattagggtgtgcttctgttgtttcactgggattgtgaaatgttgggatgaggagatatgaaaaatctatagctgaatattctgttgatggttttaaaccatagaaataaatattcaggaagtctctattgagtagctctatagggtaatgctagctgctagagcaaataaactcacgtcttaaccatcttggcccagaagtgatgtatgttatttttgctcacatttctttgccaataactagtaaaatgatcccatctatatgctgtgtgtgtttgtgtgtgtgtaaaatgcaatccctctctggacagtaatttacagcaataactatatggcagaaggagcaaacttcttgtggggcagccagctatccctgatatgaggaaagagaaagaagggtcagcattaagtggcagctcaggtggcacacattaagaatccaagctcttagagaaatgggagtccttcatgggagagggtttctggcagccaggacacatggagcccctctcggaggcactatgccaccctctgggggcaacagggtgtcaagcactctaagtctaagaacagaaagtttgggttctaaggtccagatgagggtgaggtttgtgcactaaagattaaggagatgaagatcagggcagagtaaataggtgtcaccagaaggtcaatacagtgattagcaactgtagttggtgtgataaagcagagaggctcgcagtagcccttggaagggcctgagtagagggacataggatgaagagcactaccagtttgttggttagaataatctggtcagccgggcatggtggcttatgcctgtaatcccagcactttgacaggctgaggcgggtggatcacgaggtcaggaattcaagaccagcctggccaagatggtgaaaccacgtctctactaaaaatacaaaaattagccgggcgtggtggcgggtgcctgtaatcccagctactcgggaggctgaggcagagaattgcttgaacctgggaggtggaggttgcagtgagccgagattgcactgcttcactccagcctggtaacagagcgagactctgtctcaaaaacaaacaaacaaacaaaaaacaaaacacaccgtggtttcaccatttacagtgacatcttgagcaaatgacttaaactctctgagtttcaatttctttatttaaaaaagaggattgttaataccccaccccacagggtggtggtaagaattaaatttggtaacatctataagacctgctgttcattacagttgattcttaaggcagcatccggtgatgcctttgaaacatacatcggcaaagtcttaatcagatgaaagccaaaacccctacacctgtgtaaggcgccacattatctggctgcccctgtgtaggtattttgctgttccctctacttgcaaccctcttttctcagaaatctgcatggtagcctccttcatctctgttaacagaaaaaccaaattctgtaaaatattttcaagaagtttatcctgaggcaatatgagttactgtagcttagagaaaacacaaacccaagaagccttgagtgagtggccctgaggcagttgggccatagtctggttttatacattttagggagacaggcattacaggcaaggatatctggaaatcagtacatggaaggtaactggtagttctgtccaaaaaatgtgagacatctcaaagtgggggagggtgcggtgttaggatatatgtattggtggtttttttttttgtttttttttgagatggagtctcgctctgtcacccaggctggagtgcaatggcgtgatctctgcccactgagcctctgcctcctgggttcaagtgattctcctgcctcagcctcctgagtagctgggattacaggagcatgccaccacgcccggctaatttttgtatttttagtagagatgggatttcaccatgttggccaggatggtctcgatctcctgacctcgtgatccacctgccttggcctcccaaagtgctgggaatacaggcgtgagccatcatgcctggactatgtgttggtttccatgcatgtttcctggcgcatagccccatagcccttgctacagtcttgctagaatgctgggctttttagacttcagggacaggccctaagaaacagtctctctcctgccgtcctttcacctgccccaaggcaaggtttttatgttttctggcctgactgtgggccttacaaccctcccatgaggccaggcatagtggttcatgcctgtaatcccagcactttgggaggccgaggtgggtggatcacctgaagtcaggagttcgagaccagcctgaccaacatggtgaaaccccgtctctactaaaaatagaaaaattagccgggtgtgatggtgggcgcctgtaatcccagctactcgggaggctgaggcaggaagaattgcttgaacccgggaggcagaggttgcagtgaatcaagatcatgctactgcactccaacctgggcgacagagcgagactctgtctcaaaaaaaaaaaaaaaaaaaaaccttcccatgagaggttcctaccctatgccctgggggaagaaatgctgacgtcaaggaagcttctataaaaacccaagaggacagggttgggtgaactttctgatagcttaataggaggaggttcctgtagggcggcacaaccagggagggcgtggaagctctgcatcccttctcccataccttgctctacacatctcttcatctgtatcctctgcagcatccttgatgataaaccagtaaatgtaagtagggtgtttccctgagttctgtgagccgctccagcaaattaattgaacccacggagaggggaaccccaatggaagctggttggtcagaaagaagttctggaggcctggacttgtgactggtggaggggggatgtcttggacactaagccctcaatctgtaggatctgacactatttccaggtagatagtgttggaactgaattagaggacaccaagctggtgtcgctgcttggtgttggggtgggacccccacacatatggtcacataagtcatcttctgtgttgattgttgtggtgtgagagcagaggaaagatggctacagagagttttccctacacagggacttggggggtagagggttaggggagggctgaggggccttacaagtcttaagtgcgttttagggattctttagctaacagtagctgagagagtcaagttattgtctagtgacttgaagtcagtaggaaggaatgcctgagtaagataaggaggttgtgggggcctaggtccttggagcctcatagatagcagccctctgggtgaatagatagtgattgtctcttctcagacctttgggtgtctgactctcagttagaatctctcctagatctgggaaaggcctagcaagggaagagacattaatatcgattctctggagatgcacgtttcccccaccaaagatggctttgcagtccaaaggctgtctggcagccttttccaaatatgtcaaagaaatgtattttggggcaaaatattttaatttccttcagagtctgctgtctgtcatgtgatactataccagagtcaggttggagagtaagccacattttactgggttaattaaaaaacccatttaatgagactgtattgtttctagggtatgacttaatctttgccttttatggccttaggtattgtgtatagtttggtatcttattgtcataaagggtctgtttggtcagtcttataatctctattttaccttaatgctggtcacttgtacctaaaccccaaaagggaggggtatgatgagggtgtaacctcctttctgtcatggctgggaattcagtttttcaggtttctctggggtgcccatggccaaaaaggagtccattcagttggttagtggggggcttaggattttatttttggtttacacctccttccaacccttgctcaaatgtcttcttctcagtgaggctttctctgatcatctgatttaaatctccacctcacccactccaagctgtccctatttctcttccctactctaattgtctgcatatcagttatctccttgcaaagcaccacggatttatgttgtttgactctttatttatcctcactataaggtgagtgctggaggggttagggatttctggctggcttctctactgctgtgtctgcagtctggttcacagtaggcaatcagcatttgctgaaagaatgaacctatagcttggaaccaacccaaatgtccaacaatgatagactggattaggaaaatgtgcacatatacaccatggaatactatgcagccatgaaaaatgatgagttcacgtcctttgtagggacatggatgaagctggaaactatcattctcagcaaactatggcaaggacaaaaagccaaacaccacatgttctcactcataggtgggaattgaacagtgagaacacatggacacaggaaggggaacatcacacaccgggactgttgtggggtggggggaacggggagggatagcattaggagatatacctaatgctaaatgatgagttaatgggtgcagcacaccaacatggcacatgtatacatatgtaacaaacctgcacgttgtgcacatgtaccctaaaacttaaagtataataataattaaaaaaaaaaaaaagaatgaacctatcgcatgagtattggtgtaagttttcttacaggccccggggccaccacaaagtagaagaactcaaccttccctattcatttcctcacctccaactcccttagactaccaggacttagatccttttgggtatatatatacatatatatgttttatatatatacatatatacatgttttgcttgtttgtttgttttttgagacaaagtctcgctgtgtcacccaggatggagtacagtggcatgatctctgctcactgcaatctccgcctccaggttcaagtgattctcctgcctcagcctcctgagtagctgggactacaggtgcatgcctccacgcctggctaattttttgtatttttagtagagacgggggtttcaccatgttagccagatggtcttgatctcctgacctcgtgatctgcccgcctcggcctcccaaagtgctgggattacaggcatgagccaccgcgcccagcctaaatgttttatatatatatatacacacacacatatactctatatatatatacacacacacatatatacacatatatatgtgtatatatatatatatatatagagagagagagagagagagagagagagagtatatgtgtatatattttaacaaaaaaagcctgggagaaccattgaatttgaaaccaccaaatctcaacaagccttgaaatctaacactcagtttaaggaaacacagagcagagaggagaacattaaacaacaccctgaggaagccgtgagccaggctcagaacataagccactccacaggagaaatgacttcattttttcaacaaatatatgccgtggaaaagaagaagtaagggagcgaggaactcttctagataagagagaattgaaaatggcacatcatccagtcatccaaacaaaatgtcctgtccttgtttggatccccttttgagcaggttagtgtaaaagacattattgagagaattggtaaacatttaaaggtgggttggatattgggtgatattggcattgtgatcatattgaattattatttatattcatatattctctggcagaacctggtgcgtgtgtgtgtgtgtgtgtgtgtgtgtgtgtgtctgtgtgtgtgtgtctcacagtgtagagaatctgagggtctacgttctcaattctcccaggggtggtacgattctgccaggggtggtacgtaggtaattctcgatgccatgggagttagttgatgcgttgcatacaatggaggtcttaggacattaaggcttaattttttgttggatccgcagttgggaagagctggtagcaggaaactgatacaaagtctggcgtttgctttaaattactccaagaaaaatcgaagcagtgtagtaaagattaggaggtgagacagttcctctttctgaggagatggcgggcccgttttcttctttgtctggctctctgtagcataggggtgtggtgtagtgtagggatgtggaggaaagagtgggtagctgtgttgctggggaggggtgaagtgttttttccactctctatataggcccttcctgcgctctcctctgcttaatgctgatttaccaagcggagtgcaaattgtgtggtgagcatgtgggagatgcctcctggggctggggtgtgtagtggggagtgggcattatacagaaagggaattcatggggcacgaaaggcctactttttgccaggcacctgtcaaataggaaggcagatatttctatgaatacaagtctgtctgtctgtgcatggggtgcaagggtgaagacagtagcaaatggctcatgatttccctttgccatggctgtgtcaatctggagttcagagctctcctaatcagttccgagtggttggctctggtcagggaccgcagcctgacctcatggtggggacacaacaccccccaacaaagttctgttctccagactcttagaaaacctctggggaaatgtactcagggaaatgttctgaggacttcattatcagtgctgcctggctgggaaaagatgtaatctctggtaagagacccttggcaggagtgaaagccctttatcttcagggctttgctctgggcaggatctccccctccccaccatgagccatgcaggtgggcctgtcctcaggtaaacacttgccaacagtcacagcctctcaggcactgcgcgcccctcatggcttcctttctttcactgtcttctcagattcaccagctacaagtcggtttcttgttgcatatcatgcttctgacctttgctgcgcttttgagcaaaacggtgacttgtcagaaatgttttgacaaatgattaatgttttgacccatgttggttcccgcttgatagagctcggtgggtaggagctggggtggtagagccagacagcctgggcaggctcctctggggactctgtgaagcacatggtgataacagtgctcgccttgggcactgttgttgctgcaggaattaaatgagcttcaccaaattacaggacctttactgcctgtaaattacttagcacatagtaaaagctcattaattattagctaaaataaagtgataaaaatctatcattaaattgtcagcacagccctgcagaggcaaccttttaagtattgttatccttcgcagatgaagacacaaggttcacagaaactgactaattggcctaagataacttacagtacaaaagccaggatttcaatctagctttttgagactagagcctgagtgaactgtttctccaaagccaaggcttctcaaactattggtggtgaagaaccaaattttttttcccaattcctctcacatcagtagttacgtaaaatacaataaaaatggggccaggtgcggtggctcacgcctgtaatcccagcactttgggaggccgaggcgggtggatcatgaggtcaggagatcgagaccatcctggctaacacggtgaaaccccatctctactaaaaacacaaaaacaaaattagccaggcatggtggcgggcacctgtagtcccagctactggggaggctgaggcgggagaatggagtgaaccctggaggcagagcttgcagtgagccgagatctcaccactgcactccagcctgggcgacagagggagactctgtctccaaaaaaataaataaataaataaaaaataaaaaataaaataaacaaataaataaaaaagcatggattccagaatcatgaaatgagaaaaaggacatttgaaatacaagccccattttaaaaagtattgatctaacaggcataaaattactctttaaaattactgtaaaagtcacttacactccatttctgtacttttctcatcttgcatcttgaaaagctttctcagcctagcacttctctgcagatctcactttcagtagcactgttctcagcgacctgtttctcaccacttgcctgagaattaattacctggggtgcttattaaatgcagatttccaacttccccccaatattctcccaacctcccagactacttgaatcagaatgattgagacagaattcaggaacccgcattttaacaagtgattttaataatttgggtgtgctctaagtctgagaatcactgtgctcctcagtgttgcctcctctctacagataacagataagagggtaaatagtgaagtgagtgcagtgttttattccggccccccttcttgccccgtcttcttttctcaaaaaaaattttcaaaggcttcctttctgtagaagctcactgacagaaccgactttccggactcagtgcacttcaacaaacaggtattgagctcaaactgcagggggctgggtaggtggagagctgaccgcaagatgctcacaagcagtagagggtgagtataggtagagaaagggcaggtctagggcatttctgtgcataaagtggggcagaagagaaggagccagcaacgagaccagtaaggcattaccggtaaggcagagaaaagccaggagaagtataggttttggaagctaggtgaagaatatgcatcaaggaagaggaagttatggactgctgatgagctgaataagatgaagactgaacattgaccatttggttagcaatgtggagatcgtggaggtccttgtgactctgacaagatcaggttcatggagatggggaggcctggttggagtgggttcaagtgagagtgggaagatagctattgcaaacaagactatggactgtctttcaaggagttttactgtaaaggaaagagaaataaggcattttaaagaagagaaatgaggtcaagaggtttagggtcagggcagggaagtggagtttatttagaactcatgcaataagtggctcaatatatgacttctctaaagtcatatatcttttagttaattccttgagtaaaacagaaacaattgtctatcgtgacttttttcttcaagctctttaaaactctccccactcccaaactatatcactgtctaagaagaaaggagtttgaaaatcagtcttgttacatagcttaatttgaatacatccaaaaaatgacattgcattattttcatatttgctgaatctattttttggctggagtattttaaagtagatttttaaagtagatttcatctcttactacttcacatgcataggactttttctttatataaccacaatacttttatacacctaacaaaattaacaataatttcttaataccatataataaccaatctatgttccaatatccccatttgtccccaaggtgaatcaaaccaagattcagacaaggtgtacgtattacatattattatatctgcgaagccatttgttttttattcccatttacttgttgatgaaaccagttcagttgtcccataggaagtcctaccttctggatttgtctgataattttcctttggcgctatttgacttgttcttctttcttctgtatttcctaaaaactggaattgtgtatgacagcttgataatatacagattaaacattttgggcaagaatttttcataggtggttagcagggcgtggtggtgcacgcctgtgatcccagctactcgggaggctgaggcaggagaatcgcttgaacctgggaggtggaggttgcggtgaacagagattgtgccactgtgtactccagcctgggtgacaaagcaagaccttgtctctaaaaaaaaaaagaatttttcataggtgcttcatgtcacgtcacatcagaaggcacacactatctagatgtctcactgttaatgatgctaaaagactgatcagggtcaggtcacggctgcttgactcacgagaggtgttttgattttgctttttaagagcagcagcgtgtctatatgttgatgggagtaatctttgagagagggatacttatcaattaaacaaaggggtgaggttttctagaacaactttcttaagtaaacaataatgtgtaggatctagtggacaagtgttggttattgcaagtgttggacatagccagttcatctatagtaatgaggcatatggacataaatgcagataaagggggctctgttagggggtttgaggaagttctaatctggcagcttttgttttctccatgaacaagtagcaaattcatcacaggagagggagattgaaaggaggaagtcaagtagtgggcgagtgccagatgaatagactggacaagtagcatgtgatttctgaaaagcattaaggacctcctggcagttagggatcgcgaacttgaagtgaaatcagtaagcattgttgtacaattttctctagccatgctcagttgcatgtttgctggtgtggagcagaacagagggttggatttaaccaggattgagttttagccaatcatgtgtgatcaaagagggcaaaggactcattttaatgattttgaccatggaatttaagctgtgtaggaagggaagtaagaatatgaggaaagtgaggaacagtgacaggtggaaggattaaccacagaagcttgttggagttggggtactagttggaataggctgcatatagacaggagtggtaattggagatgggatgcctgaactcaagattatggaaggtattgttgggaaataacaagatcagagatacaactctgggagtgagtggccgtggtcacaatcactggggtagaggagatcaaaggactgtgaggccagaggactagaatatcctaaaagtggatattaatatcacaaggagttatgatagaaacagtgttggagctaaaatattcaggcaacgaagcacggtattttgggtgggggagaagatggctgcagccaggtaagtggggtcataggtagcgctgtctgcacagggtctctgtgaggatgacatgcattgatgcatgtgatgctcttcactttgagcctgacaaatagcatgtgttagaggttcagtctaacacttgctagaggcaacaagtgttagaggttcaccatctgagtctatgtggctccagtgagtagagcttaaaacactgggtttatagttattcattttttattttattttttagacagagtcttgctctgttgtccaggctggagtgcagtggtgcaatctcagctcacttcaacctccgcctcccggattcaagcgatcctcctgcctcagcctctcaagtagctgggattacaggcgcccgccaccacacccagctaatttttgtatttttaggaaagatgaggtttcaccgtgttggctaggctggtctcgaactcctaacctcaagtgatctgcccgccttggcctcccaaagtgctgggattacaggtgtgagccaccgtgcccagctgcaacactggatttatttttacagggaagttgattttcattaactttaatatatttctaagaggcagagctactcacacagttgtgtgtggtctggggcggtagtaaattccctgtcattcagtgtatccaacaggcaaaatgaacatttgcaatgatggtgccgtcaaggtgattctggcaactgaaggtgatgggtgggtaggtgggagggagtggctgtagcaattgaaggcagtgggcagtggggagggatggtgtcaggagctagcttcattcttgcattcagacatgactgaacatttcctagttgtggcccaggagctctcaatctggttgggacagatctgcaaacagataaatgtcacatagtttgatgaggggaagaataggcaccatggagttatgctgatcatctctgtgaggccaaggaagcttgagagtcaaggagcacttgagctggtgttggaagctgagtgggcatggccccatgggaacagcacaggaaaccacactttgctgaagaacttcttgtgcagagctgcaaaggcatgaaagagtcttcgacatttagagtgccattctacttaatctgggcaaattatttatcttccctgtctcagtttccctgtttgtaaaaatgggggtagtaatggtatccacagaggaagggatggtgactgttgtaatccctttgagtggattatctttttttttttttgagatggagtctcgctctgttgcccaggctgcagtgcagtggtgtgatctcggctcactgcaacctccacctcccgggttcaagtgattctcctacatcagcctcccgagtaactaagattacagacacacgtcaccacgccccgctagttttgtatttttagtagagacgggttttcaccatgttggtcaggctggtcacgggcttctgacttcaagtcatccacctgcctcagcctcccaaggtgctgggattacaggcatgagccacagtacctggccgagtggattattttacttgattctgtaaatcacactatgaggtaggacttgttattattactatttctattttatagataaagatgtcttaaatcttgggtcttaaggggttgagtaacttgctcaaagtcaggtagctggtgaaaggcagtttgggctcttgtcttgataaatctgattccaaagcttgtattgttcatccctaagctatagtcagtgcttggcacatagctagtgctaaataaatggtagctattattgccaggattgctaaagtttctcacccagagagttgagggttctgttatcacttctacagctggttgaagatcagtagtgctgctatctcatcagcagcagggactatttttggaaagccctcatcacctatgataaatctagatagttgcaccacttttgtttcaattggttgatttttgaaaatcaaaaatggagagtgatttttatcttcttagagggcaaggttttttgagcagatgcagttgatgtaagggaggaagagctgggattgatgtacttttctgttgtctgtgggctgtatcaaacaaaaagtttcatgttctggctgccagctggaggatggcagcaaaccagcattcacaggcaagaggtatcatccaaaagtctggtgactgcccacagtgttttctacagggggctaagaaagagcctcttccatgagtgatgccaggagtaagagctgtgaacccgtcacccatttattcattcaacaaatgcatactgagagcttattaagtgctagacattcatctagtgtctagagatactccctggaaataatagagaagaaggttgacaagattcctatttatgaagcttatatttttagtggaaggagacagactaatcaaatactaaatgaatgcctgcataattacaaacactcatgccacaagggaaattcatgctgtgaaaatgtcagagggataactatcagagaaattttctgactcttccaaggatgctgcccagaaaaccgtccttctttgagctgatgaggagagccccaaatgttttgacacagggcagagtggcacctctcactttttccctggtagtcatacctagggtttgcctgcctgccttcctcctggtcatgaagagctggggttctcccaacctgaattcctagccttcaacagaggattttctcttggttcatggggtgaagtcaagtatgtccatatggcttcctcttagttctgttaatgctagatctcctaggacaggccttgcagccaggttaatattgtgcaccaagttgatacacaaggttgaagtgtattttttagtattgcccccaagagttttgccttaattattcaagtaacataataaaaataataaaggaagttggctaggcgtgggggctcacgcctgtaatcctagcactttgggaggccgaagtgggtagatcacctgaggtcaggagttgaagaccagcctggccaacatggtgaaaccccatctctactaaaaacaagtattagctgggcgtggtggccggtgcctatattacccagctactggggaggctgaggcaggagaatctcatgaacctcgggggtggagcttgcagtgagccaagattgcaccacttctgcctgggccgacagagagagacaccatctcaaaaacaaagaataaaataataaaggaattcaaactgataagaattaatctttcatcagtttatccgtcaatggtattcaagtctcaaccatttacattttttctagacagttggatatacatatcttttaagtcaccatctgagtatacaggtaacattttctgttttgcttttttcattttaagattttaagtattttctcccctattactatataaattcatacacaattatataaattatttcaggtggctataccatgcttttcttatttccttattgctggatgcttagttgttaacagattttcaccttgataaataagctcgacattaaaaatttttatttttggcagtgttattaggaaagtttgtagtgcttaacatctacttcaaaaagttagaaagatctcaaattaacaacctaatattgcacccagaggaactagaaaaaaaatttaccccaaagctggcagaaaaagaaaaaaataactaaaatccagagcaaaactgaacaaaattgagactcaaaaatccatacaaagaatcaacagaaccaaaagttggttctttgaaaggataaacaagtttggtaaaccattagctagattaacaaagaagaaaagagagaagatacaaataatcacaaccagaaatgacaaatatgacattacaactaatcccacagaaatatgaaagatctttggagactattaatacctctgttcacacaaagtagaaaatctagaagaaatggacaaattcctggaaactcacaatctttcaagattgaatcaggaagaaattgaaacctgaacagaccaatatcaagttctgaaattgagtcagtaataaaaaacttaccaccaaaaaaagccctggaccagataaattcacagccaaattctatcagacatacaaaaaagagctggtaccagtcctactgaaattattccaaaaaagtgaggcagacagatccctctctaactcattctatgaagccagcattaccctgataccaaaacctggcaaagacacagtaaaaaaagaaaaccgcaggccaatatccctgatgaaaataaatgcaaaaatcctcaacaaaacactagcataccgaatccagcagcacatcaaaaattatttcactgtgatcaagtaggcttcattcctgggatggaaggttggttctacacagacacattaataaatgtgattcacctcataaacagaattaaaaacaaaagccatatgatcatctcaatagatgcagaaaaagattttgataaaatccaaaatcctttcatcaaaaaagccttcaagaaactaggcatcaaaggcacatacctcaaaataataagaatcatctataacaaatccacagccaatatcatactgaatgggtaaaaactggaagcattctccttgagaactgaaacaagacaaggatgcccactctcaccacttctattcaacatagtattggaagtgctgtccagagcaatcaaacaagaaaaagaaataaaaggcatccaaataggaaaagaagtcaaactgtctctctttgctgacaatatgattctatacctagaaaactataaagacactgccaaaaggcttctggaactaataaacaacttcagcaaagtttcaggatacaaaaccagtgtataaaaattcatggcatttccataaccagtaattttcaagctgagagtcaaatcaacaacacaatctcatttataatagtcgcaacaaaattttaaatacctaggaatacatctaatcaaataagtgaaatatctctccaaggagaactacaaaactttgctgaaagaagtcatggatgacacaaactaatggaaaaacatttcgtgttcatggattaaaagaatcaatatcattaaaacagccacactgcccaaagcaatctgtagattcaacactgttcctatcaaactaccaatgtcatttttcacagaactagaaaaaacctatcctaaaattcatgtgtaaccaaaaaagagtacaaataactaaagcaatcctaagcaaaaagaacaaactcagaggcattccagtacctgacttagaactgcactgtaaggctacagtaaccaaaacagcatggtactggtaccaaaacagacacatagactaatggagcagaatagtgaacccagaaataaagccacatacctataatcatctgatctttaacacagtcaacaaaaataagcaacgggggaaagaactccctattcaataaatgatgctggaataactggctagccatatgcagaagaatgaaactagatcccttccttataccatatacaaaaattaactcaagatcaattaaagatttaaatgtgagacctcaaactataagaatcctggaagaaaacctaggaaacaccattctggacatcaaccttgggaaaggatttatgacaaagtacttaaaagcaactgcaacagaaacaaaaattgacaagtgggatctaattaaactaaagagcttttgtgcagcaaaagaaactatcaacagaataaacagacaacctacagaatggaagaaaatatttgcaagctatgcatctgacaaagatctaatatccagaatctataagaaacttaaacaattgaacaagcaaaaaacaaataacaacattaaaatgtgagcaaaagatatgaacagacaattctcaaaagatgcatataagctgccaacaaacatgaaaaatgctcagtatcactaattattagagaaaagcaaacaaaagcacagtgagataccccctcacgtcagtcagaatggctattattaagtcaaaaaacaccagatgctagggaggctgcagggaaaagggaacacctacacactgttgttgagaatgttaattagttcagccaccatgaaaagcaatttggagatttctcagaaaacttgaaaacagaactactattcaactcagcaatcacattactgggtatatatccaaaaggaaataaatgtttctaccaaaaagagacatgcacttgtgtgtttattgcagcactattcacaatagcaaagaatggaatcagcctaggtgcccatcagtggtggactggataaagaaaatatggtacatatacactgtggaatagtacacagccatgaaaaagaacaaagccatgccctttgcagcaacatggatgcagctggaagccattatcctaagcaaattaataatgcaggaacagaaaaccaaatgccatatgttgtcacttataagtgggaactaaacaatgaatgctgatagacataaagatggcaataataaacactggggactacaagacggggaaggctggggaaagagctaaaaaatgaattattcagtacctgcatggcaggatcaatcataccccaagcctcagcattgtgcaatataccaggtaacaagcctgcatacataccccctgaatctaacatataaattaaaattattttttaaaaaaacccttttcttctttgtgtgcgtattgctttatagaactcatattctttatctcattaatcctctttcatttgtcatcagaactatgtaatgtagagaatcattttacatgtggggaaactggagtatgtaatcttttgaattatttatgaattatttatttattcactcttatttcctagaagtacagtagcctggtccatggtcagaagctcttaattctatggcctgaatacattctagaaaggttacattaatttatatgatcctttgaatatatatcgatttaattataatctgtccagcaatgagtattatcatgtagaaaactgcggacgaatgtaaattctataaactagtttctcagtattctagttgcccctcttgggtttctctcatgattaaccataactttatatgcttgttaattgtgctttttattttgtgattagtctgttcatgttgattacctctttattttgggagacttttattatattaaccctttttatattttgacttttcctttttattgtagttacagtatttttcattgtatagatgttgaaattttcttgcaactgaatgtattaaacttttcctttgctattttcctacatcgcatcaaaagaagaaagagctgacaggtatatatttatatttttagctgttttttgttggtttgtttagagacaggttcactctgtcacctaggctggagtgcagtggcgctcatagctcactgcagcctctaactcctgggctcaaatgatcctccctcctcaacctcctgagtaactgggactacaggcatgcacgcctggcttatttttagctttttaaaattacatttttatacttttgtacattttttcaaagtcaaagaataatggatgtacattttagaaattttggaatatatgtaaaattataaaagatgaaaacatctattattaccattctgggtgtacttttttctagtactttttcctagtactttttcacgtttttttaaatgtattttttttctgaatttggatagtgtttaccgttttataacgtattttttcagttacaattatactgattgaactttcacatattattaaatattctttgaaaataaataattttttgaaaatctgtatgaagtttatttcaggatggacctaattactccctgtttacctccaagccagcaattaaacaacctgttcttcccaggttggtccatggtggccgctttagctttctagcccattcttatctggtgtcaagtctatttctttttttttttttttttttttcttttgagacagagtctctctctgttgcccaggctggagtgcagtggcgtgatctcggctcactgcaacctccgcctcccgggttcaagcaattctcctgcctcagcctcccttgtagctgggactaccggtgtgcgccatcatgcctggctaattttttttttgtattttagtagagatggagtttcaccgtgttagccaagatggtcttgatctcctgtcctcatgatcctgatccgcctgcctcggcctcccaaagtgctgggattacaggtgtgagccaccacacccggctagtgtcaagtctatttctaggctatctgtgctgttcacagatccagagcattgcacctttaataggcttttctctctctctttttcctgagccctggaggcttcctggattgagacctagcctaggtctgcataagcacctttccatcttgttaatgtttaacactgcctctgctggaaaacagctctcacctcctctctttctgtctcttattttttgcctttgcagatgagttttgatcatcctgagaaaaatgggccttggcctgcagacccaataaaccttccctcccatggataatagtgctaattcctgaggacctgaagggcctgccgcccctgggggattagccagaagcaggtaaggaacacacagaggcatgggctagcaaaggggtacattcctgagtaaaagctggtgtggcagatgtcctggcagggaatctcaggatctcagtatctggctccagctttgctgttttctttttgtatgtattttttagtcctctttaactgctgattcaatgtgggtttcattggggggtgtagagaaatggcttgtccatttctattaactatataagatttaagttattctgtatttcagtcaaccattctgagtacctactacctgccacgaatgcaactggtactgagtatgtcatgacgggtgggtcgggacaggatttccttgctttgagcattgatttctgccggttcagtgttggccagttctttgaaggtgatgatgcaagtcgctgtgttcttcctctagaagcctcgtgatgattgtaaagattctctgatacaattgcatcagttcaataatctttcattgagtatccgctctggtccaggcactgtgctgggtactagggtttcagaaaggataccaggaggagttttccttgagcagcaaagtcaggcatgaaaagcaagcattacaaagcactggctggcagcaaaggggagcagggatagtgcggaaggggaggtggcctccactgaccttcagaagcagaaaggtgatgctgtcagagctggcaggcacatggacaaggagaaagagtgcagcagtgcagacacctggaggcttaacacagtctggtgtaattggaaaattcaaagcttagtgtgtttttccaaaacatttgtagagaaaagtttgctactcttttccctcggttgcgccatttagagaaagtttcttcagcctctgccttcttcagacaatttgagagatgagaaagggtcttgcagttataagtgcctgtgaccagaaactccagccacctggtggacttggagcctcaaccaagggtggtgtcaagggaccacatgagcccttatgtgagatttcagatgagtgccctgaggccatgacagagcacaggctgtgaaggctgaggctgtctgatggttgcaagactgtcgctagacccagctgtttggaggaactcttctttcctgggaaaccacaccttggagagtaggtactgggcagctgctgcctgagcctccactcctgtgacagtgaatcaggcccttcctgccatcttgtttcattcagacatgtgaaagtcaggttctaagtccactatttccaaatcactcatgcaactttgaaaattatttgtatttccaaacctcactatactcagctataaatggagctcataaaatctgctgtgcttatctcacgggagtataataggtctgtaaaaccttaccaatacggaaagtacctgagtgttaccactcagtgcacagcagggatggcaggtgcagcactgatggtgaaggtggcttgtctgcgactgtctgacagacgaagttgcctctctagtgaccttgagtccgacttgatcacactgacttctcactgtcccttatcacagatgcatgtccttgggtggaaagatgatgaacttttagagtcagacagacctgggctggaattctggttctagaactgacttgctgttgacattggagaaaccctataaccttgctaagtctcagttttttccatttcctaaaataggattgtcaatatctctatcatagtgttgtagtaaaggttcaatgagatattgcaaggaaagtgactaccacgtagtaggccctccttaaatgctactttccttcttttctctagttcttcttcagttgtcatatggtcatgtgattacctgtgttgggtgtctgcggaaattgaattccttagtttctggtaatacaacaagcttccacccttcacttcatgatcttctatctgaattcttcttccactgtgtacatttaatcatttccacaacttcagcagcccaagataggagcccatcgttcccagagtcactggttcctgaggtctgggatggtggaagcactgctttggttggtactgccaatggattccaggaatgagctggatgtcagttcatggagaattcccagggaagagcctggagctcagggctgctgagtcatggctgtggcttcacactgctgtcttcactacccgtatcacctccacatggcccccaggctgagctgctgctctcctgtctctgttcagaataccttctgtgcctttttgcttatctagttcaaatccaatgaataccatgctcttgttttgccctcccaacactctgcaaatcacatagggcagagataattattctgaaaaactcaggggcagaaatattaagtgacctgcccaaggtcaccaagaatggggataagaacccaggttttgtgaacacccagtccagtactcctactaccttttcctgatatccttaggagcgggatccatgggaagggacctcagacccctagtgggttagcaaaaccccggaggtgattgctttgatttattattgtaaataaacccagtgattggggaaagaatgtaatgttttccaaaagatacagacattatttgagttcaaagtgcttccagtttccattcagttacacaataaattctgagaaaacaaagtaggtgtttactcagaaataaagagactattcagtctctatttgctcagtgaaatctattttccagagcttcttgcagttctgtgcatgttgtactggaaaggacatgggttatggaatcaaatccacttcgatttgaacctcagtgcaaccatttcctcagctctgtgagcttgggcacttcccttgacttcttagagcctcaggttgctaatccataaaatggagattataacacctttgaagtgaaccctgtacaggttaggagatgcccttcgtattagactatgctatgcgtggtgcccccagagttgtgtctcatggtggccctggttatggtgaagttaagtgaaataacatctagcgtgcttaatgaatttttgtttccatttccttagttggctacatgtctgctatcttacccagaattcctagcctctatcatgaggtgagtcagcttcctgtctcagcagtgctcttcttgcagggcactgcacaaaactgtggtggagataaccctcgatcttctcatgcaggagtccagcatcgcagcccttagagagatacatcagaaatctatggcatcatctataacgagaagtctttttctggccattttgaaggggtgttgggccacttactattttaggaagtttaggtctggtgatgtaaaacagtcagcctgcttttttttattctatttttttttcaagcatgcatggcttcatttaacaaatgttacaaggccctaggaactgagtgatttgcaagatgtggtttctgacttcaagaaactcagagtgcagtcagagaggtagaccaaggcaaccagaaactaatattcagcatagaaaaagtaatgatgggaggacatataaagtgttcatggctcaagaggaagaagggagtggaagagtggaagaggaagagggactgctgtccacgttcaaagcccaaattgagtctgacttttgtcgagaattgcttaacaggctgcagaggtggccaggaggtagaccagggctggaattcaagtcacctcatttcaaatctattgctcagtccatcgctccgcctcatgccacattgggtttttctttacatcatttgtttttccttgtctcactttttttaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcggtatgttctggggttgttctgtgaatggcagtgcttattgggactggctgggcatattgatggtatgggagacaagtggcccaagtgtggctcagcggaccagtggagtgggcccagggcagtgtttttttcagagtcacaagtgacacagagggagttgaacagatggcgctctaggcccccgcatcttttatcaattagaagagcttcattattgtttcctaatatttttagttgatatataataattagatatatttatggggatattttgatacgtgtattcaatgtgtaatgatccaatcagggtaattagaatatctatcaccttgaacatttattgtttctttgtgttgggaacagaatagttttattttcatctgttttaaatattggaattgtgtagaagatttcatttgaaaaagagagttccgctgctaccaataatcaaaagcctacaattgacctttgaaaagacttgaagcatagatctgcacatcatttccaggttctgaaattctgttgtttttcctgattagtggaggactctattggcctcaacaacctgggtaattttcagcttttctctttgaaaagatttaattgggtcagtaattcttaactgggggctatggaccaacttcagagggtcatgaatccctgcaattgcgtgcaaaactgtctgtggattaggtgtgtagaatgtatgtgtatgcgtataagtgtgtccgtgcatttttccaggaagggagtttgtagactgcagtttattctctaagggatctgtgacccaaaaaagtttcagagtcactggtcacaacatattaatttgcttttcttgaaaccctttgtagtgaatcaagatagaaagtctgtctatatttgtaaacctgtgtaacagagagccttatttctcttatgctgaatgtgttttccattatttgaaatgaatcagctaaagaaagcaaagcacaggaagctttgctcctctgtcagcctggaggtactggagcaggtgaggtcatacgtctccttttttatttccttcatttgactgccaggaaaaatggtctgaaacccagcacaggctctcaaagaaaagtaggcccaaactggattctctagagcagaaagaaatggtgagatcacagtttctacctccccaaataggcagctgccccgctggccggccccacctcaacttctgcttttgtatttttggtttttcttggactttgttttcaagaaactaaatgtgattggtttttgttcatccataatggagctaagtttctttcttctccatttttgctgcttatgtagcaaatgtttgggatatcctaggtattagctgatccttcttcttcatgtcaagttaatattgcgtgcctggctgaaattgtactgaagtttgagacagggcctgatagctctgttaattagaactacagctttaattttatgcactccttaaagatttggggtgatttaagtaaacattaatacaaataatatttttctatagattgcagtttcaacttcaaaataaggatttccacagaaggactttgatcctgagatgtaatcaaaattgcatgttagacttcgaatgttctgctgttatggggtatatatcctcttggcattttgtctaacaaatattttaagacattcatatattcttttatttattcatggattcatcaacaatacaaaggggaaagggaagggaaaggccctttgttgaagcccgagttgcaggcagcgtgccaggcccatacacttcctcctgcatctggaatttgttgagtctcttcccaactactggatggatcagattatttcaaatggttttcttttacaaataacattgctgacaaggtttttgtgcagataacttaggtaaccactattgacattcaacagggaaatatcctcagaagtgaggctagaagacacgagtaagagacattttatgacttttttttttttgtccatagcaagattttctatcagagagagtgtaataacatactctgcctccagcagtctcacaaaccagccaatggtgggctcagtcattttcaattatttttgatagtttactcatacatgttaagtatcctagatttgctggaattttcatgtcaaacagtagcataattttaaaacactatcatcaatacaagtgatgcttattatgcatctgctgagttcctaacatgccttgctcttttcatcctcccagaagtcctgtgaggttgataagattattggtctcattttgctggagagctaaatgcggaggctcaagtggtcacacaactggctaatagcagactgaggtttgaaagcagagtgcttgcttcaaagaccccactcttggcacctctgctgttgtgcctcataataattgtagcttcataataaaattcggtgtgattattcttttattatgttaaaaattttcttctattcttgtctattagctgtcctagagagaaagagaagggtattctgagttaaggcaaaggcaagaagcaaaggctgcacggggaaaagtgtgtttgggcatcacaaataatcctgtttggacggcatgtgggtccttgtgggtgaagatgggtgaggaacgaggccagaaaggtagctaggcattagctcttagagaacgttgatagtcacaataaggactttaggtttcattctttaagccatggagagccctaggaggtttttgaacaagggagacttctcacttctctatgagtccctgttttgtactctataatgtctccattattagggactattgccacaaccaggtcagaagtgccaggcctgcccaggctgtggtagcagtgatgaagagaaaggaccttacctgagagggctcatgaagtaagaggcagaacttactatctagctggaaatgatcttgagtgagaggcaggagccaggatgtctagcctgggagcaggctgtatcttaccaaggggagcatgcttccagaggaacgcagattccactttggatgttctgagactgaagtgtgtgtggatttccctgggtagatatctatgctgttgagtacttaattctagagaaggatcagatatcgagatagatttacaagtcatttgtatcaaggtgagataatggttataatccagggaagaagaccaattagaaaatctagaaaaagatttacatttaaaggacaaagaaaagaacagggaaaagtcagaagggtcagagaccggctagaggagaactaggtgtgcaccatacaatggaaggcaaagggggatggagtttgagggatgttggctgttggtatcaaagtctgcagaggtgggacatattcttgggcagaataaggactgagaagacacctgtgaactgagtagcttggagaacatgatcagttatatcaggggtcagcaagcttttcttaaaaggccggatagtaaatagttttggctttgagggccatgatgtctgtcacaactactcaactctgctgttgtactgcagaagtaacaatagatagtagtaaatgaacaggcctggctatgttccaacaaaactttatttacaaaatgagggatgcaccagatttgtccttcaagtcatagtgttttgttttgtttttgacggagtcttgctctgttgcccaggctggagtgcagtggcatgatctcggctcactgcaagctccgcctcccaggttcatgccattctcctgcctcagcctcccgagtagctgggactacaggtgcctgccaccacgcctggctaattttttgtatttttagtagagacagggtttcaccgtgttagccaggatggtctcgatctcctgatctcatgatccgcccacctcggcctcccaaagtgctgggattacaggtgtgagccaccgcgcccggccaagtcatagttttttttttttttaactctgatctatagtatgtctgttttcttcaaccggactcagaatgtaattttccataaatggttgtaggatgtattaggctaacttgaaaatataaaagcgtttggtgataaattgtgataaaatttctttcataataatttctagctatttagagttaactacacctagaggcagtggattttgatgtatttatgaatttactaacttgagctgattctgttgaattttctaagcgtgtgattgtataatctgaatacagtgatgcatttattttttcttctcctaatttgcctctttttctgagctctaattctaagttacagagaggtggtagtttcttttttctgcagcctttccccctcgctaggcttgtttgctgggatctcagtagttgtggatttctcttggtgatttcttagaggcctatttgagtttgaaagttcaactttcaattagcagggaggtttgacaaacaggatttttttctctttaagtacccaagtcagtttaaagttttctttttaaaaatttgatatataataattgtacatatttatggggtacatgtgatattttggtacatgcatacaatgcgcaatgatcagattgggtaattagaatatccatctcctcaaaaaagttttctcctttgattggcttttttcttttcctttcttttttttttttttgagacagagtcttgctctgttgcccaggctggagtgcagtggcgtgatcttggctcactgcaagctccacctcctgggttcacaccattctcctacctcagcctcccgagtagctgggattacaggcgcctgccaccatactcggctaatttttttgtatttttagtagagacgaggtttcactgtgttagccaggatggtctcgatctcctgacctcgtgatctgcccaccttggcctcccaaagtgctgggattacaggtgtgagccaccgtgcccagcctgattggcttttttcttagaatcacgtccaaacttcatacctgggcccccatgtccgtgtatgatctggttcctgccaacctctgtaactgtatctttgatttttcttcccctcactccttgtctacagtcaagtccctgccctcattgtggtcctgacacttgctgcatcctctgactggtggacttctctgaacccttcccaaggctggccatcctttgggtctcagctccaaggcattccctgaatcatcactctatgaaggaaattccctcagtgtctctggcacacagctcagcttgttagtgtcacagtgtttgtcacaatccgaaattatcttatatgtaggttgttgtccgtctttactgtctatgtccgtgcagtagaatgtaatatctctgagggcatggaccttgtctttgttgctcacaggcgtcgtctcccgtgtctaaaactgtgcctggcatagagtaggtgctcaatcagtatttgttgactgaacaaaacaattctcctttcttatggtcaacatcaagcatctgttctaacctaagccttctgtgctggatgttctccagtggcacctccaaatcccactctcacccttttccatctggctctgtccctgagaaattgaattttttttttttttttttttttttttttgagaatgagtcttgttctgttgcccaggctggagtgcagtggcacaatctcggctcacgctaacccccgcctcctgggttcaagcgattctcctgcctcagcctccagagtagctaggattacaggtgcgtgccaccacgcccagctaatttttgtatatttagtagagatggggtttcaccatgttggtcaggctgatgtcgaactcctgacttcaggtgatccacccgcctcggcctcccaaagtactgggattacaggcgtgagctactgcgcccagctgagaaattaaaattttgaactgcgttaattggcatttctcactctctggattttctctgggactggccaggagaagcagtggcattaaagctgagaagaagactaaggtcagggcacctattccgccatgtttcgccttgcagagtaaactcaagctgtatctttctcttgactgaaggtctcagatcctgccaggaggccgtcccagtcttggtcctgctctgtcccttttcccttcagttctatgagatccaagggaaggggcagaaccaggttgggatattgactccctcaggctccttcttgcccggaggttggcaatagctgtgttcctctcctaaaggcaacagctcccgacaggtgtccctcctcagctcagggtctccgctcatcaggccacagtagacctggggtggtaatgacaccctgcagtcatcaaccctggggctttagcctattccgtgttgatttctttaaactctaccccaacttggtaagtagtccttttatgaatctctcaattactccattggagcttctcatctcttttctactgggattctcaccaataatttattcatctgtgaaatggaaaagttgactaactgaagtttctgatggatctgtgtttctcatgcaattactactaatccctttcgaaccagtgactgattctgacaaaatgtgttgtaattctgagttgtgtaaagatatacctcctgccctatgtgcacttcagtgtacctgccctgtaagatgataacagtttggactgtgcccttctcagataattttcaaaccattttgatgaaattttgccctaggattgaggatagggttgtgttgttttcatgaatgatgtttctgtgttcctgaggtttagtacatacattggaactgaaataaagagagaggctttcatccttaattctgtggatatcctctttctaaatcatcttgtgttcagtcaaatgccctcacttccccaaatcctgtgtggataaagaatgatccaaaacaaacctgaataggacaatagaggattcagctgacccccagatcccgtgtagatttcagtggtgagccccaaacttgcttgaccgagtaagattgaaagaagttctcataggatcacaggatttggatggctccttaaagtcttcagttccctccttcatcagataggtcaacgtggggtagagaaacttttccaagtcttccaaacactgcttaaacagttgcaaagacaaggagctagcccaggaagcttttaggtttttcaagatggcctgtttgattttgactggatttagtacattgtttctgacaatggcttacaaagaaagagagagagagagagagagagagagggagggagggaaggaaggagggagggaaggaaggaaggaaaagaaggaaggaaggaaggaaaagagagagaggaaggaagttagtttagctctctgacctcctcttccatttctgccacaccagttctgtgactcttccctgggcctcaggttcctaaatggaacgcctgggggttgtcttggatgccatagttaaatcctgtccatttgctgagcactgcatgcttttcaaagtgcaatggggtcctttgcacttgtgggatacactgaacatatggtagtgttttcatttttctgacagagatagaaatataatctactggtgataccaagagaatatctggtttgctgctttgataactggagtagctactccactgtaagtagcacactggctttgttcacttttctgtgtgcccaggcacaagcgaatgtctttgaatgggtttcaggaatgccacagtatggcccccttcagcccttacagtggctggcagacaggtggtcatctctgcctaggagctttacctgagcaccacacaaatactgccatttcgccctgtggatcatgatggggtaaagatggggaagcattattcccttgccccctcccccgcctctcgtctttctctttttctgcatattgccagtgctcatcacctcttttctgtttctttgtggtttatagatgatcatgacgcagtcctgaggtttaatggggcacccacagccaacttccaacaagatgtgggcacaaaaactaccattcgcctgatgaactctcaggtaaaatttcttctgtgcagctatggagtaagagaaggaccacagtgtgggctctaatgtggaatgtatctactgggagcatatctaggctgccaattaagtctcttgatcttcctgagttcctgattcctcactggagaagaagacaatgattccatgacccaacctgatgatgtgtttatttaaagaaaaaccctttagtattagtgtctgctaatggaggtgtctggtacccaggaaagtagagttgagctgtccttgctgctgcaaggtcatacctggaggtttacatgagggacagcagagcgcagaacatccaggggagagtggggagtgttgtgaaaagtgaatgaaacaatacacaggagagcactttatgaaccgtaaaatgctatacaactactataagacagtgtcaccatgtaattatgtgtaatatggcactagaattcatgtactatttcataaattcccctggataattaggttcccggagtattttcaggtagcacatgccgatttctcaatactaagggagacttgagaaatattcttgccacagggttctgttagtatattttattagtgggaaaaactgtattacacatatatatgaaaatatcaaaaattgcacaatagggctgcaacctgcccatctcacaaccaccaacatttgcctttttctgaataaacatatgtgctctgggggtttttatgtcagtatttagtctgcatacttccctaggagtcctgggcatggggtggatcctggaacagatcagaaatgccttttcagcagtgtctgtggaatgtgtgtttctttccttctctactagggctccacttccctatatctgtctcttcacttccttactttcaggaactcaccagctaggcagaagctgcttcctgcatagcccactttctatttgaagcccacaaccttaagaaacttttttttaaaattatactttaagttctagggtacatgtgcacaatgtgcagatttgttacatagatatacatgtgccatgttggtttgctgcacccatcaactcgtcatttacattaggtatttctcctaatgctatccctccccttgcccccaaccccacaacaggccccagggtgtgatgttccctgccctgtatccaagtgttctcattgttcaactcccacctgtgagtgagaacatgcggtgtttggttttctgtccttgtgatagtttgctcagcatgatggtttccagcttcatccatgtccccacaaaggacatgaactcatccttttttatggctgcatagtattccatggtgtatacatgccacattttcttaatccagtctatcattgatggacctttgggttggttccaagtctttgctattgtgaatactgccacaataagcatacgtgtgcatgtgtctttatagcagcatgatttataatcctttgggtatatacccagtaatgggatggctgagtcaaatggtatttctagttctagatccttgaggaattgccatactgtcttccacaatggttgaactagtttacactcccacccacagtgtaaaagcattcctgtttctccacatcctctccagcatctgttgtttcctgactttttaatgatcgccattctaactggtgtgagatggtatctcattatggttttgatttgcatttctctgatgaccagtgatgatgagcattttttcatgtgcctgttggctgcataaatgtcttcttttgagaagtgtttgtttatatcttttgcccactttttgatggggttgtttgtttttttcttgtaaatttgtttacattctttgtggattctggatattagccctttgtcagatggataggttacaaaaattttctcccattctttaggttggctgttcactctgatggtcgtttcttttgctgtgcagaagctctttagtttaattagatcccatttgtctattttggcttttgttgccattgcttttggtgttttagtcatgaagtccttgcccatgcctatgtcctgaatggtattgtttaggttttcttccagggtttttatggttttaggtctaacatttaagtctttaatccaccttgaattaatttttgtgtaaggtgtaaggaagggatccagtttcagctttctacatatggctagccagttttcccagcaccatttattaaatagggaatcctttccccatttcttgtttttgtcaggtttgtcaaagatcagatggttgtagatgtgtggtattatttctgaggcctctgttctgttctattcgtctatatatctgttttggtaccagtaccatgctgtttcggttactgtagccttatagtatagtttgaagtcaagtagcatgatgcctccagctttgttcttttggattaggattgtcttggcaatgcaggctcttttttggttgcatatgaactttaaagtagttttttccaattctgtgaagaatgtcattggtagcttgatggggatggcattgaatctataaattaccttgggcagtatggccctttccacagtattgattcttcctaaccatgagcatggaatgttcttccatttgtttgtgtcctcttttattttgttgagcagtggtttgtagttcttgttgaagaggaccttcacatcccttgtaagttggatgcctaggtattttattctctttgtagcaattgtgaatgagagttcactcatgatttggctctctgtttgtctgttattggtgtataggaatgcttgtgatgtttgcacattgattttgtatcctgagactttgctgaagttgcttatcagcttgaggagattttgagctgagatgatgggtttttctaaatatacaatcatgtcatctgcaaacagggacagttcgacttcctcttttcctaattgaataccctttatttctttctcttgcctgattgccctggccagaacttccaacactatgttgaataggagtggtaagagagggcatccctgtcttgtgctagttttcaaagggaatgcttcagtttttgcccattcagtatgatattggctgtgggtttgtcataaatagcttttattattttgagatacattccatcaatacctagttcattgagagtttttagcatgaagggctgttgtattttgttgaaggtcttttctgcatctattgagataatcatgtggtttttgtcattgttctgtttatgtgatggattatgtttactgatttgcatatgttgaaccagccttgcattccagggatgaagctgacttaatcgtggtggataagctttttgatgcactgctggatttggtttgccagtattttattgaggatttttgcatcgatgttcatcagggatattggcctaaaattctctttttttgttttgtctctgctagactttggtatcaggatgatacttgcctcataaaatgaattagggaggattccctctttttgtattgattggaatagtttcagaaggattgatacaaagaggtttgtacctctgctagaatttggctgtgaatccgtctggtcctggactttttttggttggttaggctattagttattgcctcaatttcagagcctgttattggtctattcagagattcaacttcttcctggtttagtcttgggagggtgtatgtgtccaggaatttatccatttcttctagattttctagtttatttgcatagaggtgtttatagtattctctgatggtagtttgtatttctgtgggatcagtggtgatatcccaatttatcgttttttattgcgtctatttgattcttctctcttttcttctttattagtcttgctagcggtttatcaattttgttgatcttttcaaaaaaaaaaaaacagctcctggattcattgatttttttgaagagttttttgtgtctctatctccttcagttctgctctgatcttagttatttcttgccttctgctagcttttgaatttgtttactcttgcttctctagttcttttaattgtgatgttagggtgttgattttagatcttttctgctttctcttgtgggcatttagtgctataaatttccctctacacatggctttaaatgtgtcccagacattctggtatgttgtgtctttgttctcattggtttcaaagaacatctttatttctgccttcatttcgttatgtccccagtagtcattcaggagcaggttgttcagtttccatgtagttgtgcagttttgagtgagtttcttaatcccgagttctaatttgattgcgctgtggtctgagagacagtttgttatgatttctcttcttttatgtttgctgaggagtgctttacttccaactatgtggtcagttttacaataagtgcgatgtggtgctgagacaaatgtatattctgttgatttggggtggagagttctgtagatgtctattaggtctgcttggtgcagagctgagttcaagtcctggatatccttgttaagtttctgtctcgttgatccgtctaatattgacagtggggtgttgaagtctcctattattattgtgtgggagtctaagtctctttgtaggtctctgaggacttgctttatgaatctggatgctcctgtattgggtgcatatttatttaggatagttagctcttcttgttcaatcgatccctttaccattatgtaatggccttctttatctcttttgatctttgttggtttaaagtctgttttatcagagactaggattgcaacccctgcttttttttgctttccatttgcttggtagatcttcctccatccctttattttgagcctatgtgtgtctctgcatgtgagatgggtctcctgaatacagcacactgatgggtcttgactctatccaatttgccagcctgtatctttcaactggggcatttagcccatttacatttaaggttaatattatgtgtgcatttgatcctgtcattatgatgttagctggttattttgcccattagctgatgtagtttattcctagcattgatggtttttacaatgtagcatgtttttgcagtggctggtaccagttattcctttccatgtttagtgcttccttcaggagctcttgtaaggcaggcctggtggtgacaaaatctctcagcatttgcttgtctgtaaaggattttatttctccttcacatatgaaggttagtttggctggacatgaaattctgggttgaaaattcttttctttaagaaagttgaatcttggcccctactctcttctggcttgtagagtttctgctgagagatctgctgttagtctgatgggcttccctttgtgggtaacctgatgtttctctctggctgcccttaatattttttccttcatttcaaccttggtgaatctgacaattatgtgtcttggggttgctcttctcgaggagtatctttgtggtgttctctgtatttcctgaatttgaatgttggcctgccttactaggttggggaagttctcctgggtaatatcctgaagagtgttttccaacttggatccattttccctgtcactttcaggtacaccagtgaaacgtagatttggtcttttcacatagtcccatatttcttggaggctttgtttgtttctttttactcttttttctctaaacttctctttttgttttatttcattgatttgatcttcaatcactgataccctttcttccacttgatcgcattggctattgaagcttgtgcatgcatctcgtagttcttaagccatggttttcagctccatcaggtcatttaaggtcttctctatactgtttattctagttagccattcatctaatcttttttcaaggtatttagcttccttgccatgggtttgaacatcctcctttagcttggagaagtttgttattactgaccttctgaagcctacttctgtcagctcgtgaaagtcattctccgtccagctttgttctgttgctggcgaggagctgcgatcctttggaggcaaagaggcactctggtttttagaattttcagcttttctgctctggtttctccccatctttgtagttttatctacctttggtttttgatgatggttttggtgtggatgtcctttctggtgatgttgatgctattcctttctgtttgttagttttccttctaacagtcaggtccctcagctgcaggtctgttggagtttgctggaggtccactccagaccctgtttgcctgggtatcaccagcagaggctgcagaacagcaaatattgctgcctcattcttcctctggaagctttgtcccagtggggcaactgcctgtatgaggtgtcagtcggcccctactgggaggtgcctcccagttaggctacacggggctcagggacccacttgaagaggcaatctgtccgttctccgagttcaaacaccgtgctgggagaaccactgctctcttcagagctgtcagacagggacgtttaagtctgcagaagtttctgctgccttttattcagctatgccctgcccccagaggtggagtctacagaggcagcaggcctggctgacctgcagtgggctccacctacttcgagcttccagggctgctttgtttacctactcaagcctcagcaatggcagacgcccctcccccgccaggctgctgtcttgcaggtcgatctcagactgctgcactagcagtgagcaaggctccgtggtcctgggacccgctgagccaggcacaggatataatctcctggtgtgccattttttaagacagttggaaaagcgcagtgtttgggcgggagtgtcccattttttcaggtaccgtctgtcacgacttcccttggctaggaaagggaagtcccctgaccccttgcgcttcctgggtgaggtgatgccccaccctgctttggctcgtcctccatgggttgcacccactgtccaaccagtcccaatgatatgaaccaggtacgtcagttggaaaagcagaaatcacccgtcttgtttgtcgatcgcgctgggagctgcagaccagagctgttcctatttgaccatcataagaatatttttataacgggatagaaattgaggaacttaacttatttgtaagtggtcaccatcttgtttttttgttcttcctctaataccttttaatttttttttaagaaaatcactttctatcaccgtcacatcttctagtcacctctaggtgcttccaatgcctgtttgttgttcaaatttatattttggcttttggtattacttttattattattattattattattatttgagatggagtttcgctctgtcacccaggctggagtgcagtggtgtgatcttggcttactgcaacctccttttcctgggttcaagcgatcctcttgcctcagcctcctgagtagctgggattacaggcatgcaccaccatacccagctaatttttgtatctttagtagagatggggtttcaccatgttggcccaactggtcttgaactcctgacctcaagtaaccacccaccttggcctcctgaagtgttagtattacaggcgtgagccatcgtgcctggcctacttttattgttactagaagagataggattgaaaggaatggactggctagcaagaagctctctggggcaaatgacagttgagctagactttgaaagatgggcaggacttggggaaatagcaatagccgggcactccagaaagtggaattggcaagacagaggagaacaggaaatgagggaggcgttacaccactccaagagtagtgtaatgatcactcccctattagtgatcaggctggagtgcagtggcgtgatcataggaaatgagggagacattcagatacccctggctaagttggaggtggaggtgtagaagaattggctggccttgccccgtagagagagatgaggctggaccttcatggctgcttgtgctctggcaagtgtggaaattcagacagagggttaggaccagctttgtccctttcccttctcatgcctagtcaggaaccctggagctggagagcactttagggagcactaaaacctcatctccacttctatataagatgctacctaaatatccaggagagatgttcatttactcttaattaattcattcattcaacaaatgtattcagtattgagtagactgtggcagtcagtacataaactctatagttagcctgcttggggttgaaatccagctctgtctcttactagctgaaggatcatcaagttacttctctctaaaaaagggagaataattcccttacagggttgttgtgaggtgtaaataagaaaaatctgtgcaaagcacttagaacaatacctggcacatgtatcaataaacgttaactgcacttactattgatatttgcagacattggtaggggagggtacaattgtgagcaaaacaggctcagcctctgttcttatgatgcaatcaaatagttttacaaataaataaatttgcaaaaaagaactagagaagagagtggtcaaggtactaggagagccctgaaaggggagatttgagctattcaaggaggtcagaatccctaagtaggtggtacttggctgtgtagaaggaatgtgtggatgttgaaaagggtgggataagagcttttcaggaagaggcaacagcatgggtacagttttgtgtggaaggaaatgggggactggaaggactcaggaagaggtgagtatatgtgggactatgtggtgagagacaaggctgaaagcaagaaggagtcaagccatggtgctgcaccgaggcatcttcttttttcagtgggggtaggggggttggcctgtcacccgggctggagtgcagtggcgcgatctcagctcactgcaaacaccacctcctgggttcaagcgattcccctgcctcagcctcccgagtagctgggattacaggcgcccacaaccatgcccgactaatttttgtatttttagcagagacgaggtttcactgtgttggccaggttagtctcaaactcctgacctcaggtgatccacctgcctcagcctcccaaagtgctgggattacaggcgtgagccacctcacccagcagggtgagacatcttctttatggcatgatcagatttgcattttgtaaccatcactggctttcatctgagcagaggggctgcagtagatgaagacacatagttaggaaggtcttacaagtagtctgggttagatacgctgatagcttgcacaagagtaggggtgaaggtgaatgtgagaaaagaatgtatttaagggctgcttgcgatttgcagtcaacaggttttaatgtcgcattagatgtgagaagtaaagggagaggggccaaaggtgcagctcagtttctttcttgtgtaacttggcagctagaagttgaaattagaagtcagccccttatccatggtttcactctctgcagtttcatttatttgtggtcagctgcaggctggaaatactaaatgaaaaattccagaaataagcaattcagaagttttaaatgacacgttgttctgagtagtgggatgaaatcttacacatcttactttgtcccttcctcatcacaggaagaaggatgggtacagtacaataaaatattgaataaataagcaaattcaataaagtagcaggatccgaagtcaacacccaaaaaatattcattttttctattatgtgcaataacaatgaatgatctagaaaggaaatttaaaaaacaattccatttacaatagaatagcataaaaaagcataaaatacttaggaatgaatttaaccaaggagttgaaagacttatacaatgaaaactacaaaatagttctgaaagaaattaaaggagacacaaaaacctggaagacatcccatgttcacagattgaaaaaagtattgttaagatgtcaataataccgaatatgatatgcagatttaatgcaatcgttgtgaaaatccaaaagatatttctttttttgcagaaatagaaaaagctatcctaaaatttatatgaaacctcaagggaccccgattaaccaaacaatcctgaaaaataagaataaagctggagttctctcacttcttgatttcaaaaaatacatatgttacaataatcgagagagtgaggtacaaagacaaacatataaaccattggaatagaataaaagtccagaaataaagtcttgtatatatgtgtaaatgatttttgatgagtgtgtcaggatcgttcaatgaggaaaagacagtctttttaagaaatgatactgggaaaactggctatccacatgcaaaagaataaagttggacccttacctaacaccaaaaataaaaattaactcaaaatggatctatgacctaaatgtagaccaaaaactataaaactcttagaagacaacatagggcaaaaactttatgacatcagatttggcaatgatttcgtcattattacaccaaaggcatacatacgtaacaaaggaaaaaatatacaagttggactttatgaaaattaaaaataattgtatatcaaaagatactctcaacagagtaaaaagacaccacacataataggagaaaatatttgcaagtcatctatctgataagggattaatgtacagaatatatagaacactcttcaaacaacaataaaaaaaatcaaattacccaatttaaaaataggcaaaggacttgaatggacgtttctccaagatatacaaatggttagtaagcacatgaaaagagactcaactcttttttgctagggaaatgcaacccaagaatacaacacagcaccacctcacccccattagggtggcttctatgatcagaaatcggaatccgtgggcactgttgatgggaatggaaaatggtcagccactgtggaaaacagtacggcagtgcctcaaaaacttaaaaatggaattaccgtgtaatctaataatcttatttattggcgtatatgtacagaaattgaaagaagggtcttgaagagatattcatacccccatattcagactactcttattcacaatagctggactgcagaaggaacccaagtgtctgttgatgttgaatggatacacaaaagctggtttatacatacaataaaatattattctaaaaaaggaagaaaataccgagattggctacaacatggatgaaccctgaagacattatgccaagtgaaataagccagtcacacacacacacacacacacacacacacacaaaatactatatgaatgtggttgccagggaatgtgaggtgggagggggaatggggagttactgtttaatgagtatagagtttcaattttgcaagactgaaaaagttttggagatggtttgtggtgatagttgcacaacaatacaaatgtacttaatatcactgaactgtacacttaaaaatggttaagatagtcaatgttatgttatatgtattttaatacaatttttaaattggaaaaaatgtcagtaggggagacagtcacagaagtacaaacactgtatgattccactttatatggaacacctggagtagaaacaaagtagaatgatgtttgccaagggctaggaggagaaaggaatgtggaattgttgtttaatgaatactgtgattcattttgggaagctgaaaaagttctggagatggtggtgatagttacacaacaataggaatgtactaagctgaatacttaaagttgctaaaatggtcaattttatgttatgtatattttaaaagctttcttttaaatcaacagggagaaaccagttgatagagggagaaagtgaatatactaaaaagaggagaaaatgattagttacccacaacatgatggtggtggagccaaagcgtagtggaggatgaaccccagcaggcgggagtcagagggaagaaggtgcgagtggtgtagctggaggcagtcagtattagaaggatgagagggcttctattttctctgcaaagtggcatgcaaggccaagtcagaaggaggctgagggggaaagaggttttagtagagaaggtttgaacaaagagatttataattgtcattgaggtgagtgggaccgtcagtaaacctgatgaatggagtaggatttccaggccatgctgggctactttgaggttgaagagaatgaatttagagagaaaccaatctctgtttgatacatggatggtaggatctggaggtgagcaggcagcagcaaagaggagaggggagaggggaggagccctccctgagcactctcttggactgcggaggctacctactctctgagcacttcttcgtgatgattcagtcttcctcactgtgaagaacgaaaccccagtcctgcaaagatttgaaactgtatttaaggccaaagtaaggttgcctgggaattaagagtactggagtcaggcaggctttgatcagatccctcccccaacacttcctgtgtgagtgacttcagcaagttgctttactttacctttctgagcctcatttcccttacttgtaacacagaaatatgaatagttactatccagggtttttttttaggatcaaaggagttactatgtgtggagcatgtcacccagaggctggtatgcagcaagtgctttgtaaatagtagcgatgggcactactgaaacctgaatgtctgcctctgcctgtttgcgaatgactccaccttcccaaatcccaacagggaaggtgagtcagcttgagaccacttgagaggcatctagcagaagggaggcaaaacttctgttaaaggataatttttagggaaaaaaaggtaagatgatgactctcatacagatattaaaaatgaattcatcatgaagattttattttactcgtatgatggaaccaggcagatattacaactggttcaaaggaaaagtcaaagcaacacaaatttggagtaaaggagttgaactagtttttctgtgagataaggcagggggaggggagaaatcaattgaaactctcctgggcagcatcctgcccagtaggcacatgtattagttgcctacaattcacaaagggttgcgaaatagctcccgtggaatcagaatctgacagggaggaagagtgtgctcagaaaatgcatggctttctactgaagcagatttttttcccattacacttctagatctctgtgcaccattgtgccagggctgcgaggaaggtggcccacttcccgggatacactacccaccctcaagagagcctttcctgctgcttcttaggcaagtcagctctcttttctcacctcctgtaagcaacactaagtatctggctgttcctttcgtactcgagtcctggccgctccatgacagcacttgtggtggtactgaactgtgatggacactttctatcattgccctttcttaccttgatatcctaaaaagctggtggtctgtcttctctatcttttgtcctggtcagttatcctaactattttgtgtctgtttctgtggattagtaaacggggtccccacccccactccacaaggagaacatctggcacccagaagtcactgagagaatagctgttgctttggtagaattctgcctctgagtggcttgttcttttcccagacggagaggtctcctgacagcagctctcttctttttctttttttttttttttgagacagagttttgctcttgcgctcaggctggagtgcagtggtgcactctcggctccctgctctgcctcctgggttcaagtgattcccctgcctcggtctcccaagtagctgagattacaggcatgcaccaccatgcccagctaattttttgtatttttagtagagacagggttttgccatgtttgccagactagtctcaaactcctgacctcaggtgatccacctgcctcagcctcccaaagtgctgggattacaggcatgagccactgcgcctggctttagcagctctcttctaaagccatctggacccacatttgttcagctcccctcccttggccatgatgaaggcatgcaaaacaaaaaaggcacttttcttattgagaaggtggctttttatagagaatggtgtcatactgttaggtttcaggccagcagacctagtcaggcatgtgacacttctgtgccaggtgtggctatgagagtcaacaggaaaaatgatatatgtaaatggacaggtctttaaataaatgcagttttgactataagagtaagaaggtttctgtgagactcaactcagtacctcctgtaccctgtgggcctgagagaggagacaatgggacaagaagacccagtggcttccttggaagcttttgtgctagctggagagagaagacctacttcctatatgcctagcaacagtccacactgactggactgcaaccaggacatttccagattactcagtggggcttatcttgaaataatagttgatgccatttgttaaatatattatatataccatctaagggtcttacatgccttctctcatttgatcttcatggcaaaccctgtgaggtatgaccaccaaccaccattttacctcagaactcaggctcccagagtttaagttgctcacaggagcccagaaagtaagcgacagaggtgggatttggttctaggtgtttgccaccagcactttaaatcaccaaagctttctggaagctccaacttttcttctcaagatactgaaagacaggtatctggatgggttggcagggcgggtgggaggtgggcgagatttccatcaacaacgggtctaaaaccagcgatggtgagctgggtgattttgatggaacccctgccatacagtctattaatatcataattggagctaaaatttaatcatgatggcaatcatgagttctggggcttcttgatttgggccagcagacacagtctcagtcactagttctccgaatcagagaaaggatgccttcaggctgtgtcttcacatggcttttcctctgtgcgtggtggaaagagagagctctgcgggtctcttcttgttgtaaggacactggccccattggattagggccccaccacatgacacatttaatcctaattacctccctcacagccctatttccaaacagggtattagtcacattagggattagggcttcaacataggaattctgggggcacacaattcagtctataacagagggaaaacagatttgagaagaaaaaagtccaaaatatgcacagtggtaatatctgaagatgtgcgtgcgtgcgtgtgtgtgtgtgtgtgtgtgtgtgtgtgtttctattcttgcattttctaactgtccccagtgagtatttgttactttctaactgagaaggttactttaaacagtgtcttgagcagcagcactccatgccctggtgtagccttttcctggcagatgttccccagggctctgctgctctgccaatgacttattctcagcatgaactcctcccctgccccctaagaggatctccaaacccaggtcacactccccctgcaggtaagtacaggcgtttgagaacagctttattcttccaggaacagctggtcccctcagcagggccttacaaggtggttatgtctaaataaggcacctgaggccaggagatgtgacatggtccatctaataccatggagtgagttagacacagagcaggactggaacccatgcttccaattccccatccagttttaaggcaatcttcttttctttctttctttcttttttttttttttttttttttttttggagacagagtctctgtcacccaggctggagtgcagtggtgcgatcttggctcactgcaacctctgcctccggggttcaagcgattctcctgcctcagccttctgagtagctgagatttcaggtgcccgccaccacgcctggctaatttttgtatttttagtagagacgaggttttactatgttggccagggtgatctcgaactcctgacctcaagtgatctgcccacctcagcttcccaaagtgctgggattacaggtgtgagccactgcacctggcaaggcaacctttttttttttttttttttttggtagaaaatctttgaacttcatatagatggtgttaatgtgggtgagttcagagccatgtgtaaagttccaggaggggagtgcttgctggcttctcccttatccctcaaccagatcccagccccagccactttctgtttctcttctctggataaaactatcattcatcttcacctgtttctattttcatggattactgtctcattcatctcaagtagctcaagtgaatggctgtttttccattggatacaggaagactgagggtgacctgaccctcatggtgtgcttgcttatttgaatgtctgatggttttatgggtgtagtcctgctggagcagaaagaatatctgttaggagcctgcctctgggctctggttctaactgtgccacaaactcatcgtagccttagacaattctcttgtctctctgggcctcagtttacccatctggaaaatgatgggtctgaatttaataccttgagtatcatccagctgtgacatactacaactcaggcaagaagcaaattctcctgacactccatactcctatccagtgttctctgacgtccttccccaagagctgtggtaccctaccctgcccacattatgtgaggcattatagcacataggttagaagtgtggtctctgggccgggtgtggtggctcatgcctgtaatcccaacactttgggaggccgaggcaggtggatcacgaggtcaggagatcaagaccatcctggctaacacagtgaaaccccatctctactaaaaatacaaaaaattagctgggtgtggtggcacatgtctgtcgtaccagctacttgggaggctgaggcaggagaatcacttgaacctgggtggcggaggttgcagtgagccaagatcgtgccactgcactccagcctgggcaacagagcgagactccatctcaaaaaaaaaaaaaaaaaagaagtgtggtctctggagctagacctaagaatccaattcagactctcttacttactgactgtgtaatttggacaagttacttagcatttagcatctctatttctttaatcataaaatgaacatattaacacttacttcctagggctgttgtgaagataaactgagttgaggtatgacagtacctagcatgtagtaagcatcattaaatggtgtctgttgttttcacatattgtaaagaagaaagcttcgtgcatctcttggaatttctgaggacggtgaagccacagctgggaaagtctcagggagccaggagttgctggcctcctgctttgcatactcaaaattgctggaaaggggctatagcagggggagacattttttaaaaatcccagttattgctattcctcatgagtatgtatatatcacctggcatcagtactctgcatagaaagaagcatagctaaagaaaagacactttgcttttaatataacagctgttttcaggggaatagggtggatgaggatagggagtactggccctctgtcctcaggcctccctgtcaccagctcagtcacgtctatcttacaaatccccatctagcaggaagcctgctctgcccttggactatagacctgaagggctgttgttaagttacaacgttcccagtggaaggaggacagtacttaaaagttacaagatgtgggttctgttcttagttcttatggcctgtcagccagggaactcctggccagtagtctcatccttgaacttcttctttttttttttttttctcaagacggagtctcgctctgtcgccaggctagagtgcagtggcacgatcttggctcactgcaacctctgcctcctgagttcaagctattcgcctgcctcagccttccaagtagctgggattacaggtgcttgccaccacgcctggctaatttttgtatttttggtagagacagggtttcgccatgttggccaggctggtcttgaactcctgacctcaagtgagcccagccctcatccttgaacttcaaatttccaccccaccttactcccacaggcatataccagttgttcctttttctctgttcttatgcaggaaatggcctgaggtccaggagtccccttggtcccctttttccctcactctcaacattcaattagtcttcacatctacagccgacaattgtaacttcttttctttactccattatttcttaggtgacaacaggagcttctttgtggtcttcttttttctaaaaacactaattcagaactctagcatgtttagatcttccttacttaaaaccctttcctggtccccataacctactgaagaaatcctaagctccctggcttggcctctgtctacatttctctgatctcttccagctctttctctgtatcctagccatactgaactacttgcaattcccaaacagggtacacactgtactagttgttcctgcaagagacaggaacacacatccccccacactagcttaacaaaacaaaaaatgcatttctctctcatgcaaaagaagtccaaaagtagacattccaaacttaatatggtgttccagtgtcagaatccaagttctttctactttgtgggtttgccgttctcagcatatgacttccactttatggtccaaaatgactgctcaagctccagccatcacatccacatttcagccaggaggaagaaggaacaaggaaaggcataaccttgcctctaaggatagttcctggaagccacacttgcttacattccattggccagaattagtcacccagccatatttatctataagagaggctatgaaatttttttatttcagggagtctattttaggttgccatgtgcaaaagtaaaaaccagaggtgttggtggtcaaggaagaaatagcgaatggatgctgggtaacatctggcagtctctgccacacactcacacattcaggggtttgcacgtggttccccgtgtctcagacaccccctctctcatgcttacagtctctgcttggcatcttcttttttgccccctaacacttgctcttttttttttttttttttttcgagatggagtctcactgttgccaggctggagtgcagtggtgcaatcttggctcacggcaacctccgcctcctgggttcaagtgattctcctgcctcagcctcccgagtagctgggactacaggcacccgccaccatgcccggctaatgtttgtattttcagtagagacggggtttcaccatgttggccaggatggtctcaatctcttgaccttgtgatccacccgcctcggcctcccaaagtgctgggattacaggtgtgagccaccgcacccggcccaacactcgctcactttatggccatcctcatactacctctgttgttgcaccatcacagcgtgttaaccattgttcaattgtccacctttcccactaccctgtgacctcctggagggcagggactgtgtctttcctttggctccttagcacccagtatagctgcacaatctccagccaaggtagaccgaccaccaatatttcttgtctcaaagatatattgaggaaatgagagtatattcttcaggcttccaggaacttccttacatctgtaggaaggtatgggcatggggatagctcagtgattgtagaggctcgtggcagattgcttgctattctttgggttgcacacaggccgtctctcttgccatagttttttccagatactgcagtgacattgattaggtctcagccttggcgatgtagactgaggtggagagggattattgtcatgattcttgctttcgtttcagtcagttcttgatttgatttctgccatttattcctctcaatttttacctgggcaacatcatctcccgcctgctttttaaggtgaatgttgacagctgatttcatatattaattctggctttcttaagagggacatggctcccttcattcttaagcctttggggctacttttctttctcattcactcatgatctccatttgatccgcaagacagctcatatttgagagagcagagcaaatgtgttattcccatttcaccgatcagaaaatgagggccggccgggcgcggtggctcatgcctgtaatcccagcactttgggaggctgaggtgggcggatcacgaggtcaggagatcgagaccatcctggctaacaaggtgaaaccccgtctctactaaaaatacaaaaaaacccccaaaaaattagccgggcgtggtggcgggcgtctgtagtcccaactgcttggaggctgaggcaggagaatggcgtgaacccgggaggcggagcctgcagtgagccgagatcacgccactgcactccagcctgggcgacacaggctgtgtcgcctttttttgagactccgcctcaaaaaaaaaaaaaaaaaaagaaaaagaaaatgagggcctagtaagattactcttatttgctcaagatcataggaaagttagtggcaaagccaagagttgatcctggatccttttgtatccaagaccagtatcttttgcaaatacttttctttattttgataaataattaacatttacatgcattattttcccccagaatttgaattttttcttaggatagattcctaaacatggaagtattgagtcaaagagtataaatgtgctttaaaaaaaatgctcttaatacattttgcagaattcttcaagcaaggttgtcacactcatgtttaaggcaggtataactacccatgtgcaggccagcccaggagccagtgtggtggggagaggccataaccagccattgctggttccctcagccagcagaggcacacatgagcttctcaccagcccggtgagggtctcctgttgggaggtgtgcatttttgcatgcactctggcctctgcacacaaactgaatatttcatctggtgctcaaccacaagcacagccatctgttccgtgttggaacagatgtgttggactgtgttggctgtgttggactgtgttggctgtgttggacttcgtgagagagcctatgtcagtctccatcaggatgtgtatgtagtgtactggactctctaggtgattgaaaggattccagagataattttgattatatgagtccctgacttcagactccactcttgtgaccaccacacaagctgtgactccaggaggctgggatgccgtgctattttcactgtacccttgcccccgtaatctcaaagcctgactggatggaaccctttctattctatggctagtggcttgtgataaatgtcctttcaggtcaacacagtgcaggctggtatctttacctttctttcaccgaagttaagtgctgcaccagaacttagaagcctcatggggctctggggcctcaggctgtaccttgtgctatgtcagctattacttcatgtcaaacatttgcatatgaatgttcaagcgacagcttatctctttcttcctgcagttggttaccacagagaagcgcttcctcaaagacagtttgtacaatgaaggaatcctaattgtatgggacccatctgtataccactcagatatcccaaaggtaagtgggtgtccgtgggaaataggggttgagtttcctgtctgtctacagattttcctgatttcctaggtttttaaagtcatggctgacattggctattcctaaaggctgggtatttgagttttagggtaccccatttcatctggactagcagattcagaagtattcctgtcctataccagctactctctttgccgtgccagcactgccaggtattgtctcccagttatagtatttactgggatagtggctggagttcccagcatctggggtagattgttcattaatgcaattattcgtgatgagcatcagcagaactcgagagtagttgccgttactcctgtaaataatattagcacacttttatttcacacttccaatatccagaattcttcccatttcactctcataacaatttaaggagatagatggaagtgtggttgttcccattttacagatggggaaattgaaatgtggagaatgaaagtcccccattccaggacttgatttactaagcagaaggcgcagatctgcaacagcagctctttccggggaaggagacatgagtggcaggcctgctggattctaacctctctggaatagtcctctcactgttaatgcatgtcagttgacctctccctgatgcaggctgctgtggcctcaggagcatggcctgagaagggcagagagcactaatcttgggacacttaactcttaagttggatctaccaatgcctgacaggctctggcgacccctggcaccctcactatctgactttcaacagttttgcactgatctcacttagaactcaaatttgcctaggtcaggacaaggactctgaacccatagatgtcctatgctctagttttctcccctttaaaaatgagagatggggccagatggtacgtggggctcttttcagctctgagagtgttcccggactctgatcctgaagcctgaagctgatcttgggtcgccaagctcaactctcccccaaagcacaggctataggctaggccccaccctgctatccagtgaaacctgcggctggaagagaaacctgtagtctgctgcaagaaaagggctgtgcctcaggagcaacacttgttgatcctttcccctccccatgtccactgatgaagatgactcctggggggagcagctcactggcccatttctcccttgagaggaccacttctttctttttcagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtgagttcatgtcggggaaaagaccttgcatgtttgtttctagaagagatgagctttttttctggggtctcattcagtcattcgtttgttcatttgttcactaaacaattgctaggattctgctctgcttgtagaccatgccaagttctatctaaaatacagagggaaatcagatagaatcctttttcctgagggcatctattggggaggtcaatcagatgtctgaggcaatattcaatttgtgccagaagggagagacaacctggtgtcataggagagaggacaccttctagctggacagttgcttatagcctcatggaggaagtagtgttcggtaggctttggagaggggagaatttggcagaggaagatggagggaagggaagctatgaacaggggagggaggtgggaaaatgaggagcggggctgcacctcagacgaggggagcaaggcacttttctcaggtgtacaatttaagggcgtaccccttaaaaactcagtcatcaagataaataatatttcactacagtatcttcagaaaacacaattaatgtaaaaattatgatgagtgaaatatcaagtatttaaataaagataggatcagtaacagtgctgtgcagagtttattggaacaatgctggccaggggcccccttcttggattttctctacatctcatcattcagactgtggagtgctcctgttccagctgtccctttgcccagctaagggaagaaaagtcttccctccccaacactgtttcatgcaaatgctataaggaaaaatctgctcccaaatagcaccatccaagaggttctgcaggatgtcacagtgctagaaagtgctaactacacatgatgccactgtctcctcaatcagctcagtaatcttgtcctctttctccaaataaattattccatggatacattcattggctgattgatggagtcatttaatctactagcatttagggaggatctattattcaccaggccctggcctaggtgctggggattcaaaggtgtataaccctcacacagccctgcatcctaaggaacactgctgggcttggcttgctgaaacttagattgggaatcacagtcataaatagaaactccagagggaaagctctccaaatttggggtcatgagctgctgaacccactgggcagagctctggggtgctggggtgggttgtcaggcatgactcacctctgctcccctctccaggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 388 - DNA, 21876 bp, Homo sapiens
gattcttctatttggccactctgcaagaaggcaatcctctaaggatcaccagcttctacctataagacttcaactcaagatgcaggcaagtaaatgatatgtatataatattagactattccatgcagctccaatgttctaattctactaatcaggaataagaaagttcctaatctttgtagttctactgatccatgggtttccaagctgagaatcaattaatccaggttcctttctcagctttgccactgatttcccagctatggaaaagaggcaagtaactactgaaaaataattatataaagtaagagatatcttattttaattaagaagctcccaatttacatgtagctgacttatatatatgcttcatggaattttggcattctggaaatatctactgtacctaggcacctaggactcaagaacagtcattcttccttccccagagctgcaatatgaataattgggaatttttcttcccaaattccctcctctcccagcttattgaacagatggagattgtattatcttcccctcctctctccacaagtctggcttctctatttatctctggttctgtgtaaactttgcgacatcaagattggctggataaagggactgagatgcgaatggggatgggcaataaccaagccctaggtgctcttgggttcctaccctgctctaccccggctccaggactgcttctctttaggagaacaatgaaggctttaaagaactttcgagggcttgcctgagaaccagtcataaagtgacctttatgaaaaaatagacctaggttgcaaaaattagcttttagaattaacacccccataatatactagtccaatgttcttaggaagagtcatcctaagagaacactggtgctgaacacaggtgattttctacctgagcatacaggtccagtattcaatattctgctttctatgtggtcccagacatggtaatggtcacaagtaaaagatgtagagacttgataatcagtacaagcctcagacaaaaactaattacagccagttcttgcattcatttcttgacctccctttagctacccctttagccatgcatatttacatcttgttcatcaaaaaataattatctgcactaaaatgaactcttatcattgatagtaatagcattacctagatgtacattattttagacaattgctttaaatttaatattctgatttctgaaacacattctgttcaggaaaagaaaaaacaatgtctccaaattcttgatccaatagaaattgcataatcttaaaaggaagagtcctgagagaatagcgtgaggttgagaaaagatctgaagtgacaagataagcaattaatactggaattgctattagtctggtaaccttcagcaagtcagagtctcagtttcctcatcttgtaaagtagaaataatctaactggcatggctgggtaaagtttaagtaggccatcagaaaatactttgtagtccatagagcattaactcatccaggcccctactcaaagtacaaaactgccctttagcatcactgacagcctcttcttgatcacttctagtgatggggaactcatctttggaaggtcatttttgacagccctaatgataagaaagtatatatataaagtgtgtgtgtgtttgtaaaaatacacacatatatttacatatgtacaatgatatacatacatacacatatatgtatataggcatatatatttagccataataaattcctccaacatcagcttcctggttaatcctgatcatcaactccagctcagagcttcattaagggaaggaacaggtcagtgagaatctattctgtaggaacaggaacatgggaacgtttgtcacagagctgatgactgcccttgctgtgttttgttaataactgatttatcttgcttatcatgcctattccaggcaagtagaatgagtttgctttctctgagttccagggaggaggaagccaacacagatgaaagggtccctgtgctgttcaagagggtagcactagccacacagctattccattttaaattaaactaaattaaaattttagttcctcatttcacaggctcaatagccatatgtgattagttattgtgtggcatagttatcaaacatttctattgtagcagaagttgtttgaagagctgtggttgatgattcattaccatctacaatatgccagggaccagttaaactctacatgcaagcactaaaacatcaatagtggaagttttctatcccttgaaaaaattacataatagcatgattaactgagctcttactccggacagttcaagaaaaagggtggcttttattcccaaatgaacatcataggcttcacactctttcccaacaatcttaagaaagtggagatactattaattggttacctatgttgttatcaaatgctcatttccacttacatttggagatctgagcttctctctaaggcagaggtctttaaatcatgaggtgccacacccagatcagaactaaacaaaaattgaaactttaaattggcaaatgtcattgctcatttcttcctaacaagtgaagacctatggttaattcaactgcaggtatggtgaaataactacagttacttagttagacactatttctttcaccacttatctgagcgaagaagtccaggttggatactatatgtagagctttatattaacttttctccaggaataagaaagtgtccacactgccgtttgtcttgaaaacataattagggaaggtgtaccacaaaagaatgggattctctctgagagcatgtttatctactgtcacagctttaattgggaagggtgaaatatctacatctggctaggtctgctcttcaagagctggggccagatatttgccatctctcagccttggtcttttcttctgtaaacagcaggattggagtatatgatcagaaaggtttctgtaattccaatgacttcccaaaataaccatgacctgcatcctatctataaacctcacatagttctctccctaacccatgctgttgtcacaaccctcctacagtcttttttttaggacttagtaaatcgttctgacaaataactgtattctacccataggctttatcttacagtcagcaaatcatttgctaaagtgctaaactgccagagtcataagcccgcattctggaggggcttccagcagtggttggtaaactactgcccaaaggccaaatctgacccacctcctatttctgtacatccaagagctcagaataatatttacatttttaaatggttggaaaaataaaattaagcataatatttcatgtcatatgaaattcaaatttcagtgtctataaataaagttgcattggaacccagcgacatccattcatttatctattgtctatggatacttgtggcctacacagcagagttgagtggtatttggccataccactatgactacatagtctacataccactatgtatgtagactctctcatacagagactgtatggcccacaggcctaaaatatttactacctggccctttacctgcccctgggtgtagagcacagactctagagtcagatggcttggcagcatagctcagctctgttctgttccttccccttcctcaaaactgtataataggaatgacaatagtacctatcccatgggtttttattaagattaagcaaataagtaaaatgcgatgaggatctggcatatttttattattatatatatgtctgatggtattataagttgccacaattttttccagcaaactaaagtattagcagctgaccaatttgttagcaataattgtaagaattgaatttgcaacactccattaaaattcaattctttgtcagatgagtaggtagcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagttttagcttcctacatatggctagcctgttttcccagcaccatttattaaatagggaatcctttccccatttcttctttttgtcaggtttgtcaaagatcagatagttgtaggtatgcggcgttatttctgagggctttgttctgttccattgatctatatctctgttttggtaccagtaccatgctgttttggttactgtagccttgtagtatagtttgagggctaatatccagaatctacagtgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaattaccatttgacccgccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaccaaaaaaccaaacaccgcatattctcactcataggtgggaactgaacgatgagatcacatggacacaggaaggggaatatcacactctagggactgtggtggggtggggggaggggagagggatagcattgggagatatacctaatgctagatgacgagttagtgggtgcagcgcaccagcatggcacatgtatacatatgtaaccaacctgcacaatgttcacatgtaccctaaaacttaaagtgtaattaaaaaaaaaattcaattctttagcagtaaagcagtgggaagatgtctaaggacaactgatatgccaattcgtatagccgtttatccacgaagctaattctgcagtacttaaaaatattttatatgctttatacttctttcaaacttgagtcttgagcttgtactcaacatcgagttcggccctgacatctactctttatagtcggttacctctttctgaagaaacaggcttccaaagagagaccaggggactcattagatgtctcatctaccttgatgattgctaccttgatgattgaaaacagtaacctgcttcctgaatcaaacacaaaacaggcaacatgcagtgtctttgctatgccacaacagggactattagaatttttctcacaattcggactttggttttcaaaagggcttgcgagggaagttacacacaagagaaaaacaatgaaccgaatgaggacaatagcccacgaatttagaatggaggaagcccgtccaccacagcgaaaaagcacagtaccacattggcgggtgctccaatatttgtgaaatgttgatgaccctttaaatgtttctgtgcaacctccacaacaaatactgtgaatcttgcttattaatgcgtttctcaatacgttaaaattcaggaaatcattaagtctagtccttaacagtgaagggcaagcaattttctgtcattgaaattacacaaaacaaaacaaaaagctcacgcctgaattgcttcggactattcaactggaagatagaaaaatatatgaagtaaagaagaataacctacatagaagttcctatctcttatcttcctgaatacttaccagtacactattagtttgttctaaacttttcttatataaaaagtagctgaatacttttagggaaatggattgttttgtctgaatcatccagataattcaaacaattcattttcctaagaacgatatgtgtgagtctgtcctgcccggaaaatgccctctgtcctactcaggacacaagtcacgctcagcttaaacaggcaaggaattgtcccctaggaaggaaatacgccgttgtcgttcagtgaactctgcaaccaacagcaagccaaactctcccttgcacacagttcgtcaagttaattcttattttccaagggcgctttcgtatttccatctttcaaagactccttcacccactggcacctaaggcttgccctaacgcatccagcccctgcctcgcgatggtgcgctccgcttataatagctccgtcctgtccaataaagttgtttaaaataagaaatgtgccagataatagccaagtccgaaggaaaaaaaaaaaaaaagaattcctggggtggtgtattggtgttggaatgtgccattagttttggagggaggaaagtccctggtgtgaattgcctcgcaggtcgtaggccgccactggaccttcagtcgtgcactgcattagcgccgtaatggcaaagatacgaagaagcgcgcaggcaggggagccacggccgcgcgcacaggcaagagctggagacgactgcggagcgcgtcccccacgcccgcgtggtgcgctctggggcggccccctagcggcagggcggggcggggcagggggcggagaggcctggcgcacagggcgagggcggctgcggcgcagtctgcagcatggcgtacccggggcatcctggcgccggcggcgggtactacccaggcggggtaagtgctgactgcgcgggatcgcggcccaggcggctccggggcgctaagaggccaccttggagatgctgcggccagcggggtgaggcgctgctgggcggctacccgggctccttccgccctcggcttctccctgcgctcgcggcctcgccctaggcccctggggttcggcctctccccacgtttccccgtcccttctcctggatggccctgcggggccaaggtgagggtggattgggaccctagaagcccaccctgcggcttctcggatacgcggcgtgaaatcgtgttaattgggtgttggctgacccccaccccaccccacccccgccttcttggttgcctcccagagcaacaacagtcattttattctagaatgatataccttcctccctttaaaaaacaaacaaacaaacaaacaaacaaacaaacaaaaaacgagtgagaagggggacggaaaaaaagggaaaacctgctgaagtaaaagacctgtaggaaggcagcctcgccgggcgtctgggatgcgcgttgtcttgggaactgtttccgagacaggcaatgttccctcgccacccacgagatacagcccggccggacaccttactcttccctaggctacacccgtctcagaatgttaccaactccagccttccatcgttcataaaacgctcttaaaataccataaatgctgtaacaacaaaaggagaatttgaagccctgccattcgttggcttacctagtttgcactcacctcagtaaccttcaggttaatagggattttaaaagttgctttacatatgtagacatcactttcacagcaactctttatggtctaagtcgccagtttttaaattacggggtgtgaatggaagagaggggtggagtgttggcagagtgtgcccggtggtggggaggtgagccttgtgaagggcgggcaggcgggcagttgtctggccttgcacaaaagccctcagtggtgaaagaagaaaacttgattcggcagaatgacgtgtatgtgtttcctgtttcacagtatggaggggctcccggagggcctgcgtttcccggacaaactcaggatccgctgtatggttactttgctgctgtagctggacaggttagcttttccctttaatattaaagagccgttattgtctgcatttgtggtagcttttgatatagtgacacagaaaagcgaacttcctgtggtactgagtccctttgcttctgcaaaagaaaaaaaaagttgtttcttattttagttttttatttctgaatgttcagaataaatgaggacaaagtgttactcgtatttatgtgagttcagttcgaaagcaaacttgtggttgaattaaagggtccaggatggtttcaagcgaaaaaattcaagatctggtaaatataaacgcttgtttgtacaacttaaagacatatattagtaattacatagctcgattctaatgggcactttctttgggttgaacttgattgctaatcattcacccccttaggaaatatggtaaaaacccaccagcttctaaataaggaagttactgttcccttcttagtatcagaaagttaatcttgtgaacagtgtagtttctctttgatgcagatgctgttactaggtcagcccctccatgtccttattaggtgttctggcctgttgacccagagaagcaattaaggtcagctccccaagacctttcacttgtctgcattctgagttgtatgacaggtgctatcttacattgacaggtgctatcttacattgagagaggacacttccctagttcatgaggtcactgtgtgcagtaaatatactgttggtataacccagacacgtccagaggagatgtttgttcttatgaattcaacctagttttgttttgaccaaaagctagaaatagcaaaatcttaatgtgaaaactgtagaatattatgggataaaaaacctaagaccacttttaaggtagtactctaagaaatacagcttaagaaattgaatggaaaatatagtctaaaactggaagaccttccccttaagtatctacttaaactgttaatgatctgtatctttgaaaccacaaggcatggcaaacctcaagactagcattcttagattgccagtgcctccagcatgtaagtgactccacctgcttagctttcagcagccctggcctgtattcagcatacccattgtctttcaaattgctgatcttgctcctcatttataacttataatacccagtgacttgaagatttaggtattttattttaaagtccctaaaaatcacatatatctagttctttcccagttcagccagtgaatgggcactgggaacctaatgtgaatcttccagatgtatttgtgctctgaaaaaaatgattcactatatcataagaaaaagtgaccaaggaggcctttttctgtttgaaccaagccttctatttattgatgtctgctttgtaccttgctctctccacccccatcaaaaaaaaatattttaaaatgtttagctgtagcagtttgctagctcagattgagagaagagtagttgccaagacagactctttctttcatcattaaattacttttggaagtgggttaaggaaaagaatgcccacttttggaaggcattccttttaataaaaaaaaggcattccttttaaataaaaaaaagatactgattttctttgttgttattgcttcattgaatgctgaaggtaaacaacttgaaagtacaaatcactattatgattcctctaattttttttcaaaaggatgggcagatagatgctgatgaattgcagagatgtctgacacagtctggcattgctggaggatacaaacgtaagttgacagtcccaaagtttgtctaaatatactcttgtgtttcctatcttagctgttacttgtgattacagccttcaagaaaactgagcttgtcggatctagcaaagtttagaattccgaaagctaaaatacagtactatttcaaaatgttgatttgaaaacagtttttaaatcactccaggctgggcacagtggctcacacctgtaatcccagtacttcagaggcccaggcaggaggatcgcttgaagccaagagtttttggctgcagtaatctatgattgtaccactgcactccagcctgagcaacagagcaagaccttgtctttaaaataataataataataaattattccatcctacctgccaatctagtggatttctcagatttgggttttgtgtacctagaaccagtgagacagtttgggtggcctccttcacagaggacaaggtagggtgctgaaatggaatctgccaggtcaggggtcattaactgacattaggaactgatatttactgttatttgccaagagcctactctgccctgacctggtggcacttagggctttgagttgctgccctgcacccctggtccctgagtggcctatcctgcactcctggtctctgagctttgggcatgctcctgctaacataagtggttgccatgacatccctcaggtctttcctcttccacttcatagaatgtattcaggctaagtgggaagtggcctttctacttactggacctgctgctccataattcagcccttaccctacccctgccttttgaacactctgccatgagctgagagtaatgaaatactgcaaagatgctccatccctggcagggcacagtggctcacacctgtaatcccagcactttaggagactgaggtgggaggattgcttgagcccgggagttcaagactagcctgggcaacatagtgaaaccttgtctctgcaaaaaatttaaaaattagccaggcatggtggcatgcacctgtggtcccagctactcaggaggctgaggtgggaggattatacaagcccaggaggcggaggttgcagtgagccaagattgtgccactgcactccagcctgggtgacagcctgtctcagaaaatccaaaaaattgctgcatcccaactgggggcttctcatcatccaacacatatgaagtggttcctcttgaaattagatcttgaacatgatagatttccagggtagagaataatgtcttagttcaaatacattaccaacttctttgccagttgttaattgagacaaaacatcaaattgaagacccaatttcatggttagctgtggattaaaatgttcaaactagaattcacagctgtgaatttatagtggcctttttttaaaaactatttgacatggcatgtattagatggctgtctttgaactctttgcatttgttttcattatcctttgttttatgtgactttagtatcctattactctttcctaattagaggaattaatacaaacgaagaacctttcaagttcctgttatttaatctagtcctaaacaaaataagcactttttggattaggggatgttattctttactgtgtaggcagtacatttaaattgttaattgttacgcaattgagctggtaaacaaggtaggcctgcctattagcagggtttatcaaagtgcagtgagatcacagcatggcctgttattctacatcctttcagtagatgaggtgtggcagattttagaatctgactaacaaaatgggttgtatattgttagagagcagtccttttaaaatttcattgagaaagccacatttagtgatggccttagatcaatgcattaaagagaaagcatttcctgaatcatggggcctatgtgattgaatccatttgcctactctctggtggccgtactgaaccacagaaccatcctgcctatgaggtgtcagtgttttgtaatgcagatattatatggccattagtcttttaaacccaacttccaaaccaaaaagcacaggtccgaattggatgagcaggtgggatactccagctcagagcctatgggcccttcttaaccagtttaaaaggaagcagtcatacctagaggtggagttggtgagagaagttgtgttccagtcagtaagattgtaattcagcttctcttttttccctgaatttagttgttcgtctgtgataaggttgagagaaacagctggaggtagggctttccttctaggtccattatattgtatgtttctgtgagaagaaaagatgtttgaggcattctagtagaatgaacagaagagaagaaaaagagtaaaggtaaattacagcagagattctttggaaattattaaaattaacattatttaatttaaataatttcaaaatgttgaattaataattttaattataatttatagttataattatatgtagttacatttacgtaactaatatataatacttataattttaattaattttaaataattatttaaaatagaattaacactaataaaagctatattattaacaaaattgagaaagagttttccttaccaaaacttattggacatcagcgttctagttcattggaactgtctagaatggtgtattttttgttcattcacttttgttcactgccatctcactgccctttcagatccttctcacaaaagatgaccagattcctgatcttcctgatctgtccctctcctcctcagtctttactaacagcttagaaggaattcaaggtcctctgtaatgcaccctcccctgaccaaacatattttctcccactccttttgtactctttgaaagtcatattgagctattcacttacgctttgcctgtcctaggccttctacttctctctttgcttatgctggtccttagctgtcaccaaatgcccccatcattcttgtcattcaaggcttggcttaaattctttgtcttctataaagtctttcttgattctcttactgggaaggagcttctcacttctcaatcccttctggtactttctggcccctccattataattcagcactctaccatgattagggttatatgtgtatgtgacttatcttttccttagactgtcagctaggacggtatgcagtttcacaactgtatctgcaaagttcctgttaccctgagccctgaacataataagtacttaacagtggctgttgagttaatgaatatggaaaattttctgtgtcagaaaaattatagccctgtagccttattggctttttgatttaagattatacattaatttttgagcattagtaaagattagaaaattttattcaaaaaacattccttcttagacgatctaagagggttgtacatataaagtgcagggctctacagcttcctgcgtgggggtgagaatttggtgccatccatccataccagtgcatttttagtgaatacttcctatgagctaggtgctggctctgtagccacaatcaatgcctgggtgttgggaaaagcactgggataagagagaggctgtggaatcacatagaatgggcacataacccagacaggagtcaggaaagttttccttgcagaattgatacctaagctgagcagaaatgaggccgaccatgaagtgagtgggatggggaagttgtgtcctaggttgttagaacagcatgtgcagaagacccagaaatagcgtggttcagtcaagaaattgagaaattctccatgaagatagtgtacggggttgaacaagagtaagagatgagcctgacttgcaaaataagtgtgttaccttatgtaccagttaaggtgcttggactttatcctgagagcagtagatcactgatactgggttttgcataggagagcacatactacccctgactgtaaagactaataaattgggggacatggaagtaaaacaagagtcagggatgcccattagggagctgctggagtcatacaggtgagagaaatgctaactaaggagacagtggggctggaaatggactctacagctgtttagaaggtgattgattattggtggagagggaattgaggaggctcccaggtttctggcttgggttactgctgagtggatgggggtgccattcattaacagagacagagaagctgtctgcctcatagccccttcaataccttcatgtgagcccaacacagttggctctgcgctgtggttgtcaggccgtccagagcagttcttaaactttagcagcattggcatcacctggaaagcttacaaaaaccagattgctgggtcatgccctagagtttctcattcagaggtctggagtgagtcctgagaatttcacctctaacaggtttccatgtgatgctggttcaggttgaaccagcttctttaacatgaatatctatcacctgcacatctgctaaaattcagcttctgattttattggtgtagggtaagggctgagattctgcagttcttcaagctcctgggtgatgctaatatggctggtccaggaatcacactttgagtagaatggtggtctcaaccttggctgctcactagaatcatctgaaaagctttttaaaaatacaaatacctgggtcccacactcagagttcctgatttaattgttctatggtgcagcccaggtatcagaatcttttaaagctttgattcagataagcacaagtgtggagaactacagctccagattagagggacttcatacctccacacaacttaaaagtcagaatgaagaatctaccagctctttcccaaactgtaaaaagtgcttcctcctcctctcacctcagagaatattatctgtggatcaaatggagattgaaggaccaaaatagaaatagtcactagtcttttatttccagtaaagcatatgccaaacacaggaatctattaaatgtgtaaaacctatagtttgcactgttgggagacattacagtaatgagcgcagttgtgttttaatttcagtttggtttgagaaaaaatatgaagctacaaagagctgttaaaaatgttctgtgtgttaacaagcttgcagaatttataccagcttttcccacgtgacccttgtcacttctgccatttagcgttgtagcttctttgtacctatacaatttcttcagtcattgattcccattaattcaatgtaagaggtggtttttaatttcctaatgcttaggttaccagtaaccacacccattgcatgtgctctggtttggttacataagtgaggtaccaaaatgccctcataatactcctaaactgtaggtaaattaaaaaggcttctgaatagtggccaccactgaattggtcatggggtcttatctagagtactcttatttaacacataattctaacaaccatatttatctggtttcatatataagctaagaggtcatagactatttgaggtaggaggttactgctcagtacctgacattgaagggaaaatagaaaaacaagtaatcagacacaaaattagcaaaaccagcaatttatagtcatttatgagtaggaacaaagcaaccctgacttcccacccaccatgttggatataatacattatggttcgttatggtgacttgaactcgctatattacagtttcaaagcaagaaagtatgaacagtactatgtaatacttttttttttttgagatggagtcttgccctgtcacccaggctggagtgcagtggcatgatctcagctcactgtaaccgcctcctcccaggtgcaagcaattctcctgcctcaaccttctgagtagctgagattacaggtgtgtgccaccaggcctggctaatttttatatttttagtagagacgagtttttgccatgttggccaggctggtctcaaactcctgacctcaggtgatccgcctgtctcggcaccccccaaagtgctgggattacaggcgtgagccaccatacccggactatgtaatactttttaaaaggaattctgtcaaagttatttaaatcaaatttgggttcctagcaaaaaatcttctttatggagaaaaggctactttgaagttccatatgattagtcacacgtaaattgatagcatataaaaataaaagtgtataataatcatatttctaattaatttgaatgtatccagtgtaatgtgaatttttggatttgtgttaatatgtatgtacttttcttgatttaacagcttttaacctggagacttgccggcttatggtttcaatgctggatgtatcctttactttgattgttgtctagaataattttttctaaaattctaaaggaattcatcttagaattaatatctagtaaacacaaagtaataaatgatcactaaaaagctttctgaaataattagcttctattatagggtggaatttggtgtgaataaaggaagaaaagaaatttagtaaacagaatgttgttcaggaatttaaggaaacatcagagtattatagaacaagtacagagtccagagtgtcaggacagctttttttctttaacattgattcctctgcaagtgatgggatttttcacatcccacttgttggactgagtttaggtagtgctgactatccagtgcattccatcccacctcatttgtctgggggcactaaacaagggaatattagtaccagagatgatgctaggacagaagggcaaacagcatagcctgaagcacccacaaagtacagcctagttccagtaacaagaccgctttttataagtggttcacaatggcaacgctatttccttataatcaagtcatgtaagttatcttttccccacagtaaaaattggcacttgagctttttctccatagcccctttctatttttaaatcattaattttacatcataccaagaataatctacaataacttttttagccattgaatattgaattccccttatccttgatctttcatttaatccttagaaaatatcgcaaaatacagctctaatccttgattacagttcagagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggtaggtatggcttactagaactctccattcattggtagaagtaagttgatttttatttttaaaaccaggctgggtgcagtggctcacacctgtaatcccagcactttgggaggccaaggagggtggattgcctgagctcgggagttcgagaccagcctgggcaacacagtaaaaccccgactctactaaaatacagaaacattagctgggcgtggtggcatgcacctgcagtcccagctactcgggaggctaagacaggagaatcacttgaacacaggaggcagaggttgctgtgagccgagatcacaccactgcactccagcctgggcgagagtgagactccctctcgtaaataaataaataaataaataattgctacctgaaggcagtttctgttttcttagaaattgtgtgtgttcataattaatatgagtctgcagtcttaaaaaataaaatagtgcttgattattttattttttaatgagcttctgcaatcctttaacctttttactggatggcttttcttttaggatttaggttgagtccccaggctgtgaattcaattgcaaaacgatacagcaccaatggaaagatcaccttcgacgactacatcgcctgctgcgtcaaactgagggctcttacaggtgagttctataaggtcgtgtcatcaccacaagccaagacacagtttttattacatttcatctctcagtgcttctcaacttttattcttcccaaattttttcttgctttagtagtttttttcagattactattaagcatatctggcaaaataattttttggttttttttccagaatttattttagattagtaagtaatctgccattaaaataaacaattaaattttactaaaatgttctaaaacacaatcagctaacttgtgcatttttgatcagataataatgaatttttccccagaatgtgaaatatttggaaagagtgaaattaaaataaaatccttttctatagggcagagctgaaatggtagagaaactgattacagcccatttgttatattggggactctttatctgtttcttaagcagtatctttgttattaagaagctagaaattcggtgcttttatcacaatgaagtaatggccatggaagttgcacagcttttactgactttgggtaaggtattttctccagatctaaaaaaacaaaaaaacaaaaaacacagctggccaacttctgcctgttactttgttgcatattaaatcttttactattcatatagttggcttctttgctttggtcttttgtttatgttaattggttgcacaatttaaatgttactgcaatgtgaattcaatgccaaaataactaacttttatgattttagaaaaaccatttaaagaaaaaccataaattttactgtgttgttttacagacagctttcgaagacgggatactgctcagcaaggtgttgtgaatttcccatatgatgatgtaagtcttagaaattaagagatacagtagatgaaaaggatgtacaccagatgggtatccctttgaaattagctgttaagaatatcttaaggttaaggatgccagagacataagggattcaaaagttagaaagagttatcatccagaatttattaatttcatttattagtcttaactatagtgagaccatgatttgatttgcattcagagacctgggttcaagacccagcttgttgtatttattagctgggtcacttaagcaggtttcttaattgctgtgacactatatgaataaagaagatatagtagtaatgcctttttcactgagccattgtaagatttctattagaaatgcccttgaaaaacactatgcagatatactatctgcttttgtcttctgtaaacaaatcatgtcagtcactgagaatagataacagctcaatagttttgcatacctatgttcttcattgagggcataaggcaggcaacaacttaaatcacaattttttttttttttttgagatggagtctcgctctgttgcccaggttggagtgcagtggcgcaatgtcagctcactgcaacctccacgtctcgggttctagcgattctcctgcctcagcctcctgagggactataggcatgtgccaccatacctggttaagtttttttgtatttttagtagagacggggtttcactgtgttagccaggatggtctcgatctcctgtccttgtgatctgtccgcttaggcctcccaaagtgctgggattacaggcgtgagccactgctcccggctaaatcacaatttaaaacaagttatttactaaacagccaaactaaacaagggtagggtaaggccatgtaatcagtgtgaacataacctagtgccatctttgatggcattagctggatgtatataacaaagctagagagattggttacttgtttcttcagtttttgctcagccattgatttaaaaacaaaaaacaaacaaacaaaaaaacttgtagaattgaaatgactgtaatcactgaatattccattctccattacaaaatataagatgcatgtatttttggtttagcagctgctgcagttataagtacacttttaaaagcttagtatgtgtgtgtgaatatgcttattttacctgcttaagggtgtgttctctttaacatgcgttaacttcttagttgacagtccccttgctgtttctaaagatcagaaggctgcctggggaatggaaagaaagaccatgggctttgacttcagatggggctacttaaaagatttctaaacatcctgatccttattttccttttctctaaaatagggataatcaccttgaccttgcaatagagctgcaagggttagcagtgcacaataccttagtagtgtagggaacactgatagagcagaatctattgctttatgtttagcggggaagccaacatttcacagcaaatactggtatttctaatctcaggtatctgaagggttagctgttctgtttctgtgcatacatacacttgcatgctacaatttgttttaataaagcagattttaaggcaataaactgtttaaggtgttccattagagtaatggggtaatactgtgtggtttggaaatccccacgtaatacaacagtataaactccagttgtttgtgtttgtggtaagtgtctttgaccacggccatttctagtcttggatattatttggaatttaaataattattcaaataattatttaaattatttatccattgaagttatatctgctttctctaagaagttttgatgtgagaaaccctgtggattttatattagactgcttccctaaaaaaaggaaacttttccatctatcatttactcatatcttagaaagttgtaggggttgttttacccgtgttcaaattagaaaaccaaatgtaagctgccagaaataggctgtgccgtataagtgctttgaggtctgtcatataatgctgatttttctttcagttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaa

SEQ ID NO: 389 - DNA, 50226 bp, Homo sapiens
tttcccgcggctgttcgctgttccagtgggtcgtggcggtggcggcagcggcggttaggggatgtaacggtcgcccgcctccggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgagaagctgctcgccatgtctaccccagttccaggcttcctaggtttcccctagtcccgtcctgagaactgtggccccgacatcagcccccggccagtcccctcaggttgttccctgccatgcctcgtcccctaacccccgcccctttagccacggcccctcccactttctcctcgctgctttcccggctccaccctcagcgttggagcaattcgggggttcctcgctggttcccacccgtggaaatgcattttgcttctgtaaatcacagcctagtcctgctatattttaacccccgttctatcgcctttagacgtcacgatcatagctcactgcagcctcactgccctggcccccgctgagtcattaaggtcccttcgagggttcggtccagagtgttacctgccccaactcttcctcgcttctaccccgccttctctcaccttctgcgatctctatcctttttcctcaccaaggtgggattcttaatccatattgtcactcaaaactatgagaaagacgtgagaagttatttataaaatctctgcagtgctgcctggggaggagggcgtacagaacagttccctaaatcctgagacagaaaaatggaaagaaatgatttcacagtaggtagaaggaattccattagcacagcggcaattaaaaaaattgttttccagctgtgtaggcacaaaatctgtttttataaaatggagatgataagaaccatactactggtagggcgcggtagctcacgtctgtaatcccagcactttgggaggccaaggtgggctgttcacctgagatcagttcaagaccagcctggccaacatggtgaaacccgtctctacaaaaagtagaaaaattagcccggcatgctagcgcgcgcctgtaatcccagctactcaggaggctgaggcgggagaaatcgcttgaacctgggaggcggaggttgcagtgagctgaggtcatgccactgcactccagcctgggcgacagagtgagactctgtctcaaaataaataaataaataaattatactattgcattggagggaaatgaaattttaattgtgatcttcttggcacggagtccagataaagggaggatacctggtagctgctggtggagcttgttcctgccccatgactttctcctgcactgtgattataccgcccactcctggctacagggctctggctgtacctcccatgtgctctctgtcaccaaggttcagtcacactggcctgcttttggttttcctgaggctccatattcttttctgcctcctggcctttgtgattggtgagtcctcagcctgggctttttgctgcaatctgcctgtctggctccttcccatccttcaagtctcagcctgaatgtcgctatcttgaaaggccttctcgaaccccattctaaagcaaacagccaccttcatctgtcacccagcaccctatacttcatagcctttatcttatatgttcctgaaagtgccctttgagctattaaactacatataacaatagcaaattcagagaggcgttatagcaaagtggctaagagcacagactgctgctgatggtatggttggacccaggcagcctgagcttaaactttagtcctgttcttcctggcaggttatgaacttcgctttttcttttctttttttttttttttgagatggggtcttactctgtcatccaggctgtagtgcactgggttgatctcggctcactgcagtctcagcctccctgggctcaggtgatcttcctgcctcaagcctcctgagtagctgggactgcaggcgcatgccaccatacctgactaatttttttgtgttttctggtagagacagggtctcgccgtgttggccaggctggtcttgaattactgagctcaagcgatctgcctgcctcggcctcccaaagtgctaggattacaggcgtgagctactgtgccccgccaagttatgaacttatctgtgcctcagttttcttatctgtaaaatgagaataatgatgtagaaatctctcatagggtatttgtgaggattcaatgaggttacatatcctaggcacttagaacaacactggcatatggcaagtactctattcatgttagctaatactgatattatgactgtgtatttggggtaatatttatttattttttttgtttggcagcacagagttgatctgtcttgcaaagacctagtctaaaagtgaccattcataccagggcccagtaatgctgatcgacagataagacaacatgagtgccatggcttggttgtttgtgttggaatcctggcactaccccttcctggatgggtaacccctcttggcctctgtttcctcaactgttttgttcctttttttttttgagacagagtctcactctgtcgcccaggatggagtgcaatggtgccatctcagctcactgcaacctccgcctcctgggttcaagcgattttactgcctcagcctcctgagtgcctgggattataggcatgggccaccacacctgactaatttttttgtatttttagtagagacagggtttcgccatcttggccaggatggtctcaaactcttgactgagccaccacacccagccttgtttaaattttaaatattactgttcatgtggttttttactcgttgaaaccgctcaaatttctggactgtgaatctgatgtggggaaactgtctacctttggtcactactgtgtctctcctgtacagcccaaagtgctagctttggagccagactgcctgggtttgtatatcaacattgccacttgcagatgtaggatcttgggcctcagacttcttacctgtaaaacaggggtgataatagagccttcttcgtggcttgttgggaggattcaagtcttttatacatataaaagtactaagaggccgggcacagtggctcatgcctgtaatcctagcactttgggaggccgaggcgggtgtatcacctgaggtcaggagttcgaggccagcctggccaacatggtgaaaccccatctctactaaaaatacaaaaattagccggacatggtggcatgtgcctgtaatcctagctactcaggaggctgaggcaggagaattgcttgaacctggaaggcggaggttgcaatgagccaagatctcaccactgactccagcctgggtgacagagcaagactccatctcaaaaacaaacaaaaaaaagtacttagaaacttattcacaggtcaccttctcaccgcggcattcgcccccttcccctgtgctcctaacctccttatctgctttcttctctcttgcacccatcattacttggcatctatttcacatatttgttctgctccttttctatgttctacatacccatcaccagtagaatgtgagccccccgagggcagggatttgtctcttcctcaccactctgtgcttttcacctagcgttgtatttgtcaaaggaatgttgagagaacaagtgttagctgctggtggatggcgtggccacagaagctcagtgtgggtgttgaatgtagcaggacctgaatgggtggccaaggcggctgcaccatgtggtgctggctagggtgggtgcctctgacttgggctttttctttgcaggtgtcactcgagaaggtgcttggcatcacagcccagaacagcagtggcctaacctgtgaccccggcacaggccatgtggcctacctggcagggtaagcagataagggcctcgacgtctaatcattgctagggaatttggagcttggaacctgaagccatccgtaaatcgctctgagcctcatatttttcacctgtagaatgtggagaatggggcctgcctctgagagctgtggagaggattccatagccccctctctgtctagaacagttcctggcatgtagtgagtgcaatgaaagcctttattatgactacaggggggaggtgacagcgattctgggaaagacaggtgattaaagtccacgctgtggtgtcaggtaacctggatttgtgtcccagctctgccatgtatgctgctctctgagcctcttcctctgcctctgtaaaacagagctggtgaccccctctgcttgcatagttgagaagactgaagaagatgctacagctgttcattccataaatactcatgtagcctggcactgtgctaaggacgtcccctctctgggtttgtttccttatctataaatgggcctaaatagtcgtgacctgacctggcagttgtgaggatttaaaacaattacatccctctttctctctttttgttttgttttgcttttttgagacagagtctggctgtgttgcccaggctagaatgcaatagtgtgaataacagctcactacagccccaacctcctgtgctcaagcgatcctcccatcttcacctcccatgtagctgggactacaggcacatgccaccacagccagctaattttttttagtggagatgagatctcactctgtcgcccaggctggtctaaaactcctgagctcaagtgatccctcctgccccatactcccaaagtgctgggattatagccagcttaaggtcttaattagcctagggcctgacagacattacctcagaggaagtgttggtttctatttaagaacatagcaatgttaaagtgccctagaattctcagcgtaaacacctggaggagggggaggaggaggagaccagagagaaccgagggagcttgtttatttgtgggcttttctggtgggaatagaatcatcccaggaccccaacactccccacagttgaggcacattttcctctttcttcccagctgtgtggtggtgattttggaccccaaggagaacaagcagcagcacatctttaacaccgccaggtaggctgaggcctgggcccggggcaggggtggaaccaggggcttggcacgcctcccctcccctacacagcctggagatactcatgggtaggtgctcactcattcacttacatgttggctcagcagcattcgcctgtgctgggtgctgttccgtgtgctggggacacagcagtgaccagaggagacgagaatctctgctggctagagcgagacagactgtaaactagtcagcaaattacgggctgatcatgatcagtgctatggaggaaatgatggaggatgtcttcgggcaggtttgtgggcagagaataggaggaaagccttatcagaaggctcagggaacgctgccttgactctgagacctgaaggaagcgagagggtgacccataagaagctgtagggagagcgcttcaggcagggggcacaggaagggcaaaggccctgcagtggttaagaatctccggcgctttagaagcagccagggatctgggtgcctggagaaaggagcagggaagatgaggctggaccaggcagaagccacatcccgtaggccttgcagccttgtagagggtctgcatagcatgctgagtgcagagagcagccacaggagggcaccacaggccaggaatgtgcttttcacccccagccctccagcagctctattccctgctttgcttttctccacaaaatttgctcccatctctgatatgctgtccagtttcctcattgatggtattcactgtgggtctccctcagtgtgagcactcttgagagcagggactttctctgagttcatttctgtgtccctagcaccaaagagcagtatctggcatattgatggctattttctaagagaaagacttaacatgatttgggttttagaaagatcccttcagctataagtttactggggaaggacccgctcctctgccttggggctaactgatcactgctaccctggggatgtggtcccaatagggctgtgacctttggaaggcacaccatgtccctccttggcatagctcaggctcagctcctttggcccagttctccaggtggatggataaggagtgggttttctcctgcccttatggtccctaaggtacggtccttaagctacggcaggttcttgttatctgacagaagtgcattccctcttgaaagtggctttttggaccttttgctcctaactgtgggttctgttactggtgataagggcagagctgggttccattcctggctcaagcgtctattcactgtggaatctcaggtgagacacttctttcagagccttggtctcctctgaaaataaaatagctgcctccaactgggagagcattcataaggcagcagctacaaaccagagtcacacacacttgcccaatatagtatgttttaaaggttggataagtggacaacatttcaagttttttaacacaaaaatccaaatgtcccttttgtttggagaagtgagaaattctctggcctctggggcccaaattcccctgtggcagtgaggggctgagcttagtgaaatttgtcaggcccgttgtggccagttcctcacacctgtgttgcctccctaatccctgtaggcagtggagtgggtggcctggatctatagtagatggtatgcaggtgtccgcccttggccaccagtgggtgtgcattaggaggtggtgtggccagtgtggggattttcactccaactgcatatcagaatcacctggtccctgtgcctcaccgcccccccaccgccacgcaagagaaagccaaatcagttgatctgggatgaaacttgggcattggcaattttgagactttttatattgaaataatttcagacttagaatagtacaaagagctcctatatacctatgtacctttcacatatttcacaaatgttagcttttttttcttttttttttttggacacagagtcttgctctgtcacccaggctgctggagtgcagtggcacagtctcagctcactgcaacttccacctcccgggttcaggtgattctcatgcctcagccccccaggtggctgggaccacaggcatgtgccaccatgcccagctagttttttgtgttttagtggagacggggttcatcatgttgcccaaggtggtcttgaactcctgagcttagacagtctgcctgcctcagcctcccaaagtgctaggattacaggtgcgagccactgcacttggccaaatgttagcattttaccacatttgctttatcattttttgtctatatacatattaatttgttctgaactatttgagaatcagttgtagacatgatgcccctatatctctaaatacttcacgccaggcatggtgattcacgcctgtaatctcagcactgtgggaggccttggaggcaggaagatcatttgaggtcaggagtttgagaccagcctggggaacatggcaaaaccctgtctctactaaaaatacaaaaattagccaggcctggtggcaggcgcctgtaatcccagctactcgggaggctgaggcaggagaatcgcttgaacccgggaggcagaggttgcagtgagccaagatcatgccactgcactccagcctgggtgacagagcaagagtccgtctcaaaaaaaaaaaaaaaaaaaaaaaaaacttaatcaaataaatacttcagtgtgtatttcctacaaaaaaaaatgacaatctttttaaactgtaatacatccagcaaaatcaggaaatgaaaattgatatatcactctcatccactccccagagggcaccattcaggagtcagcctttgtcccatgaatgtcctttatggccaaaggattctgtctagaatcacacattgcattgagttgtcccctcagtctctttcaggctgacgtggctcctctgtcttttcttgactttcaggatcttgacatttttttttttctttttgagatggagtctctgtcgtcaggctggagtgcagtggtgggatcctggctcactgcaacctgactccccagttcaagtgattctcctgcctcagcctcccgagtagctaggattacaggcatatgccaccatgtccggctaatttttgtatttttagtagagctggggtttccccatgttggccaggatggtctcgatctcctgaccttgtgatccgcccgccttggcctcccaaagtgctgggattacaggcgtgagccacagcacctggccacttttttttgtttttttgttttttgagacgaagtctcacactgtcgcccgggctggagtgcagtggggcgatcttggctcgctgcagcctccacctcctgggttcaagcgattctctgcctcagcctcctgagtagctgggactacaggcatgcgccaccgtgcctggctaatttttgtatttttttttagtagagacggggtttcactatgttggtcaggctggtcacgaactcctgacctcgtgatccacccgcctcggcctcccaaagtgctgggattacaggcttgagccactgcacccggccaatcttgacactgaggattgtagacgaggtattttgtagagtgtcccagcatttgggtttgtccaatgcctcctcacgggcagactcaggttctgcatctttggcaggaacagaccagaaggggtgctgtgttcttcctggtgcctcctctcaggaggtctcctatgactggtggtgttcactgggagcacttggccaaggtgttgcctgccagattcctccacttcaaagcctctcttttcacctttgtgattagcaggtatcctggggacatctttcctgagacagtgcaaatattatcttgttcctcaccaaactttcactcaactaatcttaggctttgacacttttcagatgctccccagggaaatctaatgtacagccaggactgagaactactggcttagaggtcagggctctgccctgtctggttaggtaactgcaggcaggggacttccttgtgttgcagtcacctcatctgccaagttggttcatgagagccctgactccatgaagcatgcttgaggaatcagtgcactgatggccagacagcatttgccagagggccaggcacaaggtcagggcatgcgacaggttagaggtggctacgggcaacagaaacccctccacagcatggcttaaaacccaagagcatgctcttcctgcatgtcataagtccagaggtgggcagcccaggggctgtgtctctgaacgccacattttttttttctgtctctctttttgagacagagtctcactctgttgcccaggctggagtgcagtggcgcgatcttggctcactgcaagctccgcctcctgggttcacaccattctcctgcctcagcctcccaagtagctgggactacaggcgcccaccaccacgcctggctaattttgtttttgtatttttagtatagacagggtttcaccgtgttagccagggtggtctcgatctcctgaccttgtgatctgcccacctcagcctcccaaagtgctgggattacaggcgtgagccaccgcgcccagccccacttctttttttctctagacggagtcttggtctgttgcccaggctggagtgcagcagcacgatcttggcttgctgcaacctctgcctcccgggttcaagcaattctcctgcctcagcctcccgagtagccgggattacaggctcctgccaccacacctggctattttttgtatttttagtagaggtggggttttgtcgtgttggccaggctgttcgcgaattcctgacctcaagtgaaccacccacccctctgcctcccaaagtgctgggattacaggcgtgaggcaccgcacccggcccccattccttctctcctgttccaccccatttattgtgaggcttctggtcttgaagtcacttcatggcccaagatggagttctggctgtcgtgtgcgtatttcaggaggggaactggtaggaagcagggcaaagggttccctttgacgagtatttcaggaagtcccacacagcatgtcagtttacttctccttggccagactaagtcatgtagctgtacctgcatagttgcaagcataaaactggggttatgtcagtaaggaaagagaggcgagtggatatccaggaggcagcttgccctgtttgttgcagtaaggagccacgggaagcctgggaagcaggttgacttgatgatgaatattccatgaagttgccaaagtctcacttagcgacatttacttagttatctacacaccaatttaccatctcacgtagggagacaattattagattgttaaggaacaaaggtaaaaataagattaaaagagagaagggagtagaaggaaaccatacaatctgggaacagtgaatcttgctgccagaaacctacgagctagcctgttcattcagtgcttgtgcaggctagctaggagtatcagaaacattttggctctttatggattttccagaacaccttgagtatttagcagtggagcacaggctgcaggctaccttgatgtgatgcctgccaggatcctcccatcagcaccacccgtttagttaggccaggcctgtaccatttcctgcatctctatttctcagtgttacagggtggatagggtcttaggatacccactgcggcagagggagaagaaagcagggtccgcatacagtgtctactccatttgggtttggtgtctcagggcggaaggggcctttgcatttacccccatttctctgtgtgctttgctgggcacaccagcggcactggctctgtgggagctgcttgagctcacctctgctggcctcttccgaggcttgggaggcagaagagggcagagtcctatcagagtcgccaggatggggtctggctggccaccctcagcggaaccagtgatcagctcttttctttatccccaggaagtctctcagtgctctggccttctcccctgatgggaagtacatagtgacaggggaggtgagtcgtgatcgtgactgagtgggagtcgggggctggggggtcttggaagccattccttctgctcccggcaggcctgggagtccctggaatagctccttcctgggccagaacagccctgtagcagatgggggaggtggcttttgggcacatcctgtggcaatgccatcttcggccttgacaaccctctagccctgcccagtacagagcccagcagcagtaacgaccccaccttccctagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaaggtaagagccgaccagcaggcctgtggcaggcagccagctgccacagcatcctatgtcttgggcacagggagagctacatgagaggacgcagtaaagtgctcactcacccaacagataacagctattgagcacctgtgacatgctgatcccttattgtagggcacaaggcaggctcccagctagaagcattatacatatttttatattgaccagctgtgaccttaggcaagtgacttaacatctctgtgagtctgtttcctcctctgttagatggatatagtagtacttatcttgttgagttgtgagactttaatgagttgataagcactggaaggctgggctttggaacagctgtggagctggcagaagtgggtaccaagtcctggctctgcccataacccactatgtgaccttgagcacatgacatctccccctctgagcctggtagggttggggagaagcgcctccctcgtggggcttttgagggattgaggaaatttcatgggttatcctgtgaagggctcagggcagggcccagagcaggagccccatctgtgacagccataggttgtgttgtccttacatcccagccgtgactgtccccaataccatgtgtgggctgcagagcttagacccttggagagagctctggaacatactgtcccatggggaccattccaagcctctgtcccttcctctgtcggtgaggaatgagcagggtgccccacataggtttccccatacagcagctccctggagggtcccaggaagacagacttggagtggggacgagcagggagttccagcctgagggcaaaggcacaaacagtccagtggaatgagtgctggcatgagcttctctgcacttattcttccagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgagtttctgtccctgcccctttagccaggccctgagggagtcaccatcggtggcagcatggtctcctgtttctccctgagatttgagggcagcggtctcgggccatttggcctctcaggggcccagctgctgcttctgggcctactctcagggtgctgatgcacaggccctgccaggaaccccctgaccctgggaccagctctcattcttggactgctgctgtccagcccctctgtccagagtggcagggttctagtgttttcttcccttctccatttggaagagcttcttagagttctcctgttttgttgtgtcctatcatctggtcatgcagggcccagctgtgtggacaagtatctcactacgccctctgtgtctccaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtaccacctccctctctgccatcagctggacagactctttctcgtgatatgtgtctgcaggggtgctcatcagcattgaccacacaggttctgcttatgtgactagtggtgaatgacgcccactctctgagcttaaggttccacatctgtaaaatgggagtactgctgccctccccgcagagctgataaggaagtcacgtgagataacataggcaaggcagtgagcacggtgcttggtaccctgaaatgggctcaaggtgacagttgttttcccatgactatttgatctacttcacatttcttttctcctttgagcactctggctggtagaggattgcatttttttttaattaatttatttttttttattgatcattcttgggtgtttctcccagagggggtttggcagggtcttaggacaatagtggagggaaggtcagcagacaaacaagtgaacaaaggtctctggttttcctaggcagaggaccctgcgggcttccgcagtgtttgtgtccctgggtacttgagattagggagtggtgatgactcttaacgagtctgctgccttcaagcatctgtttaacaaagcacatcttgcaccgcccttaatgcatttaaccctgaatggacacagcacatgtttcagagagcacagggttgggggtaaggtcatagatcaacagcatcccaaggcagaagaatttttcttagtacagaacaaaatgaagtctcccatgtctacttctttctacacagacacagcaacaatctgatttctctatcttttccccacctttcccccttttctattccacaaaaccgccatcgtcatcatggcccgttctcaatgagctgttgggtacacctcccagacggggtggtggccgggcagaggggctcctcacttcccagaaggggcggccgggcagaggcaccccccatctcccggacggggcggcggcagggcggaggcggacccccacctccctccctgacgggccggctggctgggcaggggctgacccccacctccctcctggacggggcggctggccgggcgggggctaaccccccacctccctcccggacggagcggctggccgggcgggggctgactccccccacctccctcccggactgggcggctggccgggcgggggctgacccccacctccctccgggacggggcggctgctgggcggagacgctcctcacttcccagacggggcagctgccgggcggaggggctcctcacttctcagacggggcggctgccgggcggaggggctcctcacttctcagatgggacggccaggcagagacgctcctcacctcccagacagggtcgcggccgggtagaggcgctcctcacatcccagacggggtggcggggcagaggcgctccccgcatctcagacgatgggcggccgggcagagacgctcctcactttctagacggaatggcagccgggaagaggcgctcctcacttcccagattgggcagccgagcagaggggctcctcacatcccagacgatgggcggccaggcagagacgctcctcacttcccagacggggtggcggccgggcagaggctgcaatctcggcactttgggaggccaaggcaggcggctgggaggtggaggttgtagctagccaagatcgcgccactgcactccagcctgggaaacattgagcactgagtaaacgagactccgtctgcaatcccggcacctcgggaggccgaggctggcggaccactcgcggttaggagctggagaccagcccggccaacacagcgaaaccctgtgtttggtggagaccaaaaaaatacgaaaaccagtcaggcgtggcggcgcgcgcctgcaatcgcaggcactcggcaggctgaggcaggagaatcaggcagggaggttgcagtgagccgagagggcagcagtacagtccagctttggctcggcatcagagggagaccgtggaaagagagggagagggagaccgtggggagagggagagggagaccgtggggagaaggagagggagaggaggattgcattttttaaaaattggaggtaccattgatttaataacttttcagtcaaaaaagactacacaaaatacataaacttttatttatttttatttatttttactttttttttttttttgagatggcgtctcacttgttgccaaggctggagtgcagtggcgcaatctcagctcactacaagttccacctcccaggttcaagcaattctcctgcctcagcctcccaagtagctgggattacaggtgcctgccaccacgcacagctaatttttgtatttttagtagagacagggttttaccatgttggcctggctggtctcgaactcctgacctttagtgatccatccgtcttggcctcccactgcgcccggccataaacttttaaactaaagcatgatctatcgatacattgcagagcttctttcctttagtatctgaaggtttgagtcaaagctgttttcccatctggaatcagttgcccatttggctatccgcccgagcgttgtggtttcctctcctgttcctggcctgcctttgtgactcactctggagatcaccttcgaggttaatggcttgtggaagagttccaagttttatctctgtcctagttggttaaacatcattttctctttttcaagcaagtgaaaagctttcaatagatagatgtttatttcctaagcactaaatgactcataaattaagtccctgtagatttggaaaaactccttaaactgtatctagaggtctagcacttcctagtaggatagacagtcctttctagatactgtaacttttttctgtaccgctttggagtacagtctttatgaagttgtttgtaagcaaaagggaataaaatttaagcctaaaggctgggcgcgatggctcacatctgtaatcccaatgctttgggaggccaaggcaggtggatcacctgaggtcaggagttcaagaccagcctgaccaacatggtgaaaccccatctcaaaatacaaaaaattatctgggtgtggtggcggccgcctataatcccagctactctggaggccgaggcaggagaatcacttgaacccaggaggtggaagttgcagtgagccgagattgtgccattgcactccagcctgggcgcaacaaaaaactctatctcaaaaaaaaaaaaaaatttaagcctaaaattcaaccctgttactacaagtgacttacctgaagttgcagtctgctgaacaggtattttccatacacagctacgtttctctgtagacagcagtgacaattctgtttccgttcatgcctctgcctacctgctggcacatgtctttcaatagcagcagtatgctatatcctgatttcacaaatcttaaaatatgctaaaatgggtgtcttagacccaaggaactgtaagtcttctctggaggcctaaggctgctctgtcagtccccatatccccgggccaggccacgtgaagcaccaaatccactggggtcccttttgcccctacaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccaggtactgccctgtggggagagggaatgggaggggcccacccagagtctgtccactggcattcatccatgcttccagatccatctatctgtctgtccatcccacaaatacccatcatgactctcagccctgggcattacaaagcagaaaagtccttgccttccgaggcaagcctcacagtgagaagtgaggctgggtagggggaagaaacagtgagaaaacaaaggaataatatcatttcagatagcggtcagcatggtgaagaacagtgcagagcaggtgtgaatgtggcggagtgtttccatccacatggctgacccctactaagtggctgctaagtgccagccctgggctggaagcaggacatgcctattataatgaagcagcaaaatctctgcctctctgcagtatagcaagggggctcgatgataagcaagtacacgaaaaagataatttcaataggcatgagtgctttggggaacacagcagggactcgggaaggagagtgactggggtgggctgtgctgattgggtgcctggtgagaaggagctgctgtgtggagagctgggtcccagcagttgaggtgacagcacactgggcttgttacgttgcaggaatagtaagggactgtgtggccagagcccagtgtgtccggggaggatggtgggagatgaggccagtgtggggcgcctgtagtctatcctcaggtcagtgggcagttgctggggtttcgggcgttggggtaaatgaccaggccttacatgttaggtccctcagctgctgtgtcgagagtggatagaagcactaggctgtggctttcttctcctttgttgcaagtctgttttatggaattgggggctacctaaccagggggtgccaggtgcctagggctgcctctttgtggatttctggatgctagctcctgggtgccttttccacgacagggcctgaacaggggaactgggtgtcatgaaggaaaggagggggcgagcaacccacaggcagtgttgtgttgtagtagtcgggctcacagctctgctgtcttctgttgtgctctgtgaccttgggaaggtgactatacctccctgtgcttccgttttctcatgtgtaaaatacagtacctagctcttattgtggttgtgagaatttattgcaggtaaaactctcggcctggcacagtgtaaatgctcagtaaactgtagccttcatagggagaccccaggccaagggacagctccccagcctccttaggacacagaggctttttgatcatgcgttggtgaggccaagaagaggtgggacctgagatacatgcctattatctttctatgctcagagagagagcaggagcttgggttgggtgaaatgatgggcgataaatgttcataggaatcaaaaactcaattgctctcggggccaggcaaaaatttccggtttgtagcctctatatgaaaagcaaagcagaggaagagggaagagggaaaagtagaattggagcaggagagatggatggccacaaataccatgagggatggcattgccggggaggcatctccactgtcactagaggtggctgtcactactcagtgacattgatggtgattgattacccatgtggccttgttagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgagccccccccccacccccttgcccctgcttggcctctgcacagttccccacagtttgggaacccattcagtaattccttcagaagatactcattgactccctcctatgcatcaggccctgtcctaggtgctgaggacacagacacaaaatccctgcccttaacaagctcacatttggatgggaaaggaaacctggaaacatcatcagtgaataacacgccaagcagcagtaaccctctgaagaaaaatgaggcggggaaggggaaggggaatgcaggtggtattctagagaggagaggggtcagggaaggcctccctgaggacatatgagcagagacctgcaggaaatcggggagtgagacctgcaactgctggggagaaccacaagcacagaggccctgcggcaggaacatgcactccacagagagctttgctgtggaggtcgtttatgtatttcactgctttttttaaaaaggagttgaagacggggcatggtggctcacacctgtaatcccaacactttgggaatctgaggcgggaggatcacttgagtccaggagtttgagaccagcctgggcaacacaagaccctgtctctacaaataatttttaaaaattagccaggcatggtagcacacacgtgtggtcccagctactcaagaggtggaggcaggaagatcacttgagcctgggatgtcaaggctgcagtgagctgtgattgtgccaccacactcccacactccagcctgggtaacagtgagaccatgtctaggaaaaaaaaaaaagttttgaagtttttattttctgagaatgaatttgtgggtttttaaaaattctctaaagttaaccaggcacagtggctcatgcctgtagtcccagcactttgggaaatcgaagtgggcagattgcttgagtccaggggttcgagatcagcctgggcaacatgaggaaaccccggctttacaaaaaatacataaaaattagccaggcgcgcctatagttgcagctactcggcaggggctgcggcaggggggctgaaaatttcttactgggaatgtttgtcctagagaaattgggttttcagtggccagattcaggatcgtgagaaagaactttgtccttttgaataggcagcattcagcctatgactctggttgaatctgtctgccttcatggggctgacgtttttgttgacagcactttttttccactcaaagaatgttttttaataacttttaaaattcctgtatgaaatttttaaaaatttgggataataggtgaaatattacagataaggctacagtccacattgatgacttccctgcccccagttctgctctctctcgccctcaccattatcaattttattatgggtgtcttcagttgattttctttgcatctccttattgtttatgtatatagctgttcaacaacagtatctgtggatagatcttttcatcagttctagaaaattctcagccaatactgcttctaccctcttctctctctttttttttttcagacggagtttcactcttgttgcccaggctggagtgcaatggtgtgatctcggttcactgcatcctccgcctcccgggttcaagtgattctcctgcctcggcctctcaggtagctgggattccaggcatgcgccaccacgccttgctaattttgtatttttagtagagacggggtttctccttgttggtcaggctggtcttgaactcccgacctcaggtgatccgcctgccttggcctcccaaagtgctgggattacaggcatgagccaccatgcccggcctattcgctctcttctaaggttctatctaactctaaggttctatctgtattcttcatgtttctgaaaataaaaatcacacaaaagatatgtagagtttatcaattattgttagcagctttttttcccccccaagacggaatctggctgtgttgcccagtctggagtgcaatggcacaatctaagctcactgcaacctccagctcctgcgttcaaacaattctcctgcctcagcctcccgagtagctgggattacaggcagccgccaccacgcctggctaatttttgtgtttttagtagagatggggtttaaccatgttggccaggctagtttcaaacccctgacctcaagtgatctgcctgcctcggcctcccaaagtgctgggattacaggcgtgagccactgtgcctggcctgttagcagctattgatgctcagttcctggacccttttatttattgagggttgcaatatggtgatattctaaatctataatttatttttattagttggactacttacgtgaagagatatttgctctcatctgccatttggtcacccagtgctatacttcatataggaaaggcaggagaaatacttgattctttccctttatttaccagttttcaagataatgaattggttccctatcctctaaaggtaactagttttatttaatatcattataaactcatatatatttaaatatatcagatatgttttaatctattgtaattattaactttattggagctcatatcatcccatctttggccagtgagagcctcttaacattggctcctgagccctttggacatgaccctagtatttcttgatagccaccttgctgcctgggatgccaatatgttccagtctcatcttgtacatttcctgtcacacatcaggaatcaaccatttctcgaaaagaccatgtttttttttttgggctgggtgcagtggctcatgcctgtaatcccagcactttggaaggctggggcaggggaattacccgagcccacgagtttgagaccaacctggccaacatggtgaaaccttgtctccactaaaatacaaaaaattagccgggcatggtggcaggcgcctgtagtcctagctacttgggaggctgaggcatgagaattgcttgaacccgggaggcagaggttgcagtaagccaagatcaagccactgcactccaatctgggtgacagagggagatcctatctcaaaaaaaaaaaaaagaaaaaagagaaagagaaggccagggtttttttttagtacaaattgggacttcagaatcacaggttgggtgttagggatgctcatcgctattgggtcgttcttccagaagcctagttcttaaggacacaggggatggtggaattagaatatccccagtaactcatttgctttttcccacattatacatgcaacagtctgagaatggacaacttttcaattctgaagatagttaaaacaattgtaatgcatatgttctctctgttctctccaatttttaaaatagttatactatatttacaggatctgaatatgtagccattatatactatagtgtctcccttttgacccctgtttattttggaatggggaattatatatgtgtgtatatatgtatgtgtgtgtgtgtatatatatatataaaatgataaaatatacatgacatcaagttcaccatttcaactattttaaattgtaccatttggtggcatttagtacacttacagtgtcatgcagccatcattactctctagtttcagaacattttcatcacccacccaccccaaaaaatcctgtatctgttaagcagtcctccccattccccactccccccatccatggaaatgactaatctgcttctgtctttatggatttgcctgttctgaatcttttcttttctctccttctttccttccttccttccttcctttttttttttttttttttgagatggagtctcactctgtcgcccaggctggagtgatgcagtggcacgatctcggctcactgcaagctccgcctcccgggttcacgccattcttcttcctcagcgtcctgagcagctgagactacaggcacacgccaccacacccagctaattttttgtatttttagtagagacgaggtttcaccatgttagccaggatggtctcgatctcctgacctcgtgatccgcccacctcagcctcccaaagtggtgggattacaggcatgagccaccatgccaggctgtttcctttcttttcctctttctttcttttttttttggatggagtctcgctttgtcacccagactggaatacagaggcacaatctcggctcactgcaacctccacctcccgagttaagctattcccatgcttcagtctctagagtagctgggattacaggcacatgccaccatgcctgatgaattttttgtattttagtagagacagggtttcaccatgttgcccaggctggtttcaaactcctgagctcaggtgatctgcccgcctcagcctcccaaagtgctaggattacaggcgtgagccaccatgcctgacctgaatattccttataagtgaaatcatagactatgtgggcttttgtgcctggctttcacttagcataatgttttcaagatttatccatgttgtagcatgtgtcagcacttcatgcctttttatggtggaataatatttcattgtacggatagaacacattttgttctctgttatcagttgacggccacttgggtttttttctaccttatggctgttgcgaataccactgctatgaacatgtaagtacaagtttttttgtttttttttttttgaaacggagtctcactctgtcgcccaggctggggtgcagtggtatgatctccgctcactgcaacctcaggctcccaggttcaagcgattcttctgcctcagactcctgagtagctgggattacaggcacgcaccaccatgcctggctaatttttgtttttttagtggagacacggtttcgccgtgttggccaggttggtctcaaactcctcgcctcaagtgatttgcccacctcggcctcccaaagtgcagggattacaggcgtgagccactgtgcctgacgtagttctttctttcagttacatcactttgtttctgagtttttgtaggttgtttttcataccttggatcattttttaaatatcttttaccttcttttgaaacagtaggcccagcgtggtggctcacgtcggtaatcccaacactttgggaggccgaggcaggtggatcacctgaggtcaggagtttgagaccagcctggccaacatggcaaaaccctgtctctgctaaaaatacaaaaaattagctggccgtggtggcgggcgcctgtaatcccagctacttggggggctgaggcaggagaattgcttgaacccgggaggcagaggttgcagtgagccaagatcgtgccattgcactccagcctgggcgacagggcgagactctgtcaaaaaaaaaaaaaaaaacaaagtaagttatagtttttatctttttttgtgaaaatatgtttctgctgtgcttttttttttttttcttttttaagagtaactattggatttgaccttggtcctttcctgttgttcatttttatgtgataccagtttttctgaaattttagaagttggtgtgcttcaggacagattttccaactacacaagaagaactctgtcttttcttttttttgtgggggtggggtggcatgttttgttttgtttttgaaaaggagtctcactgttacctaggctggagtgcagtggcatgatcacagctcactgaagcctcaacctcataggcacaagcagttctcctgcctcagcctcccgagtagctgggaccacaggcatgcactaccatgcccagctaattttttatttttggtagagatgggatctcattatactgcccaggcttgtttcaaacttgggctcaagcagtcctcctgcctcagcctcccaaagtgctgggattgcaggcttctgttatttttatactgtgttaaaatatggcagcctgctttctgatacttcctttttgtggtcctctttatctgttatgtctcttctttcgtctcaatctcctctttactttatttcttctgtccctgttgtgattggtcaatttcatttctactcttagcagtttctcttcagtgtggagctttgtcctggaaggacaaagttcacaggatcttctccagtccctttaggccttaccccttgcactcaactgctgttggggtggatgaaaccctcctactttcagctgctgttcagtttggcccagtgtgctttccaatgaacacctcttggctactttggaattatcctgttgctgggtctgtcagatgccttattacttctctgtctcccacatgcatgctgatgatatgtaggtcttgtgattggtggtggtttgtcccactcacttgtattttggggtttatgggagtattttgtcactgagttttgctataaatgttgtctgtaggtttgggttttgctatctggttgatgtttttcttatgtcgagattttgggagattaaaaaaattaatgccgctactatcatcttcccagttctcaatcttccgtattttgaaatctctttatatggtggctctttgtccttctcagcttcattctaaatatctttagttttgtctttcagttcacttaattttctcctcagttatatctaatctttggtttttaatgtttttatttttttattattttttttttgagacggagtctccctctgccgcccaggctggagtgcagtggcgtgatctcggctcactgcaagctccgcctcccaggttcacgccattctcctgcctcagcctcctgagtagctgggactacaggtgcctgccaccacgcccggctaattttttgtattttttttttttagtagagacggggtttcaccgtgttagtcaagatggtctcgatctcctgacctcgtgatcctcccgcctcggcctcccgaagtgctgggattacaggcgggagccaccatgcccggcctattttttatttttttatttttatttttttgagatggagtttcgctcttgttacccagactggagtgcaatggcgcgatcttggctcactgcaacctccgcctcccaggttcaagcaattctgctgcctcagcctcccaggttcaagcaattctgctgcctcagcctcccgagtagctgggattacaggtgtgcaccaccacgcccagctaattgtgtatttttagtagagacggggtttctccatgttgaggctggtctcaaactcctgacctcaggtgatccgcccacctcagcctcccaaagtgctgagattacaggcatgagccaccgcgcccggccaatatgtttttattattcatttctagaagctgttctgttttggtctttttcagccctgcttggttaatctttataatttctggttggctgcacacttttaatcttgtcaaaattatcttttagttcttcaaacatattgaatgtagttattttatattctgtctgataattccaatttgggtttttttattttgtttttggtttgtctgtctgtttgttttgagacacagtctcatatgttggccagagtagacttgaactgctggtctctagcagtcctcctgcctcagcctcccaagtagctgggactacaggcatgcgccacctcccctgatttaataattccagtatttaaagtcttgctagactctgttgcttctgctgcttcttgctgatggtacctcgttttcttttgtgcttagtcatgtttgattgagttccacatttcccttggaagtttatttgagggtatgtgttaaggcctaggctgaaggtgggacatggatgatatatggtagcattttgtgtcctttttttttcttgtttatttttagcatagaaggtattgcacgatacctgtttatctttaacttactttttttttttccatgaaaatgcaacagtaagtcatagtgctgtcattgagtcatcctttgccttgtcctctgggaactgtaggtgtatcctgagtttgaagaccagagagcttgtttgccatcaggatcctttctgacttgttcttcagacaacaccattcgcttctggaacttggacagcagccctgattctcactggcagaaaaacatcttcagcaatgtgagtggcttcctttgtgaaccatctttcaggaggaacaaagacctactgtaagcttgaatgcaggggcaggagagagtctgatggaccctagatgttaggttccatgagggcaagagccggcaaccaaggcaggtccctctctgcatcactgcctcttgtttctctttctcctgccccctctctgaggtggcacgctctatcctctctgattctttgccagttggctcctgctctgcagatgtgtggacgtggccactcccggcagcccaacacacccagcccaggtgaaattgcttcctaagtcttgagatggaattccctgggagagcacctgatgagccagcccattcagctgccacacagtgaggcctcacgggggtatgggcagaatgctggcgagagccatgatgggaggctgggaagaaaagtttgctgaggaaattttggttagtattgcaagcccagtgagagggcgtctctggggagctgagacctgagtcatgcattcatttattctgcagacacttattaacgtccatgccaggtgcttggctacatgctagggacacaacagtgactaagactcttctgtcctgtggcacacacaatctagtgagggccgacagtgaactgacagccgaccatgttaatgcacaatcacaagtgcgaaaagcactgtgaaggaaaatgtgcagggtgctagtaggacatagagcagcagcatgtgaacttatctgggacatccggagcagcttcccgcggaagggacagctaagttgagattgggaagagtaaagagggaaggggagagggtctatacttagggaatagcctgtatgaaggccctggggtgggaaacagctgggtgaattggaaaacctgaaagaggccagtgtgattggaactaaaaagaccctccatgcaggaggctgtagcaggtgccctgcaggtgcacctttattactcccctcattccctacccagtgctaccatcgtctcctctgtacctgtgacatacatgctgtttttggctgcacacaatagaaaaactcaaaacaagaggtaaaagttaggtttctgactcatgaaagtagtctgaaggtaaccagtttagaccgttctgcaggaagcccttagggatccaagggccttccagctctctactctgtcatttgagggagcaggctatgtcctcatgacccagtgtggctatgggggctcctgctatcatatctgagttccaggctgcaggatggagaaaagacagcagaagaatacgtgcttgctttatatttaatagttcagaatttattcacatattcttatctagctgcaggggaggcaaggaaataattattctgattggtgaaactcccagctcaaaattagagttgtattactaacgaagaagagactggctatggagggacacgatttcagaggtgcttctgagctgctcgtgctgacctcagccctgtccttcctgcagaccctgctgaaggtcgtgtacgtggagaatgacatccagcacctgcaggacatgtcacacttcccagaccgggggagcgagaatgggacacccatggacgtgaaagccggggtgcgggtcatgcaggtcagtcctgacggccagcatttggcttcaggcgaccgaagtggaaatctgaggcaagtgggccctggcagtgtccagtgtacacctcccagctccagctcaggttctcagggcagtgggcagaagccctggccttggcacctcctgctgcccattgggaatgaggggctgtgaatagtaatcccatgaacagctcccattgggaacttaagctcgtaagaggcttccagaagggctgagagcagagtaactaccaggacctcagcagctagggtgtgcagattttgcctatagagtgtacaggcaagctcacatgactctagggcagcgtgacactttcaccagccacatggtaccagtgctgaactgtcaccgaagatgccagctggaggagggtcctggtggctctgggagaggggctatgagggtgggatagctgagagttcaggctgcttatgtgccctgttgaggtttggcaggatgttaccaacccagtaggtgctagtgggacataggccctgttgctgggaccaggtttaagatgacaaatgacagctgtgaccacctgggtattggagccactggggaatggaggagagttgggggaaactagaggggacataaaggggcagcagccaccaggcagccccaggagagtaggctacaagttttcaaactttcctgttgtcaagaagagcagaaagtgccgatttttttctgtgaaattcgataatttttaaatattggcacctgttttgatatcagtcactgtatgagaccagctcagtgtgtcagtgagctgcttacattgacatggcactgtctggagtggcaaaacggtaccaagagccaacatggggatagtgctcttcccccttggtgggcgctggcctgagcactgtgttgactgatttaatcctctcactgacccctgatgtaagtgatgttattggcacaaggtgtctggagtaagatcacacgggtagaatgaagaagctgggatgactcgatgactgatttcatttggggagaatcaggaaggtctagatttgagactcttttaacaatgagagactggaatcaaatgttctcatccatagctcctatcctggactatgacctctggcccctagcccctggcccctgtcctaccccagggaccacctctgatgcagccctacgtaaacacctgcccccctagaagactgtcctagatccctggggctctgttctggcccaggcaccacaaggggctgctgcctgctgaggtgctccctggttcaacacggctccctttacgatggcaggtttctaaatgagaaaagtggttgtgcatgtctagagtatttggccatgataaggggttctcattgttggtggcctggccattctgacctattctagaagtggtagagcacatggggctggggtgtggggcttcagcgggcggtgtgtgtctcccaggatccacgagctgcacttcatggacgagctggtcaaggtggaggcccatgatgctgaggtgctgtgcctggagtactccaagccagagacgggtgagcccgcagcaggggtggaatgggggtcaggcagggaggcagcccccctggcagggccacagaaaggggtagttggtgtctggtgggactgtggatgacagctgggagttttgtgttcggtaagggcccctgtagctggaccctgagaccagagtggctgggacttcagaaagcaagacacccgcaggcaggactcagcttgacttgcccgctgctggtgccagcacccaagccaaaggggtggatgtatgaatgagtgaattgtgaatgagaagatagattgattgttaggcattattttcaaaaagtttgaagcctatagaaatattgggagaatattataatgaacaccccataggcttcacccaaattcctcaattttttttttgagatggagtcttgctgtcacccaggctagaggggagtggcaccatctctgctgactgcagcctccacctctctggttcaagtgattctcgtgcctcagtctcccatgtagctgggattacaggtgcctgctgccatgcctggccaatttttgtatttttagtagagatggggtttcaccatgttggccaggttggtctcaaactcctgacctcaggtgatccgcccgccttggcctcccaaagcgctgggattagggcatgagccaccacacctgacctttttttttttttttttttttttgagacaagagtctcactctgtcgccctggccggagggcaatgacgcgatctcagttcactgcaacttccgcctcccaggttgaagcgattcccctgcgttcaagcgattctcctgcctcagcctctcgagagtagctgggattacaggcacgcccccaccacacccggctaatttttgtatttttagtacagacggggtttcaccatgttagcctaggctgaaggctaggaccatagtagggtctccagacctcatggtcctcttcattaaaacaacagaaaattccttctgggccatcagatgagatcatgagataggagaagatttccaagtgaagatttcgtttgtttcaagacagagtcttgctctgtcacccagatgatatatggatgatatatggtagcattttgtgtcctttttcttgtttatttttagcatagaaggtattgcacgatgctggtctcaaactcctgacgtcaggtgatccacccgccttggcctcccaaaatgctgggattacaagcgtgaaccaccatgcccggctcctcaagatgttttctaggctgggcacggtggctcatgcctgtaatcccagcactttgggagttacagagttggtggagttatatcctgatgtgattttccccatgttcttctttcgttctctcatcccccatgctgtgtgccccaccaacttgtcttgaaacatatcttcactcggttcgcctctcctgatctcccctctgcctcaggtcatgttattaggcctcagacatagcaagtgaccagagtagggaaggctggtggcagatgggagtctggccacaggcagtcaataggacctgaacaaggcccaggtagccagacctcagagggtgagaggacactggttttggaagaggctgagaggttgccagggctttacccagcacagacccagcaggcaagagcgctgggctctgctggggcgtctgctgtggatgtccctggaggagcgtccatgcgcccatcgagactcatcctccctgagctggtggtgaggaggtgaaatgccagggtgtgggggctctgggaaagaccacacagagctaagggagtggcccttgccaggcttgggccaagttggctacagttgaagaaccaaagaccccttctccgaggactgggcagcttggtcacactgcccttctgggaggccagggcacccacgcagccttcaggaaccagtctcattctctcctctcacagggctgaccttgctggcctcagccagtcgggaccggctgatccatgtgctgaacgtggagaagaactacaacctggagcagacgctggatgaccactcctcctccatcaccgccatcaagttcgctggtgagcccctttcttcccgctccctgcgccttgctagctaccctgctaaaaaaggattcattctttcaactctcctgtaaaatatatatccaaacaagtgaatacagtatctgtgtacagtatacagaataatgactggggccgggtgtaatggctcacacctgtaatcccaacactttgggaggccaaggagggtggatcacctgaggtcaggagttcgggaccttcctagacaacatggtgaaaccccgtctctactaaaaatacaaaaatttgctgggcggggtgttgtttctgtaatcccagctactcaggaggccgaggtgggagaattgcttgaacctgggaggtggaggctgcactccagcctaggcaacagagtgagaccctgtctcaaaaaaaaaagaataatggccaggtaccatggctcacacctgtaatctcagcactttgggaggccaaggcaggtagatcatgaggtcaggagttcgagaccagtctggccaacatagtgaaaccccatctctactaaaaatacaaaaaaattagccaggcatggtggtgtgcacctgtaatcccagctactcgggaggctgaggcaggagaattgtgtgaacccgggaggcggaggttgcagtgagccaagattgcgccagtgactccactccagcttgggtgacaatgcgagactttgtctcaaaaaaaaaaaaaagaagaatataggccgggcgtggtggctcatgcttgtcatcccagcactttgggaggctgaggcaggcagatcacctgaagctaggagtttaagaccagcctggccaacatagtgaaaccccgtctctactaaaaattcaaaaaaagtaaccgggcatggtggtgcacacctgtaatcccagctacttgggaggctgaggcaggagaatagcttgaatccaggaggccaaggttgcagtgagccaaaattgtttcactgcactccagtctgggtaacaagagcaaaactccatctcaaaaaaaataaaaataaaaaataagctgggcgtggtggccgaagtgagtatccacagttcttaggagcaaggtttgaactaggacgttgttgatagcagagactgttctaattgctcatggtcgtaatattgttaaatacggtacttggattcaccacgtgcaggttaagaagcagaacattaccagaggcttgcaggccttctctgggtccctcccaggttacccttcctcccttatatggggctcactcccttctgtgagccaatgactcctccttgagcaacatctaatacttgtatgtcaggcctggaccctctcaaatgtcctgtcatgaaggagcatgtgtgatgtgcccagactcagagttttatatttgttctgtcatttcatcctcaccaaactgttattctgtaaagaaatgagacggccgggggcatctcacgccattgcactccagcctgggcaacaagagcgaaactctgtctcaaaaaaaaagaaatgagaataataaaagcaagaatgtttctaatgcttaccatgtggcagtccctgttccaagggcttcacatcactctccagagaaggaactgtcaccatgcccattgtacggaccggaagttgaggctcaaaggggaggcccaggttcagagcagtgtttaacagctttgaccttggcaccagagaatgcctgggttcagtcctgcccctgtcctctctgtgtgccttgggacaaggactctgtgaacctctgtgttcatgcttgtccagtgggatgggtggtgagcattcaggaagacccgctacatgcatggggcctggcccaaggctcatgtggatcttgcagttgatcctgatggcacgagcctcccagcctgtctccactggtcgctgctgcagtcctgcctctactccgctactcaagtcacctatctcaatcccagactggagagggtgtcccttctttgtccccagcctttgtttctctatatgcccttgctctgcagagcctgccttggccacagctccacctgtgccccctcacacgtacagctcataccttacagagtcccacccagacccagcacccacctcaccacctttaggaagccttgatcccagcacagttgattgatggctcttgcagtggagttccccagctagggtcccctgcccatgtggcccagccctgcctaacacacagcgtcctcctcccctaggcaacagagacatccagatgatcagctgtggggctgacaagagcatctactttcgcagtgcccagcaggtagggtggcatggcctccttgggggctggggtggggggttgtcggggcattctctgaaggtcctgccggccctgccagggttcggatggactacactttgtccgtacccaccacgtagcagagaaaaccaccttgtatgacatggacattgacatcacccagaagtacgtggccgtggcctgccaggaccgcaatgtgaggtaaggggtggccctggacccttagctggcctggtctgccttgtcctaggctgtctgctttcctccctctgttcctctggtccccaagaagctgggaaggaattgagggacccagcaggtgttccttcttggtttttttttgtttttgtttttgaggcagagtcttgctctgttgcccatgctagagtgcagtggcaccattttagctcactgcaacctccacctcctgggttcaagtgattctcctgcctcagcctcccaagtagctggaattacaggcgcctgccaccatgcctagctaattttttgtatttttagtagagacgaggtttcgccatgttggccaggctggtctcgaactcctgacctcaggtgatattgcccacctcagcctcccaaagtgctgggattacaggcgtgagccaccgtgcccggccaccagcaggtatttcttagaagctgggctctcccaagcctggcctccaggtcagcagagggctttcttctggctctccctagagccggtgtgggatgactaaggtgctgatgtggcacataaactccctcattcacccgtattccctgagcacctaactgggctggatggtgctgggatcatggcagtggccaggatagccccaggccctccttcatggagctcacagtccagtagaatggacacggccacctcacagccacagacagtgacagagtggtcagagatgggggagcccaggggccctgtggagacacctgaccccacctgcggatcaagcaggacttcctggaggaagagacaccttagcctggggaggatgtggaggagcgagccagggggaggcagagagtgagtgtgcagagggcaaagcagtgcaaagaggctctgcaccccttcccagttctttctcatgcggtgccaagcactgagcttgcagtgtgtgggggagatgaacattaactcagtggataccccaggacaacctcagcttgagatggggtttcagtttcagtctaggcatcagatggggacaagaggtagcagggggcttccaggggaggggaggacagcaagagccagagaatgaggtggtggggtaggcggggccctgttggccgcaacatgcccctacttccccagagtctacaacactgtgaacgggaagcagaagaagtgctacaagggctcccagggtgacgaagggtccttgctgaaggtgaggagttggagacccctgtctgtctgctgccctgatgggccacctattgtgacggcccacacctgagacctgtgcccttggtccttcctcagtgcaccgcgctgcccagcaccttctcaggcctggttaaacaaggatgcttgcgagagggtggggagggtgaccccagctgtgtttcctttatttacagagcccttccccaagtggggcgtctaagtgggttccattttgagtggcagcagggtatggtgggaagaatcagaggcatgaactcccctcctggtttgcccacaccagccacgggtcactcaggacaaggggggaccttctcagagcctctggtctaggacagttatgggttcaggttctgcctcaggctgactgtgtgaccttgggcaagcatcatctcttgaaatgcacacagacagcttgtctcatagacttgttctctggaggagttcagtttgcacatgttcagtgcttagcacagggcctggctactgttgttactgctgcggtggttgttaatttcttcacgtgtcgaatgggagcgggagctcctgccctgccagagtcccatgtgctgtgcatgcagcacgggggagggaggggcccaggcctcatcataaggaagaagcaggcagctggagtgacatgtgggtccctttcctggcaggtccatgtggacccctcaggcaccttcctggccaccagctgctctgacaaaagcatctcagtgattgacttttactcgggcgagtgcattgccaagatgtttggccattcaggtgggtgtgcctctctgcttgggatgcctccccacccgcccacaccctctgactccgaaggcaagtgcagcctctctgctttgtttgcagaaattattaccagcatgaagttcacctatgactgtcatcacttgatcacagtatctggagacaggtgggacatggacctttgggagagttgtggctcagataccatgagcactgcactcagcctgcctgtgtagagagcatttctaaactgcccagtttggattgtgggagtcttggtgtcacacccagccctgagttcaaataccagctctaagctgggcatgatggctcacgcctgtaaccccagcactttgggacgctgaggcgggtggatcacttgagctcaggagttcgagaccagcctgggcaacatagcaaaaccctatctctacaaaaaattagccgggtgtggtcatgtacacctctagtcccagctactcaggagggggaagatggcttgaacctggtaggtagaggttgcagggagcacagatcatgccagtgcattccagccttggtgacagagcaagaccccgtctcaaaaaaaaaacaaaacactaaaaaaacatatcccagctctgccatttattttcttgtcaccttgagcaggttatttcccctgagcctcagtttgctcccctgtaaaagacaccaccgtttacatttaccttaaaaatggtgtgatgaggccgggcgcagtggctcacgcctgtgatcccagcactttgggaggcctaggtggatggatcatctgaggtcaggagttcaagaccagcctggtcaacatggagaaactgtgtctctactaaaaatacaaaaattagctgtgcgtggtggcaggcgcctgtagtcccagctacttgggaggctgaggcatgagaatgacctgaacctgggaggtagaagttgcagtgagctgagatcgcgtcactgcaccctagcctgggtgacagagcaagactctctcaaaaaaaaaaaaaaaagaaaattgtatggtgagaaatgaatgagatgatatacatacattctttagcacatgggtggtactcaaggaagtcccttttgtcactccctttgatttaccccagttcttccccacagcccccttcctcaggtcttgaggcctccagaacaggccctggtttgctgggatgccccagacctgggcccagggtgtggatgtggcaagtccagcacccctgcactaagcggataggggtgtgttttccaggagcatctggagaatggggtccaggctgtggtgtgggtggcttcagggtcagccacggcagcggctcccatgcttactcttcctctgccttgtgtgtctctctttgacctccgcagctgcgtgttcatctggcacctgggcccggagatcaccaactgcatgaagcagcacttgctggagattgaccaccggcagcagcagcagcacacaaatgacaagaagcggagtggccaccccaggtcctggcagcccctgcctgtccaccagagggatgagtccctgccagggccccatggagtgatgctggggacacagtggtggccaagacagccctaggccctgcccttagcacactcacagctgagtaggggagacagactttgaatatgcagttacagtaatagatacaaaaaggttttgtggatttttttaattttcgtaaataatagagacagagtcttgctgtgttgcccaggcttgtcttgaactcctgggcccaagtgatcctcccaccttggcctcacaaagtgctgggatcacaggtgtgagccactgcacccggctatgagaagggtattaaagtggaaaagcaaagtgtttggcgagcctctcagcactgtgatgggggatgccccaagcggctgtgggaacagagcagtccctgaccggccagccaaggggaggggtgggtagacaggggatctgaggggagggctgcagtggggccacgtgtcctcttactcccacgtgaaagctgtagcttcacttacttctttgaatcttctaaatatatttctttcaagtctttatgtagcaaagccaattttatttgcagagaactcatgttctggtttttgatttgaggttttggtttgggtattgctcattttgagtgggaggttttttggttttcttctcttctgctgctgggtgtgtctgtttttgccattggctccatgtggctcccagggcaatgtggagaccaggccttgacatgggccactggtcctgaggtcctgaggtggtgttagagatatcttgcttttgaggctcccactccacccccaagctatgaaccagggccctggcttcagtgcctgcctcatgccaagggtgttttagtttcccgtactcgggaagagccaccatcattgctaccacctacaggaagcccagcacaggactgcagccccgctgtctgcttggctttctgtcccattgctgtggccctgagagtttgcattcgtttgtagcctggcctttgttaatctcatctattgtggtgatgtgtttctagtggggagacggcatcaagtgagagacttgccagcaccatcttgaccagcagccaagaatatgttcacatggagcttagcacagggcccagccctaggcaagtccccaccaccagcccatttgcctgtattctctccttaccatcctcattcctggctttaggcaggatacgtatgtgtccacacctagtgagattcactccctgagccctggagagcaaacagaggatgatctggaggaagagtgtgagccagaagagatgctgaagacaccatccaaagatagcttggatccaggttggaaaaggggccctattttgaactatgtcagtgtagggaatcattgctgggttttgcccatgaccttgtttacagggcctggcacatattaaaactcaggagtcgacagggtgcggtggctgatacctgtaatcccagcactttgggaggccgaggtgggtggatcacctgaggtcaggagttggagaccagcctgaccaatatggtgaaaccccgtctcaactaaaaatacaaaaattagccgggcgtggtggcgtgcaactatagtcctagctactagggaggctgagacaggaaaattgcttgaacctgggaggcagaggttgcagtgagctgagatcgcgccactgcactccagcctgggcaacagagcaagactccgtctcaaaaataataataataataataatataaataaaataaataaaattcagtaatcaggcttagcgtggtggctcacacctggaattttagcactttgggaggctgaaatgggagggtcacttgaggccaggaggtcgagaccagcctgggcaacatagcgagagcccatctatgcaaaaaaaaaattttttaaagaaattagccaggcatagtggcacacatctgtagtcccaactacatgggaggctgaggcaggaggatcacttgaggccaggagtttgagaccagcctggcacgtaccaagaccccgttcctacaaaaagaaaaaaattagccaggcctggtggtgcacacctatagtcccagctacctgaaaggctgaggcaggaagatcgcttgagcccaggaattccatgttataatgagctatgattgcaccactgcactccagcctgaataatagagtgagatcctgtctgtagaaaaagaaagaaactcaataatcatatcagtcaagactctttcagtataaaagcaaccaggcttaagtcaggaagaggattttttggtgcctgaaaattggagaggattagctttcagcatggctagatccagatagacagatgatgttaaaaggaagatttttttttgtatcttttggctctgcttttcttcatgttggctttgctgatggacagactgtccctttactaggggaaaagatacccccagcaactacaggcttataaaactccatagagaatagaacacctctttcctatagtagctcaagcagagtcttagggttgtgtggctcatgtttctggtatctgctgtacccacttctgagccagttgttgtagctgtccacatctcagcatgtgatcacttctgagggcagagactgtagtcagctccatccactcacaccacctgaccaggcatcaaagatgtgtttgaggccgggtgtggtagctcacgcctgtaatcccagcactcagggaggccgaggcgggtggatcacctgaggtcaggagttcgagaccagcctggccaacatggtgaaaccccatgtctgctaaaaatacaaaaattagctgggcgtgatggcgtgcgcctgtaatagcagctacttgggaagctgagacaggagaattgcttgaacctgggagacggaggttgcagtgagctgagactgcgccactgcactccagcctgggtgacaaagcaagactccgtctcaaaaaataaatgaacaagtaaaaataaattgaattatgttgcggatattgtccggaatctttttcctctgcaaagtctctcatctacctgtatgttggtgaatacaaagcagacgcctgcgaaattttaagttattcccctccaggtggccatttaggtttttcctgattgcacatcactgttaatgaggctatggagtggagaccactcctaagcctcctcgaaatgtgaggacttctccaggagagagtctgaggagtagcaccactggatcctggagttattttattttactttaaaaaagttgttttattattttatttcactatttttgttgcccaggctggagttcaatagcacaatcatagctcactgtagccttgacctcctgggctcaagcaattttccctccttagcctgtggagtagctgggaccacaggctcaagctcccacacccagctaaatatgtgtgtatcaggggatggtgtgtgtagagacaaggtctcactgtgttgcccaggctggtctcaaacccctggcctgaagtatcctcccacctcgacctctcaaagtggtgggattacaggcttgagccagtatgcctggcctttattttaaaagagaaccccggctgggcgcagtggctcacacctgtaatcccagcactttgggaggccgaggcgagcggatcacgagttcaggagatcgagaccatcctggctaacatggtgaaaccccgtctctactaaaaatacaaaaaaaaaaaattagccgggcatggtggcgggcacctgtagtcccagctacttgggaggctgaggcaggagaatggcatgaacccgggaggtggaggttgcagtgagccgagatcgcgccactgcactccagcctgggcaacagagcgagactccgtctcaaaaaaagaaaaaaaaagagaaccccaagagttctccaaacccagttactgccccaccctgcattgcattaggctctccattgtccccacacttttcctgccatcctttggtagtattaagctttttcacctcggtcagtctcgtgagtcaaatatcgcatcccacggtttaagtttgcatttccctaacccccggtgctgttgagccttctgacttctgggttgtggtgttgcctctttggggactgcccggttatgtatgtggcctgtttgttgggttgtttgtcctcttttcatggattctgtgtctttccagatcctcgttgcctgctaaccaacggcaagctgccactgtgggcaaagcggctggtaagtcttcagggagagggttgctcaggggctggcagaggaaacgcctccccagctctgccttctggaagccctttttcctttccatgtccctcttttccctggagaagccctgtcatccttccaggctcagtgagacagccctttgttcatgatcagtgctctctgccaggcattgttctggatgtcagggacacaacagtgagcaagggaaacaaaagtctctcccttcacaggctcacttgcctgtgtgggcgaggaacaatatccccattaaataagtaaatgacgtagtaggttgggtgctgataagtgctgtggagggaaaagaatcaagaaggaaaatacgtcagccaggtgcagtgatacgtgtctgtggtcccagctactcaggaggctgaagtgggaggatcacttgagcccaggaggttgaggctgtagggaactgagaaggcaccactactacactccagcgtgggcaacagagtgagatcctgtctcaaaaaagagaaaaagaacaggggcccagcacggtggttcatgcctgtgatcccagcactttgggaggccaaggcaggttgatcacttgagcccaggagttcaagaccagcctgagcaatatagtgagaccccatctctacaaaaaataaaaaaattagccaggcatggtggtgcatacctgtagtcccaggtactcaggaggctgaagtgggaggattgtttgggccagggaggtcgaggatgcagggagctgcactccacagcactccagcatgagcaacagagccaacactttgtctcataaaaaaaataaaaataaaaaagaaaataaggagtgttggggggtgtcagttttaagtaaacaggaaaggcctcattgggaaaatgatgtttgagcagagttgaagcaagtgagacaggcagatactgggacgaatgttctagtcataacagcctatacgtgtaaaagccacgaggccaggagctcgagaccagcttaggcaacataatgagactcccatctctacaaaagattaaaaatagccaggcatggtggtgcacacccatagtcccagctactcaggagcctgaggcaggaggatcacttcagcccaggagttggaggctgcagtgatcgtgctactgcactccagcttggatggcagaacgagaccttgtctcttaaaaaaaaaaaaagaaaaagagaccgggtgcggtggctcacgcctgtaatcccagcactttgggaggccaaggcgggtgtaatccaaggtcaagagatcaagatcatcccggtcaacatggtaaaaccccgtctctactaaaaatacaaaaattagctgggcatggtggtgcatgcctatagtcccaactactggtaaggctgaggcaggagaatcacttgaacccaggaggcagaggttacagtgaaccgaaatcatgccactgcactccagcctggcgacagagtgagactccctctcaaaaaaaaaaaaaaagaaagacaatgtggattataagagacagaataagagaggtgaatgaaggatgatcccaaggttggggcatgagtaactggaaaaaacaactgaaacagggaatctttaggaggagcaggtttgtgcagaggaaatgagttgagttgtcagcatgttaactttgaaatacctaccagacatccatacagaaatgtagagcagtcacatgtgcaattctgaagtttcagagaaaagttcatgaatcccagctgggcattcccagcactttgggaggccgaaacaggattccttgagcccaagggtttgagaccagcctgagcaacatagtgagagtccacctctaccaaaaaccaacaaaatgggctgggcgcagtggctcatgcctgtaatcccagtactttgggaagccgaggcgggcggatcacttgaggtcagcagtttgagaccagcctggccaacatggcaaaaccccatctctactaaaaatacaaaaattagccaggtgtggtggtgggcacctgtaatcccagctactctggaggctgagacaggagaattgcttgaaactgagaggtggaggttgcagtgagccaaggtcacgccactgcactccagcctgggagacagagcaagacttcgtctcaaaaaaaaaaaaaaaaaaaaaaacagagaaaggttcacgctggagatatgtacctggaagttgtttctgaatggtattgaaagccaagagtccagatgggctgtgtgaaatgtccgtgtcgctccctgcagtgagtgagcactcagccagttgcctgactgtccgatatccttcaagctaggggacgatgatgtggcagatggcttggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgaggtacacacttccaccgcagcctggcccatagccccggcaccgtgacggccccagggcctggcgccttaggctgactcccactccatgggggcagggaggattacatgagatggtgaagggcaggagggtgagccccaggtctgttgcacagcaagacttcccaaggcagacagggagtctttggaaagtgggtcacttgggggttaagagcttggatgctagagcaggcttgtacccaagtgggggacatttgggtagatcgagccctgaccctacccattcctgttgtgtgacctggagtaagaggcttacctctttgggcttcagtcttctaaaaagtagtcataatggggtcaggggcagtggctaacacctgtaatcccagcatttggggaggccaaggcaggaggattacttaacgatcacttgaggagttcaaggccagcctaggcaacgtagcaagatcccacctctacaaaaatattttttaaatttttttgtttgttttgtttttaaatggtaataacaatctcttctgccccagagggcttttacaggaatccatgcttaagtatagggcctgggctcttagaggtgcccgtgcaactttagctctttctctactattttccaaacaaaattcatttttatcctatcctataatttgtcatcttcattgtggtataatatacatccagtaacatgcacagattttaggtatacagcttgatgaactatctgtgtaattcacgtgtgtccactaccctgggcaaaatctggagtgttttctacctcatagaaacccccttctgcccttcccagtcaggtccccgcaccaggataaccagtgttctgacctctcaccaaggactgggtttcctattcttgaacttgatataaatagacacgtagagggttgggcctcctatttttggtgccacacctcttcctcatctgtaaagggactgataatgcaggggcagaccaggacaagctggttgcgagtggagggcatggcacaggccctggttcacagcctccagcagtggggctgctggcatggttcctggcgcactgttggtggccccagccatgcctgcctcagaatggctgtgctgtcttccccatagtcagagagtccccaggaagctggccgcgggcacccctccttcctgccccagcagaaggaatcatctgaggccagtgagctcatcctctactctctggaggcagaagtgacagtcacagggacagacaggtgggtgtcctttccaccaagggagccttagttggaggaacccccagctgatagctgcatcctggaagaagtgctctctgccttcccagtgggcttgtgggagtggggacagttgaggcctggatggggcaggagcccagccttagttccctggttccaggtggggtacaggagggcctgacctgggggaaggagggggcatttggaggaggcggggaggctgtcgcagtgctcctgcaggagcagcgggtacaggtgcctaggggctccgggtggggctagctgttgagtctccagctgaagtccttgttccctctctgcccccactggcactgcagccagtattgcaggaaggaggtggaggccgggcctggagaccagcagggcgactcctacctcagggtgtcctccgacagcccaaaggaccagagcccgcctgagggtgagtgcagggcaggcagggaccctgtgacagtctgtgcgttcagccaagcccctttctgggcaccgatggtgactttgacccagtactgaagctcagagtctgtcgaggaagacacatgtggtccctgctgctgcctgaggattctgggcccagctgcctacagctgagagcccagctctgccacctccttgatgtggaacttcccttattcataaaatggggggcagctgctcttaccatccctcctccagatggggaaactgagcccagggaagggtagccctggccctggctcaccagaatggtcaggctgtgggctcctgaccccgactctgtccttcagactcgggggagtcagaggccgacctggagtgcagcttcgcagccatccactccccagctccgcctcctgaccctgcccctcggtttgccacgtcgctgccccatttcccaggtaagcaggggccagacacgcaggggactcgctgctcgggcctggcttagggccagtcacaatgtctaagcacaggccctgcacttggagcccactgagcctggaagacggggatccctgcttctcagcctgcgggcaacagggcagggatgggtggggcccgctttctccatttcaggtggcgtctgctgtgactcatggtgttggctcctcttgtccctcccctccttccctgtcaggatgcgcaggtcccacagaagatgagctgtccctgcccgagggacccagcgtccccagcagctccctaccccagactccggagcaggagaagttcctccgccaccactttgagacactgactgagtccccctgcagaggtagggccctgcctcacccacacctgccgaggccgtctgtgcagcctgggcacagcattggcgtccctggagttggctccccagcagggccaggagggtgagtggagagcaactgcttcgttttttttgagacggagtctcgctctgttgccaggctggagtgcggtggcccaatcttggctcactgcaacctccgactccctggttcaagcaattctcctgcctcagcctcctgagtagctgggattataggcatccacaaccacgccctgctaattttttgtatttttagtagagatgaggtttcaccatgttggccagactggtctcaaactcctgcctcagatgatctgcccgccttggcctcccaaagtgctgggattacaggcgtgagccaccgtgcccggcccactgcttcactcttgacctgagcctcacgatgcctcctcacccactgcccctgctcgtaccctgtgtctgtacataagggtttctggggagtgccccgctgggctgtgggctggcctagggccagggctgctcggcgggaagggttatgagggtcccctcgggatcttcccctagagctcttccccgcagctctgggagacgtggaggcctctgaagctgaagaccacttcttcaacccacgcctgagtatctccacgcagttcctctcaagcctccagaaggcatccaggtagaagctggccaagcactgcccaccctctggctcctcaacagtgccccagggcaggctgaatgagaatcatcccccctgctctcctccccacaggttcacccataccttccctccccgggcaacccagtgccttgtgaagtctccagaggtcaagctcatggaccgaggcggaagccagcccagagcaggtactggctacgcctccccagacaggacccacgtgagtattgggcccacctccgtcagggcacggggctgggaaccctgaggccttgtcctcacctcagagctgtgcctgcaggtcctcgctgcagggaaggctgaagagaccctggaggcctggcgcccaccacgtgagtgccccagtcccagacggacagtcctgggtttctcggcgagtggccggatgtccagcctagctgtggggcgtgggggccctagccatcagttctgtgtggtggagtcagtgccatctgcttccgttacagctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgagtacagccctggagcaaggactgtcccctaagctcatcctgtgtgctagttggctcagctccaaagatggatacttgacctggccacagggactgtgccattcattcattcgtgcattaacttaaatatttaatgagcattacatgttgggctttgtgctaaaccctgggacatgggacatggtggtaaacaacacagagaactgacagcttcaatggggacaatgcccagactaaacctttaaggaacccgtcatatgtatcacgaagtgacacatgcttaggagggacagaggagggcgagggagtgcagggtggggacaggggttgggattacaaaccagaagataagaagaggcttcagggaggaggctgcattggagcagagacctgtaggagtgaaggggagggagccttggggacccagagaagtgttccagacagaagtacagcatggagtccacccagtcgctctggccgctcacaccaatggaatgcagctcatcttgctcattcccttctctctaccccaggtgcacttggtctgttacagggcagccctgcccgctggagtgagccctgggtgccggttgaagccctgcccccatctccccttgagctgagcagggtggggaacatcttgcacaggctgcagaccaccttccaagaagccctcgacctttaccgtgtggtgagctaagccccagagttgggaaagggttgaggggtctcttgagaccgcccggccttggtggcccctgacaaggctggcatcccttgcagttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttgagg

SEQ ID NO: 390 - DNA, 256741 bp, Homo sapiens
agttctgtcactcactcggggtaactttgggcaaattctctctggacctcctaatagggaggtcctcgtcaccccgaggaagttcgaagacgtgggcagtgacttggaaagcttcccgagattccccttctataacctgggtggctcagaccgggagcggggtcccagccggccggtaattccgcccggaggtgcgcacgaaacaaacctgcagcgctggccgagggcggctcagcttcggagggcgcgactccgggtgagttcttaaagggaccgtcagagtttgggtaacacctgcgatgctgaccgggcggggacgcaggcttgagggaaatgaatgaatgaatgaatgagcgaatgaatgaacaaaccttctctgcccacccttaagtataccatactcggaattaatcagttaggcttaaaaatcttgtactataaccctcaaactcttgccaagttaaccagtgtctctatttcatatgtccttctgtaatgaaacccctccccccaagcctattactaagggacgaagagtaacttaacaatcagcctggagtggaaggcaatgcagagttggcacccctccccgaactcctccctctccctctcccaggccccgccctccccgccccctgggaggtgcagttggctcctccttaaggcggcttttccccggtggggatctacccccggggtcgccaggcgctgtctctgccgcggagttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtaaaggcgggctcctccagggccaccccgggccacctgtggagtccgagtgttaactcctttgttctcagagccacttcagcggccgcccttttaagcgaagaggttcccttaggatgctccccgggtaccccttccgttcccctgccctcccccgacccgcctcccccttccaacccgaaggtagcagcgcggggagcccggggctcggcgcgagccgcctcctcacttcccattggctgagagcgccgggaaagcggtcacgtgggagcgcggcaggccagctcgggggccgccatcttggcggaaagtttcgggggagagcggttgggggcgcggaaggaggcgaggttccgggggtggggcgtgcggcagcaactgggcgagcgggccggggggccgcggcgagcgaggaggcggcgcggccgagaaggaggacgaggccgcgggggtgcggcggcccaggggagctcctcccccgtcccttcgccccctccgctcggctccgcgggccccgggcggggcgggggtacgtggagcggggccgggctggggagctgctccgagtctggccggggcgcaccccagttccgagcgcacgccgctcaccggaactttgtggcggcgccgcaggtgtgggggcccgcggaggtgtgcatgcggggcgcgagggcgtcgcggagagcggccgctgccctgtccggcccccgctggagcagcccggaggcagcgagcaaggagaaaggcaagcgagaggagggggcccgagcagggcgggcggccagtcccgctggtcccctctcagcgctctgcggccgctgctggctcaggggccaagggtcggagcgcttcacccgcccgtacccagtagcaggtggggagtgtggatacttgtgcgggggaagaggcggcctcaggtctaggctctttggggaggggacgctttcgaggagagtttggaagccgacttctgtctgttcttaatttggaggggtacccactccaaggaaaagctttccacgttgacagacaactgctgcgttttgagactctttctttgacttggtaaaactttggaacgtggggttttcaaataggctgcgagggttttctatttcgataggggaaaatgctagtttaacatgattctatcctttttcctttccgttgtgtgttttaaaggtgtgtgccctcttcctgattctggagaaaaatgccggtccggaagcaaggtgagagtttattccgtaactctgttgtcgatgtcacttgcttttccgtgtgtcagttttttgattgccgttttagaatcgtttgtgtaactttgatgagacagcacggtcctagctttattgcttagggaatctaagcctcatatcatttcagaagatggaaacacgaaaatgtttgttaaactttcttaacatttctctagtgattaagagaggcagttagcccccccccaacagatgtccttaataaccctgaattggtgttttagtatttcactctatcattcttactaagcactattctgtaagcaactgtgggatactaagaatttgtattttgaaatgttaaaaatttggattatgatgacaaattgtagataatctgcttttgcattatcaggtaatctgaaactgttgctaatactttgatcttttactttggcaaactaccagtacacatttattccaaactgctcactctcctccgttttctaatgtgatatatgtttaaatttttcttgtatttctttaatttttttttttattttttggtcattctaaggaatatgtgtacatgaacatagtgacatcaattgacctgaaggatttgcggaactatttagatgtcatgcagaattatttgcactagtatgtgatactttttttgtaaatagagagttttaatcaggctctgctttttcttctcagatacccagagagcattgcaccttttggaggaatatcgttcaaaactaagccaaactgaagacagacagctcagaagttccatagaacgggttattaacatatttcagagcaacctctttcaggctttaataggtgggaattaaaacttcgtaactattatgccagctaggctttatgctcctctcaattcatttattttaaacttaagaaaatgatgtacttaattctctgaggcattcggtaacttgaacatcttcagtgagttgtgtgtttttcataggccagtgtcctttcttaaaataactagtaaccaaaaaactttcaggattatttcagtggcttttgagaacattgtttcacatcttaatagcattaactattaaaagatgttgcacagatgtttaaggacctaaaaggtatgactgagttactgtgagcttgtttctgtatttgactggcatgtctctgaagtcattgaaagcgtgtgaagggttctgctgtgttgaagaacattcattcccttaatgtagatttctgtttgagcttggcattcatggagtcagaattttagacctggaaaataatcttagagatgatcttgtctagtaaccgtattttacaggcaagaaaatggaaagttttattcttaattgtaacttaatttgaagtggtgcattgtttgaaagaactggaaaaataagagtcctgagttcttttgccactaattgaatgatatatcccaagtcatttaatcttttctatgccaccatattagctgtagaatgtagctgttgaaatgacagaatgggtttaaagccttttttaagtagataaatcatttttaaaagcatcatctcatattttgtgtataatctcctatgtataaaacaaggtgacttgtctggctcttttgtccaggtacctcaaaaagtttgcaaaccaccgaactagaaagtttgtctcttccaattctaagaatgaagttttttttttttgttttagttatcaactatataacattttaacataagaagacatatacttaattatattacatttatttcttcagtaacttccagtcagatatggccttacatctatctgttgatagaataattgttggtgtgatttgaagactactttcaagtcagtgtgtcctgtcaggtacattattgataaatggatgctctctacggttttagaatgaaagatttttgtaaagaccacttgatgcacctgaacaattttgaaaaatgtaacattttaatagacttttaaaaacataaggatacatagcacagtgtaatgaactgccttttaactgttacccagctccagaaattcacattttgccatttttgtttacattgatggacattttttacacatttgaatttctgaggtttaaggtccgaatggatgatcaaattggattcctctggaaaaacagcaaaaagcattttttagttatttgttttctaaatcaacattgagcctagtaatttggtgcagttactgttgcaaaaaaagtatgttttttcgcaacagtatagagatatatatatacatatatgtatagataggcagatagatagactgcagacttttctttgtgtgatggctgtaacttaagaaaattaaatcgttagtgaaataacagaatctacatttatatttctgtctagattggggatgggtttgctgtgttcagagacatttttgacctattctgccttgcctgttttgaatgtgtctattcttacgtacaattgaactttgatagagttagctttcttctctttttttttttttttttttttgaggcagagtctcactctgtcacccaggctggagtgcagtggcgagatctccgctcactgcaagctccgcctgccaggttcacgccattctcctgcctcagcctcctgagtagctgggaccaaaggtgcccaccaccacgtccggctaattttttattttttgtattgtatttttagtaaagacggggtttcactgtgtaagccaggatggtctcgatctcctgacctcgtgatccacccacctcggcctcccaaaatgttgggattacaggcgtgagccaccgcgtctggcctagagttagcttcctaattactaagtttatatttgtgaatcttctaatttcattggttgtgaatttactttgacatttaaatttacttatatttaatgttctataggatgtggtactatatcacattttggtgtaagacaagtaatagattttaggagttttgaaatagataacgtttaatagaggttctgtgtgtttccatgctataattgttgatactacggaataaatacattctcttgtgtttcctgaataacttttaatacttagtctgaaaatgtttagtctgataagattttctttgtattttgcaactctaccattgttttgaaacagtgtcataaatgtactttaagcttgtaaactgccctaagctaaaccagttcattgtgtccatagtgtttgcagaaaaatccgactcagaagacagagtgccacttactgaaaggttttttctctcagtaagtggcactctgtcttctgagttggtacctgtggaccactggattaaaggagaacaggggtcttggccacctgagctgtttggagtcattgagtgcttagatttttcacttccttaatttggaaatcacttgtttaggccgcagtgagttatctagttatctgtttggggtgccaagtgtctttggattttcagtctgcattgatcatttattgattgattctttgaactggtagtttatattgacttttcatgcatttaaaaaagtttgagtctctaggggtttggtgtccccccctgtagttgatacatagattaggttcctgtacttttggattattcagagggacaagcatgtacgtactgtattatatttgttctaaaataccaactgttaaatatttcaatatctggtatatgtcatttttaattgacagtgtttctgtgttctgacacatgaaatagtgcattttataattgatactcgcaatgtaatatagaaatcattggtctagtgctgatagatacttggtagtatctttgaaggatggcttaaagatttaaaaattattgaaagcagaaaagtttttactaattttgaatttcagctgatgtattgtttctttagagctaaatatttaaagttgtatcttaacaaaagtccatgaactgcacatttgtttaaaatttactcccaaaacatacctggtgattatttttgtataaaggaagataaagtctgcttaatttcactctgtgatttaggtgagagcaatttgaaaacttgcttttgtattccagttttttgtgcttaagtttgaaaattttttgagtagacgggatatggtttgattataatcagagcccaggtattcaggtccatagtggtttcagttcattcatgattctaaggtgtgtgggatctgagatgacactgctagtccatagagacttcataccagtctaaacccctgcagttatttcttacgggatcagagaactcatctgctttccttgtgcatgagaaaaactggggcccaagattaggctggctttagagacttgagtaagttgagtcatgtgatttgtatattttgtctgcaataaataagcttattctaatgcagtgttttatttctgcagagatttcagaatgaaagtggattatgtaataatactgtccatttatgagtttagttaccagttcatttgttgccactctattaaaatctaatagtttcactagcccttataaaaggacattaccctatctttatttgtagatactagtttcaaaagtatgacccctttgccatcttcaccatctttaaatgtacagttcaggagtgtgaaatgtattcatattgttgtgaaacaaatcttcagaacactttcgtcttgcaaaactgaaatcctataccgaataaacaactgctcccctttcctctcacttcccagccccttgtgaccaacgtgctgctttctgtttcagtgaatttgatcatgttagaaacctcatagaagtatttgtctttttgcgactggcttatttcactcagtgtagagtccgcaaggttcattcatgttgtagttgttgacaggattttcttcctttttcaggctgaataatattccgttgtatgtatataccgcattttatctagccatccattgatggacagttgggttgcttcctcctcctggctgttgtgaataatgctgttaggaatgtgagtgtgcaaatatttcttcaagaccctgctttcagttcttttggatatttacccagaaataggattgtgggatcatacggcagttacatttttaattttttgagggcccaccataatgttttccatagtgattgcagcattttacagtctcaccagcagcacacaggatttccagtttctccacatccttgccgatacttaatttttttcctttctttttttgataatagccatcctaataagtgtgagtatatgactcctcttcaagtgtatgtaaaacataataaccaacatttattgagcactttctatgtgctaatacaaatatatcatttagtcattgtaatcctgtgaggtgtacattcacctgtatgaggtgtttgtactgttttatagactggaaaactgaagcactgagaaatgaccaatcttgcccttggaccctcagatgctaaattgcggagccagaaattgaactcaactaatctgaatccatagatacttctcaccgtcaaccattgggatattctttatcgttgtttttcagaactgagtattttaatctgataaagaatactaaatgacaagcatgcttaagacagatagcaatctttagggttagtaatctttaaatgattgtcactttgaaggaaaatatttataatggtgcattatgtttatgatgatggaaatcacacattttgaaaacagtgtttagtaatcagggtttgagatcttccagctatagtggtaaaatgtcaaaatttcttaaatttcttttgcattatattagtcccactgatgttacattttagtctcttgctaactgtgtgtgtgtgtgtgtgtgtgtgtgtgtgtgtgtgtgtgtaactttgtaggctagatttgagtaaggaaaacaggatatggatcacatcgttggctgaaacttcctgaaatggagaattttagtaacttctcacttgatggttttgattcaattagattgagttctttgctcatagtttgcttactactgctctgaagcagtgttttgattatgttgaatctggctgaattctctttagaaccttggaatcagagttgtaaaggcatctaaatatttcttctaagccatttcctctctgcagggtcatatttttcctcagtgcagaatccagacttggaccagatattaccgttagttgtcacgtctctttacttagggcacatttccacagcttttctttgtcttgtgtgagactgacttttttttttttttttttttttttactatttggagacagggtcttgctctgccacccaggctggagtgcagtggtggcttactgcaacctctgcttcccaggctcaagcaatcctcctgcctcaggctcctgagtagctgggactacaggtgtgagcccccacgcctggctaactttttctagagacaggtgttgcccaggctggtctcgaactcctgagcaaagttctgggattacaggtgtgagccactgcgcccagctgagattgatgattttgaaaaacgcagttccttccactcttacttttttttaatataattttctcattttgggtttgtctgatgtttccttgtgattagattcaggttttgtattcctggcttaggattctgtacatccagaggtacacagagtcatctgctctttgttgatgatactgattttgattacctagttgggtgttgtctgaattctgtatcctatagtcattgttttttaccccttgtggcttataggcaatatgtgggggagacactttaacaccatgtacatatcctactccttagcaaaatttccacccatatttagcatccattgatgattcttgaaccggtttataatatggttgttgaaaagtaagatttctaacagtaacactcctaggtttaccagttaacactttgcattttattctaaacaagagccttccttctttttttcccgtgtctttcatgaacttgcagatacctgtttttttttcaatgacttatcatttattaccatccttaatgacatttgtgctctgagtgatccagtgggggccctttcaagcttgtgtccttatgagatgccctcatcattttttggagcactttcttaatttttggcataacaagatgttccaggtttatcttgtacctctcctgccccagccctggaatcagccatttctctgagaagctctggttccttttagtacacaccttgttttatggaatatgcttgtgagtcatgtatgattcttagtctaatagtatctaaagtattcaagtgatttatttttgcctactagcttgacatctttcctttctttagtgtgtgaaacaatagtacaaacttttaaattttataggatattctttcttctaggggtcaaaaatgactttttaaatgaacattggtttagaagaaagagtatttgtgcttgagtagatttgactattgtggtattatcttagtatgtcatctgcccttcactgatgatgttaattttgattactcaattgggtattgtctgaataatcatacttgcttttagtaaatgaactgatagaatttttttcctctgaaatggtagggttatatttcagtgttcttcagctttctagttgcctttcctgtaaccctccaaaataaatttattataaaaatgatgcatgttctatataaaacatttgagatcagattattatatgtaaaataccataagaaaatattcacaccagaggttacctcctacttcatccatgggatgaatatcctggaatgttatttgtgtgtgtgtgtgtgtgtgtgtgtgtatgcgcgtgtatacacgccaccccccaccttcattttgcaaaacaaacttctaagtaaaacagttatttcccttgtgagaattgatacttaaaatcagcatgtaaggtgaaaaacctcatctagttaaaattatccctgaaaagccttcagaaatttaacactagctcttgttaattacagcacaattgttttttttcctctagtggaaaggaatgatttcttcacttgagccctagacgaagcaactggcttgtttgacttcttgtactaaaaacacgtaattatagaatcacactcagcacagtgagatatagcaagaagctcacattttgagaggcacatgaaaactcagactacctaaaggaagaatcttcttccttctcatttttttatttgtgacagtcacttattgggtagacagagttgcccttttttgcaggggagatatactgcagttgtatttgtataagtgtgaatagtatgatttctctgtactatacatattgtttttatcttctaaagtttatcgacaaatgtctttccatgtcagtagatttctaccattttatgtatgtatgtatgtatgtatgtatgtatttttttttttttttttttttttttgagacagtttcactcttgttgcccaggctggagtgcaatggcttgatctcagctcaccacaacctccgcctcctaggttcaagcgattctcctgcctcagcctcctgaatagctgggattacaggcatgtgccaccacgcctggctaattttgtatttttaatacagacagggtttcttcatgttggtcaggttggtctcgaactcctgacctcaggtgatccgcccgcctcagcctctcgaagtgctgggattacatgcatgaaccactgtgcctggccagattcgtaccattttaagtgactgtgtatatagattttttttttccttttcttttcttttttttttttttttttttgagacggagtcttgatctgtcaccaggctggagtgtagtggtgcaatctcggctcactgctacctctgcctcctgggttcaagtgattctcctgcctcagcctcctgagtagctgggattacaggcgtgcgccaccacgcctagctagtttttgcatttttagtagagacagggtttcaccatgttggccaggatggtctcgatctcttgacctcctgatctgcctgcttcaggctcccaaagtgctgggattacaggtgtgagccactgcacccggcctatatagattttctgtagtttttttaatggtttcctaggagcatttaggtttgtaatttttgtgaattataaatattgtatttgcatatgcatttttgtttcaattctttactatattcttaggacaaactcctagaaatgaattgtttggtcaaagggagtgtgcattttaaggctattgaggtaatttgttaaatactcttaggaatgttgtatttattttttaggaagtatgtggaagaatgaccaattcaccataccttaagcaatacagagtgttatccatcttttaaatattttctactctgatatatggaatatacctttagtcatttttctgttttattgtgcattttgttgattaaagaaatatccaaagctgtaagaaagtctttaattattttaatttcttttgtaaattatctgtttaatttgtgccccttcctcctcctttttcctttttcttagaggtataaaatctacattaggcctgtcaactctgccgtgtaaattgcaaataacttcccgtgttacttgcttttaaacttggcttttaaagaaaacatatatatatatggttgggtttatcaatatttttctttatcaatatactgctttctgcccttaatacgtttggaaacattcccaatgctctaagccccaacattattataatctattgccaagattgtaaaaacctgtattcaaattctttcaagactttaacattttaatgcatttgaaaattatcttgatataaagtatgagattgccttttaatataagtttatttatctctcatgcagtttaagaaattaatagatttttttcagcagttttgaatttacagaagaattgagtggaaagtacagttcccatatcccaaagccccacttcccttttccatcttgtaggccatgtgtggtggctcaacgcatgtaatcccaacattttgggaggccagggtgggaggatccttgagcccaggagtttgagaccagcctgggcaacatagtaagaccctgtcttaggaaaaaaaaaaatttaaccaggcatggtggcatgcacctgtcgtcccagctgcttgggagcctgaggtaggaggatttgttgagcccaggaggtgaaggcgctactgtactgcagcttgagtgacagagtgagactctgtctctttaaaaaaaaaaaaggcctgagctcaggtggctcttgtatataatcccagcacttgaggaggccaaggtggtggaattgctggagccagggagataacagctgcaatgagcatgatcataccattgcactccagcctgagtgaccctgtctcaaaaacaaaccttgcattagtgtggtatatttgttaaaattgataagccaatattaatatattgtcattagctaaagcccatactttacattagtagtcactctttgcattgtacattgacaaatctgatgtgcacattttttgctttgacacgtatccactattgccgtattgtacagcaggggtccccaactcccgtgccacagacctgtacctgagcggcaggcgagcgattgccacctgagctctgcctcccgtcaggtcagtagcggcgttacattctcacaggagcatgaaccctgtcgtgaactgcgcgtgcaagggatctagattgtgcactccttatgagagaatctaatgcctgatgatctgaggtggaacagtttcactgcagaagctcccccaccctcttttctgtggaaaaattgtcttccataaaaccggtctttggtgccaaaaaggttggagaccgctgttgtttttcaccaccctaaaaatcctgtgtgctcttcttcttctccggtaccccacttctacaccccccacacaaactcctgaaaaccactgatctttttactgtctccatagttttgccttttccagaatgtcataattggaatcataagtatgtaacctttttagattggcttttttcagttagtaatatatttacggttcctccatgccttttcatacctaatagctcgtatctttttatgactgaataatattccattgtgtggacatactacagtttatctactcacctgttaaagaacatattggttgcttcaaagttttatcagttagtataaagctactgtgagcgtttgtgtgcagggtcttgagttgacttaagttttcagcttgtttgggtgaataccaaggagcgcaattgctggagcatatatagtatgagtatgtatagtttttaagaaatgccaaaagtgccttccaaagtggttgtaccattttgcattcctgtcagcaatgtgttgccctgtgtcctcaccagcatttggtagtgttggtgctttggattttagccattttaataggtgtgtagtagtatcttgttttaatttgaaattccctggtgatatttgatatatgctcacttgccatctctgtctttggtgaagtgtctgtctgtatcttttgcctatttttttattggattgtcttcttattgttgagtcttaaagaattttttgtccacttgaatattagtcctttattgggtatgtgttttgccagtattttctccctgtctgtggcttatcttttcattctcttttccccatcaaataaaattattatcttctcatagattagaaatgtcaccggtattatgttaaattattacatactcttgggcctgtatttagattttctcccctgaccctaagttagtattgccttatttctttagtttgagaaatgtttcttggcttgtgggtttctctgtttaagattatgtaagttgtcaccaaaagctagaatgtttctttgcctatttgaaagttccctttctcccattcctcaccccctttgagagtatttctgggattctgcactttccctttactcccattgtttgcaaactttgaattctagcaagaaaataacaaaggtaatgaaaaatttttatgtaaaagaaaattatatatttgaaggcttctgaaatgtgtgatcttggagatttccagtttttttttttttttttttaatagataagaatgattctggcctcttctgttggacctaactgcttttcttcaagtttgatttttggaggtttcttagtgtacatgttagagctttgtgtggtcttgtttagatctgcgttcaggaatcggacttgtggaaacccagtttaggccaaaacagggaaagcacttgcagattatgaatggaaaatgaggaatagactgtgataagattgaccgagtaggtttcaacaaaattaatgttttcagttgtgagtcaaccaaaatctaattttttcctaatacatattttagtatttctgcattttcttgttttctcttcttgcttgctgtagtgtatcattattttcaaagaaaataatttttcgcagggtagtaaataaaaatgtaataggtgatttcaattctttggtatttggtaagctttctggatcttcagatgaatatagaatcacttgtagctattggcagtctcttgactacccctctgtgctcccattttctttacattttcatggtgaagatttaagtttagagttgtactcaagttaaatttttgcataggtttattgaaagactatcattttatactaggtagtaaatttggcaattcctgataaaatagtattgagagagatgacttttgaagcattattttgctatagttggattttgttttacatagtgtgatgtgtgtgtgtttgcgtgtatgcatagcacatatgtgtgtgtgcgtatgtgtgtatataatattcttaacaccctgtgaggtaggttaatattatcctcactgtacaagtgttagtttttaccagccctttacttggaaagttttgcaattccactggttattaaaactgaaagggggctgggtgcactggctcacacctgtaatcccagcactttgggagcctgaagcgggcagatcacctgaggtcaggagttcgagacctgcctggccaacatggtgaaaccctgtctctactaaaagtacaaaaattagccaggcatggtggcacgtgcctgaagtcccagctactcggaggctgagtcaggagaatcgcatgaacccaggaggtggaggttgccgtgagccaagatcataccactgcactccagcctgggcgacagagcgagactctgtctcaaaaaaaaaaaaaaaaaaaacaacccaactgaaaagggagttaagtttgtctctattttgtgaagtttgtttttaaaaggactaatgcttttaaaataatgagaagcaagaagtctaagttattctgtctaaatgttgcttacagttatgaattattctatacagggtaatgcccacttttactattcccttatccaaaattatacaagttggtgaataaggaattaagcgtggtgaatctaagcgttatataactgctacttacagcttcggaatagcgggaataattagtgttaataagtttttataattctagctgattgcaaagtcatttgatcttttaaattatcctgtgctattataaataaatttatcatttattttagagttttgtcatgactttaactgattgtttctaaagtagtataaaatatttaatttactattataaaatattcagactagaggatatccgaaagcccttctagttctttgattttaatttcctctttttttttggctttggctttggctagaagggcaattaaaaccacttgagggatttacattcccagcttagatattggtggtgaacggtaataactcctatctgtagaattcacagtaatgatattagctaccatctgttaggagcctattctgtgctatagtgctaggcatcttatatgtattatacttgagccttgaaacaattcacagtgctaagaggcaagttaccagaggttaagtagtttgcctgaacttgtagctagttggtgatggagttgggatttgaatcaagtgctgactttgaagtgtaaaaagcctatgaattttacactgtgccctgcaggttctgatatgattgtgatataatgaaataagataatattcactgtttaagtacattatacgatgggaattgatttactaatctagagtaaaaattgtgcttttgagttatgttgttatagcattgcataatttagttagaaaatataaatacttatgaatttttattttccttcttctagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagaggtgagataaaaaatgtgttctgaagctgttttttggtgatcaatttatttatgttactatgtttctttattttattaaaataatattttatacaagtggattttgttatggaagtataatttataatagaataaagagaatggggttaaaaatatttttgaaaagcaaagctcagattctctgttgcccctgttttaaaatgttatgaatgtttgaagtctgaaatacttgatttagactattaaaaaattctttgcatgatagacctcaacaaggcttcatctgtgtggtaattaaaatggaaatggtactttgaaaagatggttttgctctggtattctttcctagaaataggatatagttttgtggtctgggctgctaagttgtacccatttacctcaaggaatctcttctttattggcttgaaggatggcattcaaactcactagagactgaagagtaaacctgaacatcagcactggtttctacattttctgtaaagttatttctttgagtattcataactatcttagtaatatacttttttgtgtgtgttatactgttgcccagttggatatggtatagcagaggtatgaagcagtttgtaacaaagattctgcctaagaagcattagtcatttgaaagtggttatttgtctgaatttgaatctagtcctttctagttagtgtaagatggtgctgtgcctggaaaatgcgatgtttctgtttggtgaataataaatcagggaaaagtggtggtaggcctcaaccagatagcactttggtaaagaagttagatggcttctcagttttaagtaacagaactatagaattttagagcaggaagaatcggagcacatctgatcccttgtcttcatgttaaagatgaggaaactgagatccataatagaataacttgacccactttatttagctagtttgggcaattatacctttgaatttcaggactcttaacacccaactcacagttctctttattaatcctagaccttgtatgtttctttttgattagtgtaatgtttattgtgtatatccttattttctttacactttttttccatcactttttccaggataatttccatttccatactctttgggttaatacatcacttgcttttataatagtctgaggtctatttcaaatggatttttaaaatgtcttcagtcagtcactgctgtggtttgaatgtgtcccctccaaaattcaggtgttgccaatgtgaagataatgagaggtgggacctttaggaggtgattaggccatgaggactcctccatccttcatgggattaaggcccttataaaagagcctccacagcttgggcacggtggctcatgtttataatcccagcactttgggaggccaaggcgggtggattgcttgaggtcaggagtttgagaccagcctggccaacatggtgaaaccacgtctcacgtctaaaatacaaaaattagctgagcatggtgtcatgcacctgtaatcccagctaccagggaggctgaggcaggagaattgcttgaacctgggaggcggaggttgcagcgagctgagacggcatcactgcactccagtctgggcaacaagcgagactggcgataagcgagactccgtctcaaaaaaaaaaaaaaaaaagagcctccacaaaaagtttagcatgttagcttaactttttgctttctgccatgttgagatgtaacaagaaggcccttaccagatcagatacctggatcttggacttcccagcctccagaattgtgagaaattattttctgtttttcataaattacccagtctcaggtatgcagctgtagcaacacagaagggactaagacagttatttcacatttattgtcttagttctaggttagaaaattgcttatgtaaaaaacatgttaaactttaagagaattgaattgcttactagtattttttattgtccgatttatgatacccttgattataaagcctcgaattcttatactcgatttacttatttttataggcgattgtttaagtaatgtaaccattgaaagtgaatatttgacattattggtggaaatgtaaattattacagccattatggaaaacagtatgcaggtttctcaaaaaaactaaaaatagaactgcccaccagcaatcccattagtgggtatctgtccaagagaaaggatatcagaatatcaaagggatacctgcacccccatgtttattgcagcactattcacagtggccaagatatcaaatcaatctaaatatctatcaacaggtgaatggataaagtgtgatacacacacacacacacacacacacacacacaaaatggactactattcagccataaaaagaatgaaatcctgtcatttgcagcaacatggatggaactggaggtcattatgtgaaattaagccaggcacagaaagataaatatcacatgttctcatgtgggagctaaaaatgttgatctcatggaggtaaagagtagaatgatagttaccagagactgggaagggtgggagagggaaaagatgaagagaggatggttaatgagttcaaaaatagttagaaggaatacattctactgttcagtagcacagtagggtgactaccgttaacaacaatttattgtctatttcagaatggtttagaagatttgaaatgttcccaacacaaataaatgataaatgtttgaggtgatggatattctaaataccctgatttgaccattacacattgtatgcacgtaccaaatatcgcatgtaccctataaatacataccattatatatcaataataatatttttaactgtaagtattctttaagattggaaaagtggacagttttgtaagctgaaagtttttttccatatagatttcattcaggaagatcagtagtgcattgaatttcatcaaaaatggcattggtaacacttcaatttttataaaatgatgaggcactcatatctagaacgctatttgcagctctggtttctacacctcctgaaagatatattatgaacatggtaaaggcacctcaagggaataggagaaaaagaactttcatattgtgagcgtcagatcttattagtttggaaagtagatgagaagagaatatggtcacagagtgttgtttagcgcatggcacatggaaaatgctgtagtaatgtttgaaatctgttcatattcatgaatagactctaaggggaacattgggatatgtccatcaaggcctagatgtttaaaaagtagcaaaaacctgtatatatcaaactggagtgagcaaagtcagttagtaggaagtaccatcttatagagatgacagaaaatcctgacaaatgtttgtctgaaaatgtaaatagttttgaaacacactgatggatgatatttataatgattttttaaaaaacctggaatgtttggggatttaattgctactttttgaaggtgctatgagagaaagtaagcatgttccctttcacccatccattcatgcttcatttggaaaacttggctaagtgatcatttgatctcttgtttcatttgctactttagactcttggggcatgatgtttaggactaaaaagggacttagagaatccacttgctcaaaacaaataacttaaaacttaaagtttattgtactataacttgaaaaatttgaaaatcaaaaccattttgtcttaaacagaatttaggttatacttgtgtactaattcttggatatagtaatcttttccaacaaaattgcatgcaacatgcctctttgacttcatgtttgcttttgcaggactaaaaagaggattatttttgctaaaagtagttaagattgctcaattttcacaaagccttgactgttattctcttaaaatgcaaatcttcatctttaaagcagctatccagttttgtcttttttttttttaagttcactgatctaattcttgccaggtcatttgtcagttactttgtgaccttataactttgtttgttctatttcttctgatgtagtaaatttaaagggacaggattagtatcccattttcttaaaaaaattttttttgtatatattatcttttactttgagcatatgtctagtgagatgtttggaataatgtttgtttagtgtttaatgattgtttcagagtgatagggatttttttcttttttgtactactttttttgtttttttagaaactgtgtctcactctgtcacccaggctgaagtgcagtggtgcgatcatagctcactgtatcctcaaaacttgggggctccagggatcatcctgcctcagcctactgagtagctgggcctacatgtgtgcaccaccacacccagctaaaatcatttctttttttttttttttttttttttttttttgggacagagtcttgctctcccaccgaggctagagtgcaatggtacgatctcgtctcactgcaacctccacctcccaggttcaggtgattcttccacctcagcctcccgagtagctgggattacagcacccaccatcatacacggctaatttttgtatttttgtagagatggggtttcaccatgttggccaggctggtctcaaactcttgacctcaggtgatccacctgccttggcctcccaaagtgctgggattacaggcttcagccaccatgcccgaccccaaaaccatttctttaaacagttttttgaagactgggtctcactatgttgcctaggctagtctcagactcctggtggtggtctccagcagtcctcccacctcagcctccagagtagctgggattacaggtgtaaggtaccacacccggctctctctcttaattttaaaaaataacacatcatttttataagaacaactctattctaaaataagagtgagttagttttagagattataagaaaggatatagacttaaaaaaaagcaagagtaaagagtaggaggaattgcctgatttaatgggatatttcagtagaaaagggttgatttataaggaaggatagatgactcttaaaaagatgaggccaggcctggtggttcacacctgtaatcctagcacttttggaggcccaggcaggtgaatcacctgaggtcaggagttcaagaccagcctgagcaacatggcaaaaccccgcctctactaaaaatacaaaaattagccaggtgtggtggtgcgtgcctgtggttccagctgcttgggaggcagagacgtgagaatcgcatgaacctaggaagcggaggttgccaaagaacccaggaaggcaagatcgtaccactgcactccagcctgggtgacagggtgagactccctctggaaaaaaaggcaagatgaaagagtaggaggaatttcctgatttaatgggacatttcagtagaaaaggatgcaccctactcctaacatcacaatacatttcaactagactagagattcaaaggttaaaaaaaaaaaaaccataaaagtaagattttggggctgggcgcagtggctcatgcctgtaattccagcactttgggaggccaagctgggcagatcgcttaagctcagaagttcgaaaccagcctgggaaacatggtgaaactccatctctacaaaaaatgcaaaaattagctgggtgtagtggctccctcctgtggtcccagctactcaggaggctgaggtgggaagatcgcttgagtcctggaggtcaaggctggagtgagccaagatcgtaccaccgcactccagcctgggcgacagagcgagaccctgtctccaaacaagaaaaaaaaagttaaaaattaaaaaaaataaaaattttgatttttaataaggaaggcttttctaaccatgaccaaaaaacaccacaaaaattaaaaggttaaaaatgctgctgactttatagaatttctttgtggactttgacttcaaattttgattgtagaacttctgaatcttgaaagatataatacaaagataaattatatattaggatgaaaatttgtcacatatatgaaaaaggattaattttaatttccagtcctttcaacttaagaaacttcttatagaaactaagaaaaaggcccgtgttcaataggaaactgacttaacagtgtgagtattgtagtttgaagaagaagaaataaatgtgggccaataagcctatgaagaaatgctcagccacacttaaaaatgcaaattacattgacagcaaggatatttttaacaaatttgattgtcagagattaaataaataggaggaaacagaagctcctgtacagttagtaagggagaatacagtagtgcaactaatttgaaagacaactttatattcgtatcgtttgatccagcatatgctccagattcaccacagattattgaaggtatttgtacagggatgctcactgcagccttaattagtagaaaccaacaagggatataaaagattatcggtaagagatcggataaacacattatggtagagccatttaatgcaagataaagtagcaggcaaaatatattctgtgtatccattatgtgttattaaatgagtgaaagcaggttacatgtcaggaggcatagtatgactgtgtgtgaaaagaaaaccatgaggttaggcatgtctggaagaatatacacatagtctgctttcaatagtactcttttaaaattgataaataattatacatatttatatggtgcttgtggtattttgatacatgcataccatgtttaatgatcaaatcagggtaattgggatatccatcatctcaagcatttatcatttctttgtgttgagaatattccagattttctcttctagctattttgaaatatacaataaattgttgttacctatagtcacctactgtgctattgaacacttctaattgtatttttgtacccattaaccaacttgtcttcctcccctccttcactgtacccttctcagcctctgataaactaccattctactctccaactccatgggatcagctttttagcttccacatatgagtgacaacatgtgatatttgcctttctttgtctggcttatttctcataagatatccttcaggctcatccatgatgctgcagatgacaggacttcatgctgtgttatggctaaataatattctattgtctatatatgctacattttatttatctattcgtctgttgagggacacttaggctaattccctatcgtggcagtggtgaatagtggtgcgataaacatgggcatgtagatctctctttgatatactggtttgttttcttttgggtgtatacctcgcagtgagagtgctggattaaatggtggttgagaaatgaccatgctgttttccgtaatagctgtactaatttatattcccatcagcagtgtaccagagtgtccctttctttacatccgtagccagaatctgttatttatggtctttttgataatagccatattaagtggggtaagagaatatcttttttcttttttttttttttgagacagagtcttgctctgtcgcccaggctggggtgcagtggcgtgatctttgctcactgcaagctccacctcccaggtccaagcaattcttctgcctcagccacctgagtagctgggactacaagtgtgctctgccatgcccggctaattttttaaatatttttagtagacacagggtttcactatgctggctgagctggtcttgaagtcctgacctcgtgatctgcctgcctcggcctcccatgtgctgggattacaggcgtgagccaccgtgcccagcttattatggttttgatttccatttccctgagtattattagtaatgttgaacattttttcatataccaattaaccatttgtatgtcttctgagaaatgtctaatctgatcatttgtgcatttcaaaatcagatacttgcttttttgttgctccttatatattctggttattaatacttgtcagataaattgcagatattttctcccattctgtaagttgtttcatcactctgttggtcgtttcctttgctgtacaggatctttttagctcgatgttatctcatttacctatttttgcttttgttgcctgtgcttttgaagcattacctaaaaaatacttgccctgaccaacatcctgaagcatttccccaatgttttcgtatcgtatcgtgtcgtgtcgtgtcgtgtcgtattgtatcttttcaggtcttagatttaagtctttaatctattttgatttgttttttgttacgttttcatattgtgagtaatgggagtctagattcattctacatatggatatccagattttcccagcaccatttatcgaagagactgtccttttcccattgtgtgtttttggcttctttttcaaaaatgagttggcttaaatgtgtggatttatttctgtgttctctgttgtgttccgttggtctgtgtgtgtttttacatcagtaccatgctcacttggtgactgtagctttgtagtaggtcaggtaatgtgatgcctccagttttattatttctgctcaggattgttctgggtattcggagtgttttatgattgtatatgaattttaggcttgttttttctatttctatgaagaatgtcactggtattttattagggattgcattgaatctgtatattgctttggttagtatggacattttaacaatattagtttttccaatctatgaacatgggatatctttccattttttttgtgtcctcttcactttgtcttagcagtgttctagagttttcattgttgagatcttttactactttggttaaatttattcctaggtttgttttggttttttttttttttttggtagctattataaatgtgattgtattcctgatttcttttttggattgtttggtgttggtctatagaaatactactgatttttttatgttaatttttgcatacagctttttaaaagttgtgcctgttatttacaagtcccccctttcagcccttcagtgtttatcttattgggaggggagttttctgactgaatggtgttaagggatacttttccctttctctttgaccttgtggtttaatattttaaaataagccatctgctttaatttgagtggagttttaggaggcagtagagttaaaagtatatattcagccgggtgcggtggctcacgcctgtaatcccagcactttgggaggcagaggcgggcagatcacttgaggtcaggagttcgaaaccagcctggccaacatggtgaaaccccatctctgctaaaaatacaaaaattagccggttgttgtggcgggcacctgtaatcccagctacttgggaggctgaggcaggaggcctgggaagcagaggttgcagtgagccgagatcacatcactgtcttccagcctggctggcagagcaagacactgtctcaaaaaaaaataaaaataaaaataaagaaaaaaatatatatatatacacacacatacacacacacacacacacacacatatattcagtgtaccaggtttaatctgaagtcctctaaacattgacaaaaaatttactgaaatactgtataatattcttacataaagatacacaaataataaaggaataggttgattaattactgcattgtgaatataccaggtcaagaaaaagaacatggaatgactgctaacaggttctggaattagatagtgatggtagttgtacaagtctatgaaaatatcaaaaatcactgaattgtacactttaaaatttggtgaattttatagcatgtccattttatctcagtttaaaaaagaaaaataccagtaccccagaagtcttccttgtactctccctatttactacctatcccctcttcctcagaggaccatccaaatttccaacatcatagattagttttgcgttcttttaaattgcatataaagagacttacacagtgtatatacccccttgtgtgcttcttttttcttatatttgtgcatttcatctatgtaggtaaagttttttcatccttactgttgtatgatattccattgtatgatataccagaatatatttacacattctgccattgatggtcatgtggattgtttccagttttgattagtgttgcattgaacattcttttacattcaggtctgctgtaacaacagataactttcctaaaaatcaccacactatgaaaaatggcacaatgaaaaccacaggtgttatttcaaaaatgagggcagggaccaaacacttaaaactttgtgagtgacatattaaaagagattaaaacctaataaaaacaacagcacagttttatgcttttttttttcttttttttttccttagaggaggtcttgctttgttcttcaggctagtgtgaggtggtgtgatcatagctgactgcacccttgaactaacgggctcaagctatcctctgcctcagcctcccaagtagctgagtttataggcgtgagccactgtgcccagtttatgcatgttaagtggtgaataaatatgtgaatactacaatcaatttggcatcttaccttggaaaaaaactcagctttgcttataggagtgtgttgcaaagagttgcagcttgtgagttactgtgatgtgttagctgggggagctatctgaaattggatgagaacttatagtagcaccagttgtagaggagtgtggatcataaaactcccataaactaaagtcgctggtagatgtctgaggtgtgtgcattttgtgtattcttaggtggctcgtatcctctgggtacagttttttgccttcacctagtctttctcacagacaagattgtgcttgcttttcctgtatgtgtgtattttttggaactatttgaaaatcagtcgtagacatcatgcacttaaactattaaaacttcagcacgcatctcgtaagagtaagaatagttagatattcttctgtgttatcttagtaccattaccacatctgagaaaattagcaataattgttcagttttctctccaatctctattcaaaattgtccccagtctattttgtgggacttgaaaaaaatcagataaagcagataaatcaaatacataccatttatgcatttgattgttaggtgtcagtacacatgccatttatgcatttgattgttaggtgtctgtttttaactgggttttcctaaaagcagaacctgaggcagagggcttaggtgctattaatttatttagagagttcattcctagagagcagaagtgagggaaagtgtgaagatagtataggaaggggaaaaactaatacaaggatgcttcctgccactaagtgtgactgatttttgtatccttggtattgcatccctgagaagccatttgtactgcatgttaggactctgcaaggaaagagaaagaatttatctactggcttctagtgggcagcagttcccccatactttagggttgtggatttgtcagtgtaggtgatttatcaggaaagccccaagtgagggggtgagaggaggagatgtggactgggggccacaggcatgaagtgttcctggggctgctcaggatgaaaggtaggtgtgaagatctgggggtgactgttggaatgggttgggaatacacataccaaatctggtacagtgtctctagtcttttgtaatctgatagaatagtcttccttatcttcttttccccccctttaaatgacattacctttttgaagagaccatgccagttgttttatagactatcacacattctttatttgtctcatttgtttccttatgttatttaactcattccactaatccttgtatttctggtaagaggaagttaggtgtaaaggttgatgagactcgtttttggtaagcagacctcacagtgatacacagtgttgtatttcatattgcatcatcaggaggctcacaatatcaggttgttgctcttgtggtgctgagttggattgcgtaaaggtggggacctccagatcttccacgggaaaggtacgtttttcttgttgatattgtgaagtgtgtatggggttgtactttggcaccttgtagtgagtcagtttccccccattggtgatcattgccaaatcactacatttgaggtttcaaaatgttatttttctccctaatttaatcattctgtttgtagttattagttggcattcttctataacactctttttcttcatcaactagggatgaacttctgttccttctaaaaagacaggctaaagtttacattactttcttttaatgatcagttatttgagtagcttgtgtgataatcccctccagaggttgctaagttccccctttttcttgatctctctctttacaaagttatcactgtataccgagaaatttttatttactaaatgtttacatacatttaagtttgggtgctcatattacttcatatttgactagacgaatcacttgaaggagtatctgtgttttcttaggatatgctttactagtctttgagcatgtccttgccttccaacaattttcccaagtttattttgagttttcactgctcctgaactagaatccacgcataacgatggtttccatttttctattcctaggggttgctttttctttgaggtgttatttttgagaggtaagaaagtggacaggcaggtgacacattcttccaactttagccttttgccccagaactggtaaaataaaatttgagaaatatcgcgtgagaagaaagcacatattgtattcattttaaaatattaatgcaaaatattgtattaatagtttacaatattaatattttaaaatgaatacaatatgctttgtcttcctttcttaaactcacgtgttccacaggaacggattaaaataataaccttatttttcaaatagcatagttttaaaaggcacatcacatacattgtaataatttgggatgttagaggagcatgaattcattcttgctatagcctcctaacatacacgaggtgagccagattttggttcttaatacgtggagcttatactgtgtttactttagaattgatcaaactgtcattcagggatattggtactgcccaacgttgcagtattaacctatagaaaaactgattagaattcagaacttcaggcttcaagactgatgtttccatttttgtttagtaactttcttggcaattggacttgttacctagacaaaggaaaatactgcaataaagttaaaataaggagagaaagaactaattttaatagagatagaaatgtaacaggcaacgtttatttttttaaaaaagctatagaaatacagtaatatgtggtatgatgatgttttggccagccacagaccatgttaagtagggatcccttaaggttataatcaagctgagaaatttatatctcctagtgacatctttgctgtcataacattgtagcatgacgtatatcaagtgtttgtggtgatgctggtgtaaataaacctgttctgccagtcataaaagcatagcacgtataattaggtacagtacataatacttgataaatattaacaattatgttactagtttatctactgtacttttagtagttattttatagagtgcacttctacttattttagaaaaaagtaaagtgtaaaacggcctcaggcaggcccttcaggaggtattccagaagaagacattgttttcgtaggtggcgatagctccatgcatgctattgcctctgaagacctttcagtggtactgtccagtgatactgatgattctggccttgggtaggcttaagttaacgggtgtgtgtgtgtttgtttttaacagtatttaaaagtgtgtgtttgtatttaaacagtaaaaaaaaaaattaaaaaatagaaaaaagcttatagaatcagaatataaagaaagaaaaaattttgtacctctatacagtgtatttgtgttttaagctaaatgttaaggtgaaagagtcaaaaagttaaaaaatttaatttataaagtaaaaaggttacagtaagccaaggttaatttattactgaagaaagaaaaacatttttctataaatttagtatagatcagcctgggcagcatagggagaccccatccctacaaaaaaaaaaaattaggcgtggttggtgccttcatgcctgtagtcccagctacgtgggaggatgaggtgggagaattgcttgagcccaggaggtcaaggctgcagtgagctgtgatcagtccactgcattccagcctgggcgacggatcaagaccctgtctccaaaaaaagaaatgttataagagaagtggaacaactgtcatattatgccaaaaaaaaagctgttaatctaggagaaaactcagcaaaactttacacagttactgagaaaatgaaaggctatgtgaaagcttaagtatgtcacattggttagacttatgtgttcctagaagacacccccaattagttttgaattatgagttttgattatgtgacattttcagtaactcatcatttaaataatcttgattgctctatatctgtatctgtgcttattactatttttagtattagagcagtgatatctcatgtgctcctaaacctcctcacctctcctgttttttggatttccaaagtgatacatgtttattgcaaaatttcctaactttatatgttttcaattatgtgaaagtcatatcagagaataaatactaacagctctgttatgctcttaatccttttttcttttagaatcccactgtcctttttcattatggaatatctataacctctttctctgtcttgggcctctgttcccctctttattttatcctgtaaatatgttcaaagattccattagaaaaacagacaaacagaaaaaagtacttctcagtaggacccaaagtaataataaacatataggattagctgaacaaatacataccaaatggttaaaagaggttatctcgggaaaagaatataaaaaaagacttcagcattatgcatctgtctttgtaagtatgtttaaggtgtgcctgaattacctgtgtagttagataattttttttaaggtaaataaaggaaaaaagagaacagttactgtggagaaggagggtcagaatctgggttacagaatattgggaatgggaagaaaaaaaggcaaactacgttttcaagaagcttagctaagaagagaaggaatgctatagggtcctactaagaagtgctttctccccctgtctttctcctaatggcctctgtgaacatattatatttacaagataaagtgaagaagggaacagaggcccaagatggaaaaagagattatagacattgtatgaagggagagtgagattccaaaagagaaaaggatccaagggcaaaacagaagctgttcgcatatgttatctgattttttggtggcatttgctactctctactctgcttttgaaaattttttatcttcttggcaactatttgacctgttggttttccttcattttgtgttattttttaaaaaaatattttaatcatggagaaactgtagtgaatattataaatatccatgtatttactactaccttaagaagataacatagtgtaagtatagctgaagtctcttgtgttttccactgtaatcacgttctcctgccttgttccccagaattaacctctgtcttgaatttggtgcttgtcactcacatgtactgtttatagttacagttttctttacctttcttgtgcctgggattcattgagtttcttggatctgtgggtttatagtttttacctactttagacgtttttcaccaattatttctgcaaatattttttctcttccttcccctttgctttcagggattccagtacttgtatattggtttggttgactttgtctgcagttcactgatatgattaatcttttttcagtctttttcgttggtatgttaaattttagacaattgctgttgctatgtcttcaagttcattaatcttctcaagtatctagtatactattaatctcagtcagttttttatttcagacagtttacctctagaagcttgatttagtttctcttctcttctcctctccctctccttctttttggagacagggtcttgctgcgtcgcccaggctgcagtgcagtgatgtggtcatggcccactgcatcctcagcctcctggcttcaagcagtcctgctgcctcagcctccccaagtacctggggctacacatgtataccaccaggctgggcaatttttttttttaattttttggcagagatggggtcttgctggattgcccaggttggtctcgatagtttcgtttttatttttgtctaattaacacactctatccttctctgtcttcataaacataagggacagagttaaagtaacttttaaaatgtttttgtctactgattctattatgtgtcatttctgggtcagtttttattgattgattttttttctcttctctggatcgtgtttccttgcttctttacatgcttgataatttggatgaatttggcagacgttgtgaattttaccttttgggggcctagatatttttttattcttttaaatattcttgagctttgttttgggatgtagttaaatgacttggaaagagtttgatgccattcagactgcttttttgtttgtttttgagacggagtcttgccccgttgcccaggctggagtgccgtggcatgatctcggctcactgcaacctccgcttcctgggttcaagtgattctcctacctcagcctcctgagtagctgggattacaggcatgtgccaccacgcctggctaatttttgtatttttggtagagacggggtttcaccatgttggtcaggctggtcttgagttcctgacctcgtgatccactctccttggcctcccagagtgctgggattacaggtgtgagccaccgcgcctggctgcttttaagctttttcagtgggactgagcaacatttggttgtagaaggctatccccactgcccagtatattatgagttttcattattcttggccttgcgtgagctctgggttttgttccatttgctgctttctaagattttttcctcaccttgaagtttccttacatgcatgtactgatcaaaactaatctgaagactcgaggggaactctgcagatctctggagctttttctgtcccgctctctcctttctggtactcttacctgtgagttttagctctgtttattctcaacgctttctcctcaacttaaggctgctgggtttcgttgagtttcccccttctgctacagccaggaaactttttctgggcatttacaggactcacctcattagtttctcttctcacagggtccagtgtctgaaagtcagtctttttttttattccattatggttggcagcaattgcttgtttatggaaagccattggtattctaaaatactgttaattatcttatgtgcctattaggtgaagtgttgccatcccaaaaggcttatatttcaagtccttctaaagtagctcatattacagggtgatttctaaattacttttaacagcaaatgaccatctgaagagaacacataggcttgaaatgtaccttactcagtgccagttgggtacttacagatacttacagaagatgcagttagtgtagaatttaacacaaattgaataatcattccctgagtacagccttaaaacctgtaagtattagatctatgcaagcttttttgaaggattattaggtatattaaaaaataatatagtaaggggttagttacatcatgaaggttataaatacacgcctacagtacaggggaaagtggcttcctcttctgtgaatgagcactacaagttgagtgttccttatccaaaatacttgggaccagaagcgttttggattttggatttatttggattttgatatttgcattatacttgttggttgaatatccctgatctgaaaattcaaaatctggaacgtggctaggcacagtggctcacccttgtaatcccagcactttgggaggccgaggcaggtggatcgcctgaggtcaggagtttgagaccagcctggccaacatgtcaaaaccccgtctctactaaagatacaaaaattagctgggcgtggtggcaggcatctgtaatcccagctactcgggaggctgaggcaggagaatcatcgcttgaacctgggaggcaaaggttgcagtaagttgagattgtgccattggactccagcctgggtaacaagagtgaaactccatctcaaaaaacaaaagataacaaaatctgaaatgctccaacgagtattgtctttgagtgttatgctggcacttaaaagattttggattttggagcatttggattgtggatttttggattagggatacccaatctgtagtagtaattagggataaatggtcaagtgacgttgtagttcagaaagggccatatctcaaacaacttaaaccgtataaaactgatgtttgaggtcacagagattagatcattaaaaagtggttgtggttatgatgaccctagacatcggagatgaatgtgaggagtttaactaaaatttgttctttgaaatgtgactggaataatatattagacatactattttaatgtgttgttaagtaattatatgttaactgattaatttggatatttgactatttcatcttattcttacaggtttgtaattgagttggcaaacttctatttttactgggaaaatggaatgtctaattttcaggattgtttcaggctgttttcaattttgtaatcacctatagtttaaatattagaaaggccactcattaattcagcaaacattgtggtcaccctgctatcccccaagatgatggggataaagtggtaggtatttgagacatttcttttcttttttttctttttcttttgagatggagtcccactttgtcgcccagcctggagtgcagtggtgagatctcggctcactgcagtgtccacctcctgtgttcaagtgattctcccacctcagcctcccgagtagctgggattacaggcatgcgccaccacgcctggctaatttttgtatttgtagtagagatgggatttcaccatgttggccaggctggtctcgaactccggacctcaagtgattctcccaccttggcctcccaaagtgctgggattacaggtgtgagctaccatgcccagcctcatgagacattcttgagtcttgtcctgttggaccttagaatccaacggatttaaaaactgaaacataggcatggtataaattcaaggactcttaggagtcattgagtttttttattttacaaaagaggaagttgagaccctcctcccacccccccgaagaaaatgactgcttaagttacacaggctgaatgatatttctaacttgccgtagtgattttcagccttttctattatgaagtctgccaaacttagggatgcctgccctctctgggctagactactctagatgtgataaaaatttcacaagagaaacttcagaatactaagagagcaaccaggtaaagggttttacatacctccttatttttcttcgcaaaatgcaatgcctagtcagtacttagatatcacttccattgttttcagtattctgcttaaaaatgataaactttatttagggagttatgagccttgagccttatatgagctttactctttcatgttgggagcaaatgataattgcaggggtggggtggggaaaagggagtactcaacagagcatgtaatttccaggctatatcctgcatgggataagggatgtgttggcccatgatgacatttacatagctacatacatatgtatttaggtctgagaggagaaaaaccattttttccctctgctctcaacacagcacacttctgtgctgactagatgtgtgaggaggtttttggtgaagcttttccagtggacacctactgggtgtcctataattcaattctgacactatctgcttggaggtagtagtagtctctacgtaaatacagttctggcagtgtctacttggagatagtagtagtctctgaagtatagtgtcagatcccacaggttgggggctcagccccacaagactgcccccatttagatggaaatagtagattgtgacctatgcttctgactgactagttttaaattggggttcacacaaccccttccttgggtttggttaatttgctaggatggcttacagaactcagggaaatgcgtttactagtttattataaaagatgttataaaggatacagatgaacagccagaaaaagagatacatagggcaaggtctggaagggtcccaagtgcaggagcttctatcctggtagagttggagtcctcagccttcccagcttgcctttgccaacccaaaagcacatcacatgttgttaagagtttttatagagcttgatctccagcccccaacccctgcccctttcctggaggttggtgggtggagctgaaagttccagccctctaaccctctaatcctctaatcccgtggtctttctggtgatgagcctcatcctgaggctttctaggggtctcactttaagttacctcattagcattagctgtgatccaaagggcttgtcatgaacaaaagaagaccttcccattacttaggaatttccaagagttttaggcactctgacagaaacaaagaccgaatatatttcatattataccacaatagatctatagctgtagctggcatttactgagcactgttgcactatttattgccactattgacctaacaagtcagcattattctaagtgccctgtgtatattatttaatcctcacacaacagccccattagataaagtaaggtaaagtcccattgggcctgtctcaagtataccctgttaggctttaaataaaaggctgtaatttgatacatactaataatagtaataacaacattgataatgcttactatttgataggttctaccaaatggtatctatgtattaactccttttcataacgcttaacagtgaaatgtggtttagtctgaaagttgttagtgcagtccatgtgtatttgaaatgttaggaggaggaatggggtataagaggcaagtaggaacagttcagttgtttgaacttgaggtcattcataatatctgtaaactgtgaggaaactttgtggacaaaaattgcagataatactcttccttattatgcattaaaaatttgttagaaaatttcttggattttaaaggtttttacagacaggatctcaccctgttgcccaggctggagtgcagtgctgcaattacagctcactgcatcctcaaactcctgggctcaagccattgtccagtttcagcctcccaagtagctaggactacaggcgcaggccaccacatgtagctaacttcactatggcatttgtataggggagtgtggctggaagcttatgatactgaaagccagttgcatatccctctgccatgtcccctgtgtctgttagcctatctagctccagtcctaatgatcttggagacaggacatgaattcacaaagttagttgacttaaaaacaaagacttcttgaggagtttgaaaggttacatagttgtaactatctttttgtggtggttttttttggtgtgtgggggatcagtgaaatggatttagtaaggcagtaaagttaaaatttgcctttgttggtaaaatgttatttattcacttttttagcaaagaaaaaaaggcaagttttagagataatattttaaattattgtattttgtttttcctgctccccttctcaaaaaaccacatggaatattccattcattactgctcgagaaagtcattactttgcaggctgcagttgctgaaatggtttagtggaagaaatgtttgcttgcatatttttagtgattttttttttttttttttttttttttttttttttggtggttgtcatttgagtatccaaactgtagctaacgaggagaagcagatttaaatttatatcgggggaacctctttgtggagcatttcatcagatgacttcctgtcaacctcatatcttgaaaagagggattaatgaaacagcatctgaagaagcagtggactcttgtggaataaaccctgacatcttccacagtgttttgtgggataatttcaagttcttcagatacagattacataaagaagattgtagggcacgtgacagactctggtttcttgtattttagatagtagaaaaattgctacctctaagaatggatcctggagagatctagttacagttataacttcttcatttatggttttatctcacagctttatttatttttatttacatgttttgttcaactaggcaacttaaaatagttttgctttatgtataaaatattgtaatggtagagtaatggattgcctgtgcattgtaaccacaaaggtaagatataatatgcttttctgtatttcattgttagtgacagatgtgagagaccctttgttcagtgtcttttaaaaataaggtgtaaccattgttatagatttgaaaatagatgtgtgaatccatgtgatgcttagtttatatcctttagaaagggcggtattttgaaatgtgttttagatagccaaaagcgtgttgcacagatgttttttccctgagatttacaggaagcctttctcccagcagcaagggtctgtaaagtcctgattatatttaaatcttctcagtgtattctcagagctactcttctcccctttgtgtcccaacatgccatgctagttgaaagtataactcgttttgagagcattttctggactcttccatctattataattatagttaattttttgtttttttaggaagaggaaaatagtcaagtgctgattgtgttgcctttagaaagatgttgatgtggatttaaaatgattagacttgtacaagcactccttgaaagtacttgttttgaagtctgttttgctcattgtgttcaaagtgcagcatgcttcacttaatctctaagtttggcttcttttatttttgagcaccagtttgcagacattgtgtgatggtgttatagattcagcgtgcttacatttaaaattcatccattggtttttaaaatatggaataatttacctttttttatttctatgcacttacgatgtctcatagtgattgctagacaaacttgttgagattttaaaattacattcagtaataaaagagtaggtaaatttgtaaattctgaaagtagaggctattactctttctgtataatgaattatttttcataagaggaaaagcaggaaaattgatggaaattagttttcttttcttgttgctcagagttctagttcaaacagtagtttctgatcggatacagacatgcccattatctgtttccattccctgtttataaggagatgtcttctctgtacctctaggtaaactgtcttgttgaaatattcttactgaatgtttaaagggcacataatcctggaaaacagggtcgttgttgctttttccctctctaaatttttttcatggttgtctatgttggttctcccctgtgatttgccttttatcatttcattcattttggttttatttccagtattatagcaaggttatttgaaatgatctatctcctctctctgctccatcttccttgatagactttgaatttttttacattgactcttttagcaaaagagggtctattttgcttaaaaaattagatgtaatcattatcctaaagtatttataaatttttattatataactgttaaagcaaaaatagagaaggatgtaggttggaaattagaagcctaaaacattgtttgtagttgcttttgaaaaaactaaattaaaataatttgttctattattagaaataaaccctttgaacatatttaaccaatggctctagcaggaagagcaaaattcttgattttcttttgaactaaaggctgcggtgtgtaccccatcccttgttcttttctcccttttctggtcttagagagctttgtgattctatatgtgttttaaaagtctgacagtgtagttgatgtaattttatcatgttaatactaaaacacctttccaagtgaaatttttttcatcatccgcctcccctctctcccacttgtgtaggcacggtgaactaggtaggcacgttgcatcattgctaccatggatacccttaagtacaggcatgtgggttgagctaaagcaatgatgattagttttttggttgttcccccccgcccccccataactatatgttcttcacaatgaagaatctgactttaaaacgtttgcaaatgacaaggttgtgagatgtgatgactaaaccatcactgctactgaactgccaaatcttggtctccatttacagtagtattaatgccatttactaatttaaggctgtcataaatagctctgtattccttttctgattaatatgttttaaatccaagtgtaatgtttgttttgttttgccttttagtgaaaatgaaaatgtacttctcttcgagttaaaaaaaatactcttctggatttagatattttgtgggacaaaaagatgctagtgagcatttctagcatggcagcgtttctgattattgttcatacacttatatacatttttatgtactttaatcagcttggttacagtattttgtgcttttccacataatgtctaagagagatttatttttgtgtttgtaagttcttgtgttcttagctagctgctttgcaaacatgtccgttgaggtggagttaatattgttagaggccaggcagtgaagtgtcatttttgtcaggctcgtaatcactgtaggaaaattaactcagagcataaaaggcccaacaagagtgatttaggattattgttatatatggtatattttcttatgttagcaataaagcactctgcttaaaccgcagctgagggcatttcgtgttctttagcatggaggtttcccagctgtcaagtaacttctgagagtaactttagtaccagaatttcttgtaataggatcatgtctttctttaagttcaggtgtttcattaaggcaagctggagataggaataaaaggattatgaaagagaaggagcttgaaagatgcttttacccatacctgtttctgctttgtcagcctctttttgctgcctttattttagattttagagtgatgctttgccttgtcttctgaaacagttccctgaatctcctacttgccaaaagttcatgattcttttggtgattctttatatgggtaaagaaaatgtatgcccgtgtgtggggatgtttgtcattccagtgggtgcccagcaaatttgttttaacataactgatagaattttaggaattaagtcaccagagaactgttgaattgttttggtttatcagtttgggaattatgaatacaaaatttgactcctttgggtaaaacagctatcttttatttaaatattcatatttatattagggtactttcacttgtaggttgtattaaaattgtatgttagaagctttgaaaggggtattaaatatgttaaaagaaagtctcagtacaggtatttcagattttttagattttttttaaaagacttcaaattttttaagttaggttttaatagtgaatagaaatgctgccctctactgttggctgattgtttgactgccacgtaaaaatgttcagtaacctgtaatagaattttttagtgtagatcatattactgtgttgaagtataattatgttaaacgttttccttataatttagttaagttataatcaagtgtttcctaataatgctaactactattaaataagttcattaccattttggcttttagaaaaacttgagtcctggagaaagtttcgtttagtcttagctcctcattttatatggtgaggttttagtacttcctagattgatcccttatggttgtgtgactgaaagctcgtattgataacttataaccaaactataggtaaagatacatttttctaaactaattatttttagtttatgctatgtaaaatgtctgaacttctgaaacttatgttttacatgtaaaaaaatttggaatttaaatcactattaaatctttgcatgtttattaaaatgaggcactgctttaaaaagtagtactgttgagcaaatttaaacctctgattgatgtttttcaccgtgagtggagggattagaagagacggttttaaagattccttttagcttcgctgagtgcctactgtgtgtgaagtactgtagaaaataaacacggaaaacaaaggctattatagttcttcctttagatcaggagttggcagactatggccagtgggccaaattgggccacactcactcatttacttaccttgtatggctgctttagtgctacagtggcagaattgggtagttgcagcagtgagcatatggcctgcaaagctgaaaatacttactctctagacttttacagacaatgtttgctaacccctgccccagatgaacttctcatctagtgcagaagatatatctaaaaagaatcattttaaacagatttttataggacacatagaatgccaaataaagctagcatgtcattaaaatatgctttctttattagcgccattcttcctgttcagtagtatcttaacatcatctaataattcccaaagattcttgtttattggccatttgcagatatcgtacctcacagcctggttattttcatcatcatcattattttttctgtgtgaactgcacaaatctaagtacgcagcttgatgcctttttataactgcaatcactatccatagaaagacacaaaacatttccagtactccagaaagactcccattagctctttccaagacagcccaccctccccagagataatcttttttttttttttaactcatatcactatagattaggtttgaacgtcatataaatggaatcatgcagtatatatgattaattatggcttcttttactcagtatctgtgttactgtgcgtgctggtagcttgttcctttttattgctgtgtaatattccatggtgggaatttgaattgtttctactttttggttgttatgaagaaagctgtgtaaaacattttatacaagtccttttgtgtacatatccactaatttctctcaaatatatacctgggaggtaggatttttaattcacattgtagagcccttaccacaaagtttttgtttaataggacaaagcaggaggcaggaatcaatgacacactttcacttactttataagttcacctagtcccctgcttcattacaaagtggtgactttacattttttcataagcactgtgattaaggcaacctacgttttgactaaatcaaacaggttttatttccaatgccacctcttattggtgttggtgtctagaggtctttgctaagaattctgataacaagttgaaagtgctgtgattgtctagtagtctttgctgtgttgagggattagagatgtgtgggggaggcatgtgacagaagaatgggatcatttttatttaatatatttgaaaaattcttacatattgaatatagtgcatttaaaattacctcattgcttgaacaggtcatagatttttttttttgagacagaatctcgctcttgtcacccaggctggaatgcagtagcgtgatctcggctcactgcaacctccaccttccaggttcaagtgattctcctgcctcatcctcctgagtagctaggattacaagcacgtgccaccacgcccggctaatttttttttctttgtatttttagtaaacgtggggtttcaccacattggccaggctgtcttgaactcctgacctcaggaggtgatccaccaacctctcaaggtgctgggattacaggcatgagccaccacgctcagcctttgaataggtcatagatttcttaatttcatttattgtatttttaacttttagaatgtctgtttgctctttttagagtttctatttctcttaaatttgatattgcatctaatttgtacatcttttcctgtgtatttaaaaattgccattttaaagttcttttctgctataatagttctaacatctgtggttctgctgtgtgggttttcttttgattgttttcctcttatgttatcctacttctttacatgtcttaaattttttattgtgctctaaataacgtataaaagaaccattgaaagcgaagcagtgttctttccttttcaggaagctgcagtgaggctgataaaataggagttgaatttgtttagggttaggttgctgctttagttactttcacctggcttctgttttcagctgtcatgagggtgggagatgagttttgtgtctttcattggttctttccactagcatgactttagggtgtatgaactgtgagactgcagaaatgtttcatggctttatagccccattctcagcctgctacactgctgtaccctcagtaaatgccccatgaaggcgatctaatgtgtggggacaaataactctccattttaggatcctccagattctaactggtcatgccagcccacgtcattaaaggctccactccttataccatcaaagtcactcaatctgtatcaggtccattcctttgcccacctgagtctaggcttgtcagatacactgtttaggtaagtgtctgccttcttacaaaaggcttctttctttggggtttagattctttccttcgtgtgcagaaatttccatttcctttttttttttaattaaacctttaattttgggttaattgtagatacatgtatgtttgtaaaaaaataataataatgcagaaatcacatgtgcctttaacccagtttcctctagtagtaactctagcatagtatcactaaccaggatattgacgttaatagagtcaaactacagaacatttctgtcaccacaaagatcactcgaggcctttttgtagccacacctactttcctctcaccccatccccttcttaactcaaagcaaccactgatctgttctctatttccattattttgtcatttcagcaattctatatgaatggaataataaatatataaactttcaggattggcttttttcactgagcataattttcaagagattgccggggagtgaaattgatgggtcatatgatagttgcatgtttgcttgtttttttaaagaaactgctaaaccgctttccagagtagctgtatgattttacatttccaacagcaatgtgtgaatgatcgagtttttccacatccttgccagcatttggtgttgcctcattttattttagtcattgtcatcgatgtgtagccacatttccctgatggcaaatgattttggacatcttttcatgtgcttatttgccatctgtgtatcttttttggtgaaatgtctcttcatggtcttttgcccatattcgaattgggtggttctttttactactgagttttgagaattctttatgtaatctattatagtgtactagtccttagtcagatatatcatttccagatattttctcccagtatgtggcttgtcttttcatcctttctttaaggatctttcgtggaacaaaaccttttaattttgatgaagtccaatttatcaagttaggtgacaaatctcataactctttgcctaaccctaggttttgaaaattttctcctgtttctcctgttttttcagattaagttcataatccattttgggttagtattttttttattgtggtaaaatatacataacatacaatttattatggtaaccatttttatgagactgacatgctgcccactgcgcaaagaggacgattattctaaccattttaaagtgtatagtaaaatggtattaaatacattcatgagatgcagccactaccactattcatctatagactctgttctaatcttgtaaaactgaaacgaggacaattatcctaaccattttaagtttacagttaagtggtattaaatacatttgtgaaatgcagccgttaccactatccatctacagactcttttcatcttgcaaagctgaagttccatagtcatcagacataactcctcattccctcatcagacaataactcctcattccctcagccatcattctactttgtttctctgattttaactaccgtaagtaccacataaaagtatagtcagatggtatttgtcttcttgtgactggcttggttcactcagcatcatgtcctcaagtttcagccatgttatagtatatgtcaaaatttcctacccttttaaagctgaataatattctattatatgtctataccacatttttcgtatccattatttcgttaatggatactttgtttccatattttagctattgtgaataatattgctatgaaaacagtataatctctttgagacactgcttttaaaatccaaagtaaaagcagtaaaagaagaggtttataaagtagaaaaagaaatgggtagaagcatctttaaatctcctccctttcatattccttttattcctacctccagcttgtctcgatgatagacctgtacttaaaccatccaccacctctcataaggagagacaactagcacactagtcataaaaagcaaggaacaagaactataaaagagggaaaagagaaagaatgattcagaaaagactgttctgtacagccaggaacctacatattttactgtttcataaaaattatcaaaaagatcttctaacaattagtgaatcttaccatgtactgggcattgtttcccacactcgacaggtctattgagaaatgtctgttcagatcatttgcccattttaaatgtgcccattttaaaatatgattatttgtttttttgctattaagttgtttaagctcttaatatatcctggttattaatcccttgtcagacgggtagtttggaaatattttctcccattctgtgagttttctcttcactttgttgattgtgtttttttgctgtgcagaagctttttagcttgatgtaatctcatttgtcttttttagctttggttgcctgtggttttgaggtcttaacctcaaaaaatcattcattcattcattcttatgcatatggatatccagtgttcccagcatcatttattaaagagactgtcctttccccattatatgttcttggcatctttgttgaagatgagttggctataaatgcatgaatttatacctggattcttttttcttttctgtgtgtctgtttttattccagtaccgtgcttatttggttactgtagctttgtagtaaatttgaagtcaagtagcgtgatgcctccagctttgttctttgccttgaccatttggggtcttttgtggttccatataatttttagggttttttttctatttctttttctgtgaagaatgtcattggtaatttgataggcattgcctagagtctgtattttatttatttgtttttttgtttgtttttgtagagactgggtttcaccatgttgtccaggctgtagtcaagcagtccacccacctcggcctcccaaatgctggggttacaggcatgagccaccgtgcctgtccctgaatctgtagattactttgtttagtattgttatttttacagtattcctccacttcatgagcatggaatagctttccattttgggggtcctattcaatttccttttttttttttttttttttgatggagtcttgctctgttgcccaggctggagtgcagtggcatgatcttggctcactgcaacctttacctcccaggttctcttcacagcctcctgagtagttgggattacaggcacctgccactgcgcctggctaatgtttgtatttttggtagagacagggtttcactatgttgtccaggctggtcttgatctcctgacttcaagtgatctgccacctcagcctcccaaagtgctggaatgacacgtgtgagttcattttctttagttagtgttttatagttttcctgtatagatctttaacttctttggttcaattgattcccatacactttatattctttgtagctattataaatgtgattgctttttaaatttctttcttctctttttctttttctttttttttttttgagacggagtctcactctgtcgccagggctggagtgcagtggcatgatctcggctcactgcaacctctgtcttgcaggttcaactgattcccctgcctcagcctcctgagtagctgggattacaggtgcccaccatgacgcccagctaattttttgtatttttagtagacctggggtttcacaatgttggccaggctggtctcgaactcctgacctcgtgattcacctgcctcggcctcccaaagtgctgggattacaggcatgagccgccgtgcccggtgctttttaaatttcttttcagattgttcactgttggtatatataatgctattgatttttcatgttgattttggatcctgcagctttactaagcatatgtatcagttcttacagttttttttggtgaagtctttaggtttttctaggtatgagatcatgccatctgtaaacaaggctaatttgacttcttccttttcaattttggtgccctttatttctttgttttacttcactgcttttccagtactatatgaaataaaagcggtgaaagtaggcatttttgtcttggtccagaccttagaggaaagaccttcaatttttccccattcagtatgatgttagctgtgggtttattatatatggcccttttaattttgagctatgtttcatctgtaacagtttgttaccggtttttatcacaaaggtatattgaattttatcaagtgcttttttggcatctattgaaataatcatggtttttgttttcggttctgttaatgtgatgtatcatgtttattggtttgtgtatgtcacaccatccttgcattcctgaggtgaatcccacttgattatgatgcgtgatccttttaatatgtggttgaatctggtttgctaatattttgttgaagattttgcatctaatttcataatcagtggtattggcctgtagttttctttttttgttttatccgtgtctggttttggaatcacagtgatgctggccttgtagaatgaattccaaaacattcgattttttttttaaagagtttgagtagaactggtagaatttattaggaagccattaggtcctgggcttttctttggtgggagacttaattttttgttttatttttaaaaattttaatatttagtggaatgggagactttattatggcttcaatctcattacttgttatcagcttattgaggttttctttcttcatggttcaatcttgaaagtcatgtatccaagtatttatccatttcttctagtttttaaatttgttggcatatagttgttcataatagtctgtaatgatttttttgtatttctgtggtctcagttatgttttctttttcatttctgattttatttatttgagtcatcttttttttagcctagctaaaaggtagttgattttgttttgttgatcatctgtattttgttttattctcaattttatttattactgctatgatgtttattatttcttttcttctaccaattttagatttggtttgttcttgcttttctggttccttcaggtgcattatttctttgaagtctttctcatttttttattttttgagacatagtcttgctctgtagcctaggccagagtgcagtggagtgatcatacctcactcttgtcttgaactcctgtgcacaagtgttaggaacagtttctcttcaaacaaagggtttcaccctccttgtcttttgttctagtatataagtaatctttcttgcctttaacacacccaggcatgcctccgtccaccaagcttgtagccgacccacgctgccttactttaagttgttaggtacaaaaaataaacttcctggttctttgtcctattctaaatgctaaatctagtcagtcgggatcagtttagattgtgtggtcctaccccagataacaaggggaggacacagaaacaggaatggcgttaggaataaaaacccctgctttcctttgttcagtgtgctcttgtgattgtaactgatgcaggcagcacccttctgaaatttgccttgctgagaagtcttttgtttgagtgctcattttctttgtgactttgagctcttctaacaaatttgggggctcatctgggatcccattctcctctggggaaaggtctccaagcatctctcattaggagacgtgtcccactgcctcattgtggtggcctcaggggtaagagattgagacccacctggcatgacgaataaacccgggaagaaaagtcctacaagtagataccgcagcaaccaagtaactctgcacagaccaaggttagaaaagccgtgggggcagtgaagtatttccttggtggtcgagatcaaagtaagaaaagccagggggcggtgaagtatatcttggtcagaacataccaaggtaagaaaagccgcaggggtggtaaagtattcctagtggtcaggttatcttggaggttgaaagtgcatgaatgagattcaggcacattaagtgtagagtgagtaagtccaatctgcggttccgtggtcacctcatatggcttctgatggcggccctcctataaaggagtcaaagtcaaaggcttatactgaacctgccagtgctaagagggacctaaagtccctctggggaagtggccatagagggtgaagcgaaacaagaagagtgcaagggacctccagtaagtggggttaagcctctagggagagggaaggcaagaaacctctaatatgaaggattgagcctaacaccaaacctccaggatggggactatcccaagtaagacaagaaacagaaagtataaggctaataacattccccttaatagtcccttaggtctcatgttaaaataatactggaaagataatgagaggactaaacataagagaaagcaacagatgataaaatattgttgtttcatttggaccaaagaacccatccttgagccctcagttttctggccaaagtttaggtcaaatgaggattcaaatttgtcaacttttaataaagtatgtcaatgacaagagtcccgtttcccaggagaaaatagattatgccctgtgttggcagcagggacctgtcctcctttaccccctaaaggtatagggggcaagccagaaaccagctcctctgaaaggagtaaggtctctacccctgaacagcccactaacatctggacccactagaccacctgtatctgccaaatcccccgccccaagtgggtgcacaggaatctcctcactcagttcctcccccatgtaatcctgaatcaatgttctctggcctccctaaccacacgcctgagtctatgtctccccccaggaaggctccagcgtgagataaaacagtgcaacaaagatattcagaacttccctttcccctccacctctaagcaatcaactccaactctctttcccttaagggaagtgccccttggagaaggaagcatcggctttgttaatggtcccttaactagctcagaagtccaaagtttaaaagaggaactcagatcattattaaataacccctatgggactgcagatcaaattgatcaattcttagggccacagctgtatacttgggctgagtgaatgtccatcctgggcatcctcttttcaggggaagaaagaagcatgatccatagggccgctataatagtctgggaatgtgaacatccatccaaaacattcctgcagcagaccaaatatttccagcccaagaccctcaatgggatggtaacaatacagctcacccaagaaaagcctgaccctcttctgtggacttctgatgaaatccactaggttgagcagctaaaacacctacccatcgctattcctgtcttagcgctgccatccctagaaaaatcatttcaccttttcattaacgcaaacaagagggtgactttcagggtgcttactcaagaacatgggggtcaccaacaacctgtggccttcctatcaaaagtttaaacccagtaacctgtgggtggcccaaatttattcagtctattacagctactgccttaactgaagaaagcaggaagctaacctttgggggaaacttgatggtgagcacaccccttcaggttaggacaatcttaaatcaaaaggtaggaagatggcccaccaactcaagaattttaaagtgtgaagctcccttactaaagagagatgacttaacactaaccactgacagttcactcaacacaccaggtttcctgacagggaacccaaacctaaaagggcctaagtgtaagtgcttaaatttagttaattatcgcacagaggtcaggcctgatttaagggacccctttcaaaacaagacaacagctattcatagatggctcctcccaggtaattgaaggaaaaaaacataatgggtattcagtggtcgatggggaagctgtcgcagaagtcgagtcagaaagactgcccaataatcggtccgctcaaacatgtgaattgtttgcaataaatcaagccttagaacatttacaaaatcaagaaggaactatttatactaattccaagtatgccttcagggtagcccatacctttagaaaaatttggactaaacgaagtctcatcagtagcaagggccaagaccttgtccacagttaattaatcacccaggtactggataaccttcatttgccacctcccccccccccaaaaaaaaaaaagtattgtccatgtcccaggacatcaaaaaaaatctcttttaaaagacgagggaataacctcgcagaccaaagagccaaacaaactgctttttcctctgaaacatgcattttccaccaactcattgtctttctcccccaactgccattcccatcttcactcccgctgaaaaggagaaattaataaaaataggagccaaagaaaactcagaaggtaaatgggtgttaccagaccaaagagaaatgctaaccaaatctctcatgagggaggttttgtctcagctacatcaagaaacccactggggacctcaggctatgtgtgatgcagttcttaaagtctatggatgtataggaatttatactctagcaaaacaagttacagataattgtctaatatgtaagaaaactaataaaccctaagaaaaccaccccttggaggaagaaacccaagattaaggccactccgaagtatccaaattgattataccaaaatacccccaacaggccgcctaaagtatctactggtgatagtagatcaccttactcactgggtaaatgcaatttctttttcaagtgcaaccaccaacaatgtagttaagacactcatagaaaatgttatacccaagtttggattaatagaaaacattgattcagataatggaatccatttcactgcacatgacaatataaagctagcccagatattagaaataaagtgggaataccataccccctggcacccaccttcatcagaaagagtagaaagaatgaaccaaaccctaaaaagccatctaaccaaattagttttaaaaactcgattatcatggaccaagtgccttcctattgccttattaaaggtccgaactgtccctcagaaagaagttggcttatctccttgtgaaatgctgtataggctgccttactcacacttcactgttgacattcctacgtttgaaactaaaagtcagtttctcaagagctatgtacttggtctctcttccactttctcttccctcaaagctaaaggctttttagtacagatgccacccttggagttcccagcacatcagcatcagcctggggatgatgttctcatcagaagctggaaagaaggaaaactcaaaccagcttgggaaggaccctatctcgtgcttctaaccaccaagactgcagtccaaacaacaacaaaaaaatgcagacccatcataccccagtcaaaaaagcatcgccatcttcaaagtcatgcgctattgttccgagaccaattcctaccaagctaaagataaaaaaaaaaaagcttaaccctcttatagtgcctttttttctttcccctctctactgtcagacaattatcctttcctcacccagtaacaaaaccaaagtggccgtcgtagaggtaaaagatctaaaacaaacctaatcattgaaacagggtaccgagatgcaaatgcctggctgaaatggattaaatattctgtctgcactctaaacaaaaatgattgctatgcttgtgcgcacagcaggccaaaggcccagattgtcccctttccactcgaatggtcctccagtctaccaggcatgaactgtatggtagttcccttccaacacctcacatcctggggtaataagttatgccaagctccctctctgctattccctcaagtccagcaccctgcgggtcagcccccaagggccatcaagcttccatttccccatgccagttttacctcatgtctctcacaacacggggaaaacttggcatttcttggagacctaaagggatgcagtgagcttaagcccttccaggagcttactaatcagtctccccttattcatccccaagcaaatgtaggatggtattgtggtggactattactggatactctgccaagtaactggagcggcacttgcactctgatccaattggatatccctttcactctggcatttcatcaaccagaaaagataaaacatcgtaaaacaagagatgtccctcgtgggtcctttgactctcatgtttatatagacgccgttggagtcccacgaggggtacgaaatgaatttaaagcccgaaatcagataactgcagggtctgagtccatgttattctggtggtcaacaattaataaaaatgtagattggataaattatatctactataaccaacaacgatttgtcagttatactaggaatgccattaaaagaatagctcaacaattagggcctactagccaaatggtctgggaaaataggatggcgctaggtatgatattagcaaaaaaaaaagaggtggagtctgtgtcatgataggaacccagtgttgtaccttcatccctattagttgaaagacttattacaacagcccttactgaaactttcctgatttcttttccaccctagtttaacaaacttttacttctagacagtgaggaacagcaaagtcaggtcatgttaggtaagtttgaagaagaaagtgtgtaaattcaagaggggaaaattgttaggaacaaacagtttctcttcaaagggtttcaccccccttttcctttgttctattacataagtagtttttcctgcctttaacaggcccaggcatgcctccatccaccaaccttgtagctgacccatgccgccttactcgaagttgttaggttcaaacaatgaatttcctggttctttttccttttctaaatgctaaatctagtcagtcggaatcagtttagattgtgtggtcctaccctaattaactgggggaggacacagaaacaggaacggcattgggaataaaaacccctgctttcctttgtttggtgtgctcttgcgatcgtaactaacgcaggcagcacccttctgaaatttgccttgctgagaagtcttttgtttgagtgctcattttctttgcaactctgagctcttatttctaacacaaggcatcctcttgcctaattcttcaagcagctgggactacaggcatgtccagactgcaggatcttgaactcctggtctcaagcaatcctgctgtgacctcccaaagtgctgagattacaggcatgaatcatcatgcccagcctatttctacttttttgatgcaggtgtttattgccataaacctgcttaatactgcttttgctgtattccatagctttggtatgttgtgtttccattttcatttgtttcaagtttttaagtttccttctgaatttcttcattgttcaggagcatgttgtctaatttccatacgtttttgaagttcttgaggttctttttattgatatgtatttttattctttttgtggtcagaaaagatatttgatatgatttctatttttttttttatttgttcagactcatggcctatgataatggtccattctggagcatgttttatgtgctgataaaaagaatgtgtattctccagcagttgggtggaatgttctgtaaatgtcagttaggcctattaggtctagtttgtagtttaactccagtgtttctttgtttattttctgtctgggttatctgtccatttctgagagtagggtattaaagtctcctactattattgtattgcagtctatccccttggatgtattaatttttttatatatacttgggagctctgatgggtgaatatttataattgttatatcctcttgctgaattgactgactcctttatcatcatatagtgaccttctttgtcttttttttacagtctttgatttgtagtccactttatctgatagaagcatagttgctcctgagcttttttggtttccagttgcatgaaatatcttttccctcccttttaatgtatgtgtatcttaataggtgaagtgggtttcttgtagacagcatggaattgggtcttgtttctttctttgccttttaattggagaactgagtgcatttaccttcagtagtattattgataagtaaagactactgccattttgttgcttgttttctgattgtttcgtaactcttcctttcttgtggttaagagattttctctggtggtatgttttaatgtgttgctttttatttttagtgaatttgttataggtttttgcatcgtggttaccatgaggtttacaaaaaaataacaaattatcttaaagagttgacaacttatcttagatcacaaaagaatagaaacaaaggaaaatttgaaagaacttccacaatttaacttcatccctccctctaagaattcattagaggcttttaattgtctcagtttatctatttttatattatctgccacttaacaggttgttgtaactgttactgtttttgatagatttatcttttgggctttatataatactagagtcgtgagtggattgcataccacaattacaatagtaaagtattttgggttttttgtgtatacataattttaccagtgggttttacaccttcaaatgtttttttagtttgttttatttttcatggtagtgtttttttcttccagattgagtaattccttttagcattttttttgtaatatgagtcttgtggtggtgaattctcttagcttttgtttgtgtgggagtctttatctccccttcatatgtgaagggtaattttgctggacaaggatattcctggatggtagttttggtttttttctttgagcacattaaaaatgttcctgtcccttcctggcctgtatggtttccgttgagaagtctgttgtcatacaaggtagagcttctttatatgttatttgtttcttttctattgctgcttttaggatcctctctttgtctttgacttttcaaatttgattattatatgcctttgggtaatcttatttgggtcaaatgtgttttctgaccttcctgtactaggatatttacatttttctcaagttgtggaaagttttctattatttctttgaataagctttctacctcatgcttttgctcaactttctttgaacactaataattcttacattttttttttgaggtaattttctatatcttataggcaatctttgttgcttttcattcttttttctcctatgtgtgttttcatagcctgtctctgagcctaatgattgtttactctgcttgatcctctcttatgtcaagagcctctaatgaatcagttcagcaagtgtatttctcagttccaagatttctgtttgatttttttcttttcttttcttttggtgttatgacttggataattttaaaaaattactttaatctctttttaaaatttcctgataaatttctgaattgcatttctgtgttatcttggagatcactgagttttcttaaaaatactactttgaatattggtcagagagctcatagatcactatctcattagtgtcagttattggttccttgctttgtccatttggggagatcatgggtacctgttttctgttgtttgttgtggctgttttattcagccttctctgtctggcttgttttggtttttactggatgtatttgcttagaagttctttactgttaggttgctgcctcctttttagctctctctagttaccttaagcccaggttcacctaggttctagtaaagaaccagagcactgttcttcccgaatgagggagattccaaaggggatgtcccagtagtgtgggaatgctggctaggagttcctgcccaggggacctgtacaataaaccttctacagatggtgttgatgaacatctaatgaacatctactctgattcagtgtcttgcttggctgagttacagtagaatttccagagctggagatggtagtcttgcctcccttttttgtttctgcctatccgcagggatatttttcccttctggcatttgagatgcatcctgtgggctaagataagggacagtctcctgccagagaacattagatgatggggaagcatgagttatatctcagtctcactttttccagtgtagaaacagtgagttgtgggaaaattttttgcccattaggtgctggccagaatgaggggagggacatcatggatgtggaagtccaattctttcaccatctgctagaattcttttttttttttttaacttttctgtggcccctgaactgtcgcatcttcatatgagttctgggatattcctggtaataacatcggctctgtatatttgtttttggttttctgtgagaggagtgaagccagcttgcttctgtgctgacattttggaactggaaatcctcttgattaatttttgtatgttgatttattctatattccaggaataaatcccaatcccactgggtcatggtgtgtaatccttttaatatgctgtcaatctgatttgctagtattttattgaggatttttgtatcactgttcatgaaggatattggtctgtagttttcttttctagtactatctttggccttggtatttggtagcgctggcttaatgaaatgagtttaggagtgagtagtccctcctccttaattttttggaaaagtttgagaaggattggcattaatttttctttaaatggttggcagaattcaccagtgaagccttcaggtccaggacttttctttgttgaaagatttttgattacttattcagtgtctctgctaattatagatctatttagattttctctttcttcatggtttagtcttgataggttttgtgtttctaggagttttccatttcatttaggttatctagtttgttggcatttacttgctctatataggactctgttatcctatttatttctctagaattgattgaaatgttctcactttcatttctgattttagtaatttgagtcttctttctctcttaattccatatagttaaaggtttgtgtttttgtttatttaaagaaacaacttttggtttcattaagttttttcttctgtttctctgttctctattttgtgtatctctgccctcatctttattatttttttcctcctgctaaccttgtgtttcgtttgttcttgttttactagttccttaagttttagactaggttcttgatttgagatctttcttgttttgtaatgtaagcatttagagctatacatttactccttagcactgctttcactttataccataaattttgttatgttgtgtttttgtgttcattcatatgtaaatatcttctaatttcctttttgatttcttctttgattcattgcttgtgtaagagtgtgtttaatttccacaaattggtgaattttccagttttccttctattactgatttctgacttcatccagttgtagctggagatgatagttcatgtgctatatctatcttttcaaatggattgacattctgtatggtgtctcacagatcccttaggctgtattcacttttcacttaaatctttttcctctgttgttcacattgagtctttagtgttattgtattttcagttctgtcatttccatatagttctttgtgtcttgtatttctttgcttagactttctatttctttgctgtgagtttttattatttcatttgtttcatgtatatttgtaattgttcattaattttttatatgacgcctactttaaactctgttaggtaagtctaacatctgtggtgtcttgatgttggcatctcctgattgtctttttatattcagtttgagatattcctggttctcagtgattttcaagggaaacttcgacattttttgtattatgagacgctagatcttatttaaaccctgtgttttggctcattttctctgacgctgctctgacagtgaaaggtggggcactgcttccttactgcttagtggaggtaaaagtcaggtttctcacactgcttccttccacacctaagagagaatactcctcactcctgttgggatagggtgttagttatagttccccatgtggtcttcactaacactgcatggggtagaagcttttgttaccagtggatttggatgcaagtctaggcttcccacgtgtctgcttttggaatcaagacagtactaaaacttcataaaatcagttgagaactgctgggtgccagtgggagttccagctccccgttagttctccattaatactggctagaagttggaatgcctcattactgctcctcatgtgacagtatgtagaagtagggttgtgcaccttgttactgctggatagtggggaaaatcccgtctcctgactatacctcttctaacattccctctacccccggccagtggagagggctgtctctttattgctggatgggaacaaatgtcccagctccttaattggccttctctgacccagccccagttggggaagatggttgggacaccttgttacagcctcatgagagtggaattctaggctacctgctggtctttgctggtgtgtatatggttggtgacagagtttttttctgtggtgtttagctggaatagagcagttgtcatctaaaagttgtatcttgctaggctgcccctttctgttcctgtggcaacaaaagcctaaaagagcttctattggtgtctctcttttttggcacaaggtaggtctgtaccattggcgtttctgggttgctcatttcttcagctgaaatcctgggatagtctgaggtaaaaaagaaaactcagggactgactgccgtgtcttccttagggttctacattcctagctagtctgccaccctcttttcacctttcagtcttatttttgttttatatataatggccaaagattttagttgtatgtagcatgtggcataggaaagtgtctacgctctctttcaattggaagccctcattgtctttaaaagatatgtttatcttttttttctagttgttatggtacaagccattgtctgtgtgaccttccacattctgatctgagcaggagctcccagacgctagttattgtgggttgtttttgttttttgcactcttaaattttagtcaattaaatgactgcctgtttgttctccagtatgtaaattaaataacctttcctaattcatagtttggtagtaacagaattcattatggacagcaaatgatgtttgaataaaataatatatttattttgaaagatgaatattcttgaataaaacagcaaatgttaacagctaaagtatacttagcatttgttgatctgcttcctggtaagatttcttcccccatctgattatagattgtctaccacctccgttacttggtaaaactgtgaaaatcgacttttcttgactttggttctgcagctgtagctttcccctgtccccctttagggacaacccacctttgaaactaggtctagtgctagtggagagaggtaatgtgattgggcgttgagtcccataaacactgagctgagtagtttggactttatcccataggcaatgtagggccagccaaatgatcattttgaacagtagttcaaataaagttgttaatattcacacagtgtttgatggtctttattttatcttgtaggtcacctgatgtattttttttcagcgtgaagaacttctttaacatttcttgaaatgcatttcttctggtgatgaattctctcagctgttgtttacttgaaagaagtatttttattttgtcttttttttaatttttgagacaggatctcactctgttgcccaggatggagtgcagtggtgccatctcagctcactggaaccttttcctcccaggcttaagtgatcctcctgcttcagcctcccaagtagctggaactacaggcatgccccaccacacccagctgattttttactttttgtagagacgggatttcgccatgttgctcatgccactcttgaactcctggtctcaagcagtctgcctaccttgggctcccagagtactgggattacaggcatgagccaccatgactagcctgcctttatttttgaatgatagttttgatgaaaaaaattctgggttgacaggttttttttcccagcacgtttaaaacctcattccatttggtatgtttttattggttccatttctgtcatgatattcatgttttcctttaagtccttgagcatacttaagttttatgagtgtttttgagtttttatctgctaattctgtcattttgcatttctaagtctattatgaactggctttcctcctctgatggctcacagttttctgcttctttgcatatctggttatttttcattggatcccagacattgtgaatgtaattgagtgttcctaagtactgttttctctggaaaatactgttgtttgttttggaaggcaattaagtcatttgcagataaggttgatcagttcaagactttttaaagctttttaaaagttggatctcaagtagccttttctttaaggccagcttagccttaatgctaaggcttgactgtctaggagtgtccactgattactacaagtgtttattgaggcccctctgctctgtataagtttgaacactcctcagcttactgtgagctctgaagcttgtttataagtcccttacagttttatttgcctggccttgttgaattttatgctgttcacgtgttgattagtattcagactgaagtctcaagggtactcactatttgatttctggagctctttttctgcttagccttcttctttccagtattctgccttgcacattccagtgcttccgtctccttgaacaccagtcttgatttttgtcaacccagtaagatggctgtattggcttgggtttctccatcatgtgtcaagttccaaaaaatggcctccaggcaggaagccaggaagatcgtagagctcactttgttttccttctctcaggtattgtagtcctgtactgcttgttgtccagtgctgaaaactgttgtggcatgtattttttttctagttttctagttgttttaaggcagaaggtcaagttctgtaccagttaacttcttcatggcctgacgtagaagttttttcatattttgtttatttagatcctgtttaatttcacaatagatttaagctggttactctggaatagaaactactacttcagtagtttccttaaaaaacataacttttgacgtgactttttgggatgagggagatacaatgtatgttcattgtagagtttagaaatacacaaaaatgaacctaagtctcatgtaaactcagactccatatcttacctctattaacatttttctgtgttctagtcatttttctgtgattatatatataaccccttttatacataattacggggcataaacagacatacagccctctttctttgttcccccagtttgtattgtgtttttgtttgtttgttttgctaaaaggcaaaattttagtccaaggttagtttttcatgttattacatgttctttaaaactatgcttgtctgtccatattataatggcagtttaagatttcacaacaggaatatatcatcatttatttagagaatgtgggattgattagacatttttattcttttcaaaagtaagatctccagtcagttaaaactctactcctaaattcatccattatactttttggaaatgttttgtccttgttttatccatttcctcctccctgagaaaagcattctgcattgaaattttacactcaatttggtttgagaactgtgctttgcttttcttaattggatcatctggggttgtaagcctgtctgtgtattagaactggacagggagctcgttaaaaataaagatcgttaggcttaaattagactaaatacctgggaatcttctttggatatctcaccatttgggaaccactgttcaaaaccttatctctggtattctaggtttccttaaagactgtgtgttgattggcttagtaggacataagatgagactcattggcgctcagccacagcctctttgtgttcatctatttcgttttttggggacttccacctaagatgctgtttcaaagaagttttatgctagaagcaaatgtgtttaccatggatattgtttatcagagctccgcttccagtgtataatggatggatttctttagtttccttgaacatggagaagcctgaagcaaactgtatgagataggagtcatggcttgtagaagcttacataaaacctttaaggctgggcacggtggcttacgcctgtaatcccagcactttgggaagctgaggtgggcagatcacttgaggtcaggagttcaagaccagcctggccaatatggtgaaaccccgtctctactaaaaatacaaaaattagccaggcatggtggctcacacctgtaatcccagcactttgggaggccaaggtgggcagatcacccaaggtcaggggtttgagtccaacctggccaacatggtgaaaccccgtctctaccaaaaatacaaaaaagccgggcatcgtggtgcgcacctgtaatcccagctacttgggagactgaggcaggagaattgcttgaacctgcgacgtggaggttgcagtgagctgagatcccaccactgcacaccagcctgggcgatggagctagactctgtctcaaaaaaagaatttaagtttttaaaaaaccttccaatagaagtagttgaaaaatgatagttgctacttttacttggcagttcttctaatccatgaatatggaccatctatttatttaaatcatctttaatttctattaataatgcgtttataactttcagtgtatgagtattgcacttttattacatttattactaaattttttatgcttttaaatgtttttgtgcatggaattattttcttaattttgttttcagattattcattatatgtaatcataatttttttattttactcttgtatcctgcagttttaagttttctgacgattccttccttaggattttctacatattttgtaattacttcttcctttccagtcagttatgctttttatttttcttgcctgattacactggttagaatgtccagtacagttttgaataggaataatgagagtgtaaatccttctttgtttctggtcttaaggagaaagcatcgtctttcaccattaattatggtgttaaatgtaggttttttgtaggtgccccttatcatgaatagttgttggattttgtcacgtgctttttctgtggagatacttagtagttctcaaatttggcacaaggaagcttttcatagttttttttttttttctgccagatagatggtaattttaggatcaactgtgcgttgcatatcatgtagccttaaatgagaaccacggcagataatttaataccatttgttgaacaaatattcatgaagtgcctgcaggatgcatttctaacaagttcatttgcttctgatgaatgttcaagatttggatctagtaggttagaggtcagagtttcagacccatgataacaaagttttgtttcctccatgaatttattttttaaatggttttaaatatttaagcatagagctataaacctaatactgagcccagttccagctttttctaaaataatagttttctttttgttaccatgagcagtatcattagcatggctcttcttgcacctttttttttttttttttttaagagacaaggtctctgtcatccatgctggagtacagtggcgtgatcatagctcactgcagccagaactcctgtgctcagttgtcttcccccctcagcctcccaaagtgctgggattacaggagtgagccaccatgcctggtcttctttcacatttttatcacccattactatgacagaacagtgccactcagagtagagtggcaatccaaatagctgttttttgtgctcaaatttaggtgattgagattataccaggtttccttttagaacagatttataaatagtaatacacaaagcaaattatttgcatgaatttgttggtgttcctctgattcttatgctctccattgtgaccatgtacattgcggtttcatggtatgatttgtatcttacaggtttgccccattattgaaattgtatgtagtcacagtttaatttgttcatttcttctaattggctgtcttcaactgtgaaagcagctgaaattctgtggttaattgaaatcagtcaaggtagtgcagtttgatcaagagtgaatgttactgcatttgatttgacattaattttaattttcattcaacattttatttggcagagtagcattttagtggtttttgttttttggtttttgttgttttgttttttgttgtttttttttttttaacagggtctggttctcttccccaggctggaatacagtggtgcaatcttgactcactgcaaccttcacctcccagactcaagccaactcccacctcagccccccgagtagctgggactacaggcgcctgccaccatgcctggctaatttttgtattttttgtagagacagggtttcgctctgttgcccaagctggtcttgaattcctgagcttaagcgacccgcccgctcggcctcccaaagtgttgggattataggtgtaagaccacacctggctgtatgttagtattcttacaacaaaatgtaatcagttgtatggtatttttgctaaatcaactttgtaagcctacttataacagaaatgtccacattattgtgggctattctttgccagacaaattgatggcaaattcataggtatctaatgtcactgcttaattcctgccgtttcaaaaagacagcaaataagcaaaccacagcattaattcttcacgtaatttaagaaaaatagtgtttctctaactccattaatcatttaaatcccatatggttctcttacagcagtgtgatctagctgcatttcttcactgttaagaactgttaggcgcttctgttggagatagtttctaatgttgaaattatcagtgaatgttcattaattcttcatgttgaagctgtcaccatggaaacttaggtgttatagcaactagttatatgctataacttacttagcattaagatgattaaataacatactatatgtaaagcagttggaagaatcatggaaagcaatgtcatttcttagcagatactactatcattttattcttgttttttggcaagtgtgaaaattaaattcaaatattctttaagatgtatacttctggtcttgagatgtaacatcactttgtgatcttacctaagtcctctgctctgtaggaattacaattgtttacataaagatgctattactatctttggtatgaaactcaaatatttatcaatagatttaccatgatgttttgaaaatcagtgggattggggacagtgacatgtcaaaatcatctaggaattaaaaaagaaaagcacaacactgcttatttaaacactgctggtctacaagtttagcttcttttggacttaaaaaatttgttagcttacccttgttttatgatagtaacaataactcagcatttgtttgataatgagttaatatataatgaaaaaatttcatgactaaatagttggatgtttttactatattgtttgatctccagttaatgtgacaggtgaaggagtttggttgggtgttgctcttgtattttaacccttttataagatttcagttgacagtgaaattttaaacatggaactgtaatatgtaatataggtagtatttattaccatatatttacttaataaattcatatttacatttgtttattatataaatctaaacaggcagttttgagtagtgcaaacattttgataacattaatctcagcatctttttttccctctattttgttatacagtactgagaaaaatccaatttaaacagattagtaattgaaaactgttttaaagcttgcctgatagccttaaattgtcattctagcaggtagaaagaatagtaaggactttggacttgactcgccaaatatctaaccttggcttgcatttattaattgttgaaaatgagctttgtagtcagacatgattcccatttctgctagctgtgacaccatggataaattatgtgactcctccaagccttgagtttctctcatttatcaaatggacgttataatactttttacctcgtaagaggtagatcatatttggattaagtaaggtaattacatgtgttaaagtatatccaaataatcatatttggattaagtaaggcgattacgcttgttaaggtatgattttcaaaaaagcaaagttcttaggcaaatgtagaatgaacatgtgtcacagattgtattccactcacttgttaatgagagaaatagtaagatgttaaacttgaccagagtgcatttgttatctaagtatttataggcaatgttaatagaagattgctgagttagataagaaactgattaatatccaacgaggccaggaatttaatctttgtggttatctgggcaaaaattatttgcttctctattgaataaaaagctacaggttaacatatataacttcactgtctaggactttttttttttttttttttttaagagacaggctgtcactctgtcacccaggctggagtgcagtggctcaatcatagctcaagcagtggctcaagggctcaagtgatctttccacctcagcctcccaagtatttatttatattttttttagagatggactcttgctgtgttgactaggctggtctcgaacttctggcctcaagtaatcctcccactttgacctcctaaagtgctgggatgggacttctagtaaatagtgtgttaaagtgtgcattcccctaaattagaatttctcaatttaggcatccttgatttttgggctagatcattctttgttgtggaaagctgtccagtgtgttgttataaaatgtttagtagcatccctggcttctacccactagatgcccgtagactcttttcctcgattgggcagcagacattgccaggtgtccctgggggcgcaaagttgttccatgttgaaaaccattgccctggataatcttgaacaacctttgtctctatacagcattgaacgtactaccaatttttttgcctctttttccaagcttttgataatttttctgacacatgaaagcactttgcagaatgcctgactagtagtaattattaaatgacaattgctactgttaataattatttattattattacttaaatattgtttcttaggtagtttgataggtactatttggctgaatgtatctgggatattgatttgttagataacatcattaaaaagcagaacagcctaagacactttagtgcaaatctatcagatccactcagagtttcaaaatagtcaaaattagtcatttttcctggtaggtcccaaaatcaaatgcatgttttttatactgtcttctgcagttttaggtatggtaaattttgacccaaaatgtatacgttgaactcattcattcagtttactaaaaaaacagacaagaaacactggttaattcctagtaatcattaaaatgatcatagcacaatattatcatagttgaatatattacatgtttattgtgtaaccaactgaataaggcagactgtattaagagcacaggctaagtggacatgcttgaactttgcctgacattttgttctattagacatgtgccaaataatgtgcttgcttatatagttttaggggagcagacatgtctgcacagaactgaattttattaagactcagcgtgtacaacctacatgatcaatgagacaaatcctccatgtgcacaaaaattggagaagttgtattttgagattgacacaaaatgagtttacttggtagtatggataaataaattgttatagataaacaccagtattaaaacttgttacacatttgtgcttccaggtttttaaaattaaaatttgtaaatttgaaaatgaaagttttaaaatgaaagaacattggtgacacctctgaggcactgcagtgaaaaaggctgagaaccacagcttaacaactatggctctgacttagtaaatgtatttttaaatataaaggcttctaaggagcacagtttactttttcttgccctagttacagttgacatttgacttttcatttaagttccacaagtcatgtgatttgcagttatttacctgtcagggtaattagattggagaaccagctatttcctttactgttttagaaatgtaacctagttttttctctctctcaccccttatacaattacataagtaggaatggaacagaatagagaattgtgtaggaaattggaattaaaagtgttcttgagcaggtttggaattagagttatggttggtggtaagggaatttttgtcttttggcacgctgtttctggtgtatagcaaaatatagtatacttttccacaaacagctttgcttactaagcatacagagaccaggctgttgagtacaaatatatgaattgataattttagttttgtaaaattgttcttgtttttgttttttgtttttttggtttttttttgagatggagtctcactctgtcgcccaggctggagtgcagtggcgcaatctcggttcactgcaacttccatctcccagtttcaagctattctcctgccccagtcccccaagtagctgggactacaggtgcgtaccaccacgcctggctaatttttttgtgtttttactagagacagggtttcaccatgttggccaggctggtctcgaactcctgaccctcagatgatccacccacctcggccacctgaagtgctgggattacaggcagttttgtaaaagttgacagtcttcattagcaattatatttcttaactgcaatatagatgtagtacttagaacaacccaaataatagtggaagaaagaaaagataattacatagatgaagcagtaaatattcctttgtgtgttatttagtattttactggcatttgttaattcagcttttgagtttcaataaatactgtccatttaaattatagcgaaggtactgcataagatgtaacatctgtgtgcaagattttaaatataaaatactgtaagaatgacattttcacagtattttatttgttgctttgaatgtaattagttaatgatagcttttctgccaaagggttgattaaaaagccaaagcacagaaaataatatttgaaagagtggataaatcagtgatatgtcggtgagttaaactgcttgactttctgcttttaaactttccatatggtatagatatacatcaaaattggttcagtaatgtttttccagattttaagtgattttgatgtattagaaaatactgaactttttttactgtccaagtttaatttgtaattattctacttaactttgccagatgattgatttttgttgttgttgcttgaattgtttatagagaggaatcaaactacaaaatgtgataattgaggtactctttttaccattaaaactatattttaaatcagactacagtgtttagtggtgtagtaagaaagcatcacatatgacaagctctgggctcatctcttattgaaccgtgtaatgaatcccttgctgcaacatctttgcccctcccccaaagcagccagcatatatttgagcatagtggctctgctcgagttgtatcttattctcatggaggagatagcagagcttgtactgcagcaagtggagctctgtggtgaatccgatgctggattacattttaaggatattagcaaggccctgacaaagtggtgctaaatgagcactttcattctggtaatttgactataattttagtgaagcagttttattatgcaggaaaaagaaacagcattttaattccaatcatagtataccgacctgatctctgctgtgggggtggaaacaatgaagaatgcaacattttaatacaattttttttaaaaagaatgctttggatctagattaaatgttcaagacagtcagcaaacaacatgcacaaaggcatttttctggaatttcagtcttggatcgatttaaatgctcagggtctgaaaaaatgtctcctagcatcaaaaacttggattgcttttctccgatgttatgccactgtaaagtagcatgctccaacagcacaatatccttaatgtttggatgtaaggtgggtttgaataatacttccttaaaaagcttggttttaaaatccaatagtatttcagcaaagaaatgtaatttaggttagatggtttgattgactttaattcatgtaatagattcctgtcctttgtgtgtctgacatgagtaaagaattggtctgtgcacagttaagatatagtagaaaaggatctgatttttatgaaagctgcatgtaaaatgtcattttccattaatgaggattaattattgacttggtttttatgtgttgctactgtggagaattaagtgtacaggaaacaccattgatacgcaggactggagatggtttctgacatcactttgatggaagaaactgcttgtggcagttttaatatttaaactaatgccatagactttgattttgatactaaattgtgttgctatttagattgtatagaggaaagaaagcttttgaacaaaataaacaccaaaagaaccatgactttactactcatttcctataaatgaaactggttaatttagtaatgtgttctatataaataaaatgaatgtagtttgccttaaagatggttattcttatataaaatattagatggaacaaagagcgggtgcatttttacctgatttctgcaatcaaaaacaacatatgctgaggcaggtagatcatgaggtcaggagatcgagaccgtcctggttaacacggtgaaaccccgtctctactaaaaagtacaaaaaaattagctgggtgcggtggcgggtgcctgtagtcccagctacttggggggctgaggcaggagaatggcgtgaacccaggaggcggagcttgcagtgagccaagatcgcgccactgcactccggcctgggccacagagcgagactccatctcaacaacagcaacaataaaaacaacatgtggtttaaagctatttgtaggaagagagccctctaacgtagtatttgggggaataattacttattttgaggtattgttttgaatcgaacttttttttctttttagtttttgtatgactgaaacttttcaattgctgatgtgaagaggtctcaaattgctagctgattaaattaggctgaaaggttgttaaagaatatattgcttttctggtcacccaagcatttttccctctttacattaagttctttgttttgtcagagaattcttattttcctactgagatttcagaaattttctgaaataggaaatggaaatgattgcacaagaaaaagtatgctgctgatagaaacagatttttaacaaatttaacattcgtattggttgttaaactatgagccagtaaaaaattcatatgcattgtttaaatagctaaggctacatttttttcccctaggtgttaagcctgttttttcatgtggtatgtacaacagagtgttttaggaaaaggattttaaattttttaaggaatatttttataaagctaatcactgtaaaaaatgttcctccttatatgtaggtaaattaaacatcttatgtatataagatgtttcaaaatactattattataaaaggttttaagaagtaacatggcattgctcatgactagtctgatagtcttggtggactttaaagtcctcccctatcctccactcctttaaaccactttggatgctgttaaattcattgcacagcaccacttgaggttcttggttgccctctggtgggaaaatgaagaaaatattgtattgaaaatgtcacataacttggtaattaaagatagttaaaagggcatctaagttatatgtttacaatttaggaaatcattagatactttaatttaggaaataaaaagaagtgggttattttggggcttaaccatttgtggatagagtttttaaaaattgttttccaaaatgtttgaattttatggcaggtagtactgacaagagacgtgtagaaatatagtttctaagactacagcatcctagtcacatttttcattagtgtattttgatagatgcaaaatttattaaggctttgtggtgaaactgacaagtaaattaattaaaaattttaatatgtgattaaagaagaatacacattgggaattataccagaattatcccacaacttctagttaaaacatttcagaaatggcttgagacaataagggtaaacacatctttctttccagtgtataaactaataccagtattgcctgtgcaaaaagtttattttctaacagtacttctaatgtcaattaataactgtttacttccttaatttgtatgtaaacaacaagtaatcttactatgtaaattccaaatcacatttaaaactaagctgaatattttcatttatggcaatgagcttttgaaaaggaataaaaacaccaccttgtttgttggaaattaagtatctttaaaaagtcagttttctatgggactagagtttacctcttaaccattctgttctttatgagacatttatccaagaaggttacagtaatagattatcatgaagaagcaatatgtttactatagaatcttggaagtccccatgtgtgtcagagtgagagtgtgcatgcgtgtgtataattggagcagtatcagcaaaacatgagttaatttctggtgtcagtctctgtggaaagaagcctgtttaatctctcatgtctcgcgttagaactcagagaaaggacctttgggaatgtgaggagaatgcagaggacattcaagttcttaatgtagagactatgaagctgtttaggaggcagttctttaggggtggatgtgaacagaaattagcaaaatcatagtgcctctgaaggtatgccaactctgtagtgtagaattagctatttcaaaatagtaggcacagtgaggccggagcctaaggtccctaggaggaaatgaggtatgtgacgatcagaaacttatattttgtgaagctagttaaagttgtttgtttttttgtagtatcaagctcttgaaagttcttgcctttactaactgccctaagagaagccgtcagaatgctttttgtaataaagcattaaagtatgtttggtgacagcagtaattgaagtgagagaatcccagagggaaggcagaacacccagtataaagtcaggagtgtttttttgggtgtcttctctctgcagggaaatagtgtaaggtgttaaagccttggcgattctattttattggaaaaggtactgttcccacttagctgtgtttcttggccagggatacaagtagcttcagggacttgttcgtatctccttgctatgttgcttcatattcttaatgatttgttttttgctgttaagagataattgggtggaaaacgagaagacctatcttacaattacatcattttccccactacccaccccacttctccctgggtgaaatatgcttaagatatttgcaaataataaatactaaactaacaatgactttaaacaaatggacccctattttttcctcattatagtcagcttggaaatatgcagctgctacagctgtggacatcttttttcttgggctttgcttcattgaaagatgtctgttgcagctctagtcataaagacggggaaagggtggaaaggggaaaggagtgtggtttatgaagctagtagatgtctgcgtatatttcattgattaaaactgtgtcacacggactctcctagtagtaagggagagttggaaacctaactgcagtcagctgttcgtatccatggttctgcatctgtggattcaaccgactgtggatcagaattcgggggaaaaattgtgtttgtactgaacgtatacagacattttttcttgtcatttttccctgagcaatacattataacaactatttacatagcattaacattgtactaggcaatgtaagtactctagagatgatttaaagtatatgggaggatgtacataggttatgtgcaaatactacatacaccactttatatcaggggacttgagtatcttcagattttggtctctttgggaggtcctggaacgtgtcccccacagataccaaaggatgactgtacagtatttagcttttatagcctctatattaaacaaaagcagggaaaacagattgtagtgttgggcaaagcaatctacagtgtctgacctaatgcatacaggcagtatttttactgaagtcggattaattttagaacttgtcaagtaatgtgtctgtttagctgagataaagcagaaaagtgcaactgaggctctctcttcacacatctagttggtaaaatgtctacataaaggttgaaacatagctttattgagtgtttgcttcctgttatgtttcttttttttttttccttttctttttgagatggagtctcactctgtcacccaggctggagtgcagtggtgcagcctcggctcggttcactgcaacctccacctcccggattcaagtgattttcccacgtcagcctcccgagtagctgggattacaggcgcccgccaccacactcggctcattttttgtatgtttagtagagatggggtttcaatcaagttggccaggctggtctcgaactcctgacctcaggtgatccacccgccttgttctctcaaagtgctgggattacaggcgtgagccaccacgcccggtccctgttatgtttctttatccttctcacttctttgttccagccttcagaagcaaaagtaaatattgcaaaagagctaccattacactcaagtaaaaggagtatgcccctttgcttttagggtatggtatgtggtatgtaaggtttccttgaaacagttcactgagcactaataggtaacttaagatattcttatttaagaatactgtttcaaaaagatttcaaattgaaaaatactgtgtaataaataatgatcaatagcagtttgcttgttagaattggattagaataatttttaacagtaattaaggttaaatgccttttgatattaaaagcacagccctcctctagtatcttccttcttctaagatgaaatgtactttctcatttctgtgctaccaaacctttacattgagccagtatctttagggtactgttctattttaaagtccctttttattgacttcatggtttctccaaaggaaaaacagtattcttcagtgactatgggactctagctagttcctcagtctttcaggatggtgtattaaactcctttctttttctgctggataggtggggtacaaagaaaaaagtccaaaaactcctttcttaaactgaatgaattaaataattttttcatatattgggaaatagtttctattagcatttgctgatagcagtggccccataatatgtctgcagctagaaatagttgattattgttctcctatatccatttagaactacactgtgatatatattattagccttttctttgaaaatctagtacattacattttggaatgtaatttttcttcctttaagaatgtacttatttttgaaattttctttttcacactttatatacttataaaattttctttttataaatggaaagtcgtacgttttaaaagaacattttattttaaaacaaataccacttggtttaaatatataacattgaagcagtgaaatcatttcaggaagttaaaatagggtatgtgtctttctaatttttatgaagaaaattattgattaatttattcattgattcattctctcagtaattaagcacctgtgcactaggtatatagcagtaaacaaaggaaatctgcccgtaaggcatttatgtactaatcatgttacctagtgtaacttttctcttattaatttagaaattctgtcagtggagacgatggaataaaactttttagagtattaaattctacagtgtacatagtaatgttttttaaagctctgtattagttggctagggctgccataacaaaaactgcagatttattggttggcttagacagcaaatttaatttctcagtgttctggaggctgaaagtccaagctcaaagtgccggcgagatttcccaaggcctttcctctgtgcatggtgagatttcccctgaggcctttcccctcagcttgcagatggccaccttcttactgcctcttcacgtggcctttcctccgtgcatgcatatccccgctgtgtctctcagtgtgtccaaatttccttcttttgtaaggaaaccagtcagattggactaccacaccctaatggccacatcttaatcacctttttgaagtccttgtcttcgaataaagatacattctgaggtactagaagttaggacttcagtatgtgaattttggtggggagggcgggggacataattcagccagggcttattagtaaagggagagccagggctttaagttgacaagcatgtgaaagaggttttgaatctaggctttgatgatatatcacatttttgtaaaacattttatttataaagttcactgagcattcgtaaattaggtttgaacaaatcctatcatcaagggagattgccaagtgaataagtaaaggtgatgtggtttaagaatattcaatgtttaaattacttgaattttcagattaagaaagtcattgtagcctctgcttctcaatttggccaccctatgcctatttgctactaccaaagaagaaacatcttgagcatgtgtttgagaatagaggataggtaagaggacagtgaacgttttggtaatctgagttttaatttcttttttttttcttctttttttttgagtccaagtgtcactcttgtcgcccaggctggagtgcagtggcgcatctcggcccaccgcaacctctgcctcctgggttcaagcgattctcctgcctcagccttccggagtagctgggattacagtcatgcaccaccatgcctggctaattttgtatttttactagagacgggtttctccatgttggtcaggctggacttgaattcccgacctcaggtgatccgcccgcctcggcttcccaaagtgctgggcttacaggcgtgagccatcgcacccggccgagttttaatttcaaaatgcatctgtgtgtgtttgatgactacctgtgtttgaattaatataggtctaaggtatgttgtgttaagtgggctttttatgggttggctttaggaacctagtcataatttacattgttattttaaattgttccaaacaagcaaaaattactgattttttgaatatagcctatccatcaatagggaacggtctctgtaaaaacatctcagacagcaggagaagttatagttcctgattgcttattagtcttgcagaagtagaaaataataacttgtttgatagtacgttttaaggaatgaagcagttgactgtgttttcctggacttacggtccaagagtgggtttgttctgacagtatagctgtgttttttaagaaaatgagtctattttaagctgtctttggcacttgctggagataaagtacataaaaaagaaaccttcccttgaagttcatagccattaagagatgtgataagcaaaccactgggaactcctggcagaagcctttttttaggcttcctcattggttttagagaaaagagcaatccatatttgacatatttcacaaatttgaaatgtaaattatgatgattataaatttcatcatgctcttttcatcgtttttgtaagtgttggatatttgctatacagactgcctcgaacacttctcttagctgacagttacttaacccacagtatctagaagattgttcatcattctttgtcactttttatcttacattgctgttctttttatttttaaataattgaagttgtttgtaaataacagaagaataaaggagtaatgaaaaatctttgttagaaattttaattagaatctaaacatagcaaacccaatttttaaaatcagcattactgggatataattcacatataataaactacacatattaaaaaagtacagcgtctttaagtgttgacatctgtgtacacctgtgaaaccatcactataatcaagatggtaaatgtatccatcacttgaaaaaattttccaaagctgcttttcagtccctccctcctgtccttccctgttctcttctctcccagacaactactggtttgatttttgtcattatagattagtttgcatttctagagttttatataaatggagccataaaatatgttctatttttaagtctggctcctttcaaattattttgagattcatctgtgtccttgcctgtatcagtatttccttccttttaattgttgagtattattccattgtatgtttataacacatttgtttgtgaagatgtttgtacccaaaatgtgtggtattctttgaatgtaaataaccactcatcagctgccctacatgaacatgaaatatatatccattttgtacatactgattccaaattttaataggttttgttttttcacttgaaatcaaaacatagtttacaaacttcgatggttcataatcttgaagtagggaggacattcattgttcttgatccataattggaaagcatttcattttctgattaatcaacaccaattagaatgatcagtccatttaattctttatttttgtatcatctgtttcctttcatccacctttgtgtacttatctaccttcaacagttgtcagcttacggacaaattatggtgtatcactataaaaaacgagagcatactctcacatatactcttaggatactgggatggtccaagttcttgtcacaaaaaattgcatgattaagtcctgtttaatgactaagtggatgaaaatgctacatttcctttaaacctaagttgttcactcatctattcttgaatttgagaaaattcatttagaatattgtcatgtgaagacttgtctccgatgttacttctacaattaaattcgccattgtcattaatctacagtgttgctatctttattttcattcatattttgatcagctagtagttgtaaaatatctctctgtcagttttcttctctttgccattaatggtggtgttcacaaaaaagttaacataacctaaactgctctctttgaaaaggccagcttgtaaggttggctgttgactagtgtctggaaacttagatttcagaaggattcctaccactagctgatcaagtcgcttactgtgcctaaactgtttatacaaaatactatttctgccgaatacctccttctgggagtctgaaattttgtcatgtgctaggtgcctatgtgaccagcccacagtgaaaaccctgggtcctgagtctctaacagtctttcatggtagacagcatttcacatgtattgtcacaacttgttggtgggtgaattcaggaaatcttatgtgactccattgggagaggattctggaaagtagctcccagtttcccccagactgccccatgtgccttttttctttgctgatttttgctttgtagcctttcgtcgtaataaatcatatctgtgaatatgactcactctcataagtcctgccagcaaatcattgaatctgggaataatcttgggaatctttcaacgcaggccaaaagttaaaatttttgaattcttaactgtgttcagcaaaagcttaagtaaaaaaaaggagagacttaccaagttggtgtctgaaggatgatggaatagtgatgatttatttccagatagaatgaattttattcatatgtaaaaaagtaaattttctctttgttatatgaaatatcttaagaaagagtaacaatattggaaaagcaatctttaaaatatttagaattgcttttaattaccaccctctgccccataaaaactagaattgggttcagtgaaccctagtggtatacaaaagtttgacagagtatggtttcttggtcatttgcatggcatttaaaatttgcctttattcaatattgagtagatacaaactaataggtataaaatatatgtaggtataaagaattgctacataatattaaaaataataaaagagtaatacctgtttccttagaagtcccctgtttgctctcctcagattctttgtcattccttcccaactcagtaataattctgaattctatatttggtattccttgcttttttaaaaaacaattcctgaacaataaattgttgattttgtatatttttgaaccactgggtaatgttgaatatagttgttagagattttatggcttgtggctttttggttcagcacattaggatatgttcattttttatttttcttttctttttttctttcgtaactctgttaactgaccgttatgttatcttctgatgaatagaatcagttggtaattttaatgtcaaattaccagtgttttctgtttaggtttacacatttcttgtcttgttttgactatccttacatactagaagtcataatctcctatgtagtattgtcttctaaaagttttatattaaatcttttcacattgagatctcaaatctgcctgaaatttttgttttggtatgatacaggagtcacatttcattttttctaatggatactcaattatcccagtcacatttattgacaaattcttcccattttccccatgatatataatgtccttcattcccacatgtgagtctgtttctgaactattacttatgttccagtcatcagcctgtctaaccctgtgccattacgcattatcttaattactaaagctttagaataataccagttttaattgtatttgtatacaaatagtaatatcatttgtaaataacaagtttcgctgctatcacacaaaaataaaattcctgagtcaaaggttatatgtatttaatattttgatagtgttaaattgctggcaaaaagttactttcatttatgtttttacctgtattagagtttctgttttcccacaccttcatcaaaactaggtattattgggcatttgtggttttgtgggtatgcccagataaaagtgatagatcattgttttaatgtgcatttcttcttgagtgggaggatgaacatcttttcattgtttattgagtatttgtaattctttatacaatgaactgccagtctgtgtgtcttgctcatttttctttttcgttttttaaaaattgatttgtaagactttattataaatttcaaaactggcccttttgtaatgtacttgagctctccctcctcctacccctccccccaaactagttggcattttctttttaagttggtgacacaaaagttttaaattttatgtattcaaatttattagtcttttttgtttccgagtatcatttctttttttttgagacagagtctcgctctgtcgcccaggctagagtgcagtggcgctgtctcggctcactacaagctccgcctcctgggttcacgccattctcctgcctcagcctcccgagtagctgggactacaggcgcccaccaccacgcccggctactttttgtgtttttagtagagacggggtttcaccgtgttagcgaggctggtctcaatctcctgacctcatgatcctcccacctcggcctcccaaagccaccgcgcctggccctgaatatcatttcttacttagacttcaccattccaacggtaggaacaagtttattcatattttgtttaagtgtttgggtcagttctttatatttaggtctgtgatctaataggtatttttttttaagttatgccataagaatccttatatttttccccaaatggccatttaccaaatactgtttattcaataatccatcattcccctactgatttaaaatattattcttatcacagctattacatttgcatattcatttggttgtattgtagactcagtggtctgttcaacactttgtttctctttgtttgtgctgctatcaaacttttaattattgagaccttctactgcttctctgtgagagaactggatagagccagttgcctctcatgacttttaattcagaattttcttctcatatgccagttttttcagattataattactagtaccctgccacatactctgactcacccaaataaaactgtattgatattttgattgcaaaaacattattatagattattttcttggaaaattcaaacttaaaataatgagcctttatccaagaataactaagtagtgttgctttattcacttcagtagcattttgaagttttcttcatagagattggccctttacatttaattcaagttctcatttttgttgttgttgatgcttttggaaatgggatgttttctaacagatttacaaatatgtactattttgtttaatcatttttacggaagtataatttacattcattgagctgtgtctgtgtaaagcgtacagtttgattagttttgacagctgcagacccctgtgaaaccatttccatagttgagatacagagtattttcctcactccaaaaagattgtgctccttggtattcattcagccctccactccccaccaggtaccactaatctgcctttctcacgataaattattttacattttcaaacattttatataaatggattcatacagtaagactctttagtgtctttttaaaaaaaagctcctaataatgcttttgagattcattgaggttgtttgtgtcagcagttttcttcttattgaagaggtgtattctggtgtctggatataaaacactttgtttattcctatctgttgatggacatttagattgttaacagcttttggctattttgaatgaaggtgttagggatcttcatgtacaagtttttgtgtggacatatatttttatttctctttgataactgtcttgaggttgttttcatatcctaggtataagaatggttattttcacatttgggcagttgatgagagtcccagtcgctccacattttcaccaatgcttgtctttgtctcttctttctccccaaatttggccattttagcggatatgcagtgatttagtgggtattgtggctttatttgcatttctttgataacttgtgatgttgagtatcatttcatgctttacatgagtaaatcttcttttgttaagtgttttgggttgaattctgtctctcacaaaaaaagatatgttggagtcctagcccctaatatctcagaatatgaccttatttggagataaggtctttacagagatagtcaaattaaaatgagattattgggatgggctattccagtataactggtgtgcttataaaaaggaagaatttggtcaaagagacatgacacggcaagaatgccatgtgaagatgaaggcagagatcagagtgatgcatctgtaagccaaggagtgcggaagactgccagcaagccgctggaagtcaggaagagaggcacggaacagattcttcctcacagcccttagaagaaactaactctgcctgtagtcttgtaaattccttagggttttcagtgcgaacagtcatgtcatttgcaaatagagacagttttacttaatctttactggctgttacacttttactttcttttgcctgccttccagccacaattagggcctccagcataatgttgaaaacaagtgaggcaagtaagcatcctttcctccatcttaatgttgaacatatcaccattgtgtgcattagcggtagggttttttgtttgttttttaaaacttttaggttcaggggtacacgtgaagctttgttacataggtgaacagattattacatcacccaagtattaagcccagtacccagtagttaccttttctgctcctctccctcctcccactctccaccctcaagtagatcccagtgtctgttgttctcttgtgttcatcagttctcatcgtttagttcccacttataagtgagaacattcagtatttggttttctgttcctgtgttagtttgctaaggataatagcctctagcaacatccatcttccctcaaaagacatgatcgtgttctttttcagggctgcatggtatcccatggtgtatatgtaccacattttttttagccagtctgtcattgatgtccatgtctttgctattgtgagtagtgctgcagtgaacgtttgtgcacatgtgtctttgtggtagaatgatttatattcctctaggtatataaccagtaatgggattgctgggtcaaatggtagttctgcttttagctcttcgaggaatcaccatactactttctacaatggttgaacccatttgtactcccaacaacagtgtataagtattcccttttctccataacctcaccagcatctgtttttttgactttttaataataaccactctgacaggtgggagatggtatctcattgtgtgtttgatttgcatttatttagttctgtttatgtgatgaatcacatttattgattggcgtgtattgaaccagccttgcatcccgggatgaagcctacttgattgtggcggtttagctttttaatgtgctacaggattcagtttttaagtattttgttgaggatttttgcatcaatgttcatcaagatatgggcctgaagttttctttttttgttgtgtctctgccaggttttggtatcaggatgatgctggcctcatagaatgagttggagaggagttcagcctctttaatttttttggaatagtttcggtagaaatggtaccagctcttctttgtgcatctgttagctgtagggttttcataaatgccctttatcagatttagatcgttcctctggatttttagtttgctgagagttttatgaattggtattcaattggatcacatattttatatgtctgttgaaataattatataatttttctccttcattctgttaaatatagagaattacattaatttattttttagatgttaaactaaccttgccttgttgaaataaatcatatttggtcatgatgtattatcctttacagcatccttttcatattcaatttgctgtattttaaaaaggattcttgcatttgtgttcatgaaggatatttgtgtcattttcttttttcgtaatgtctttgtcaggttttggtattaaggttatgctgatctcatagttgggagatgttcactctatttattgaaagaattatgtaaaattgatattgtttctttcttaaatgcttggtagaatttagtgtatttgggcctggagttttctcagtgggaagaattttggtaacagattgaattctttaatatatattaaagaaaatatatttcttataaagacttatatatatatatataaatttgagaggccactcacatttactgttttatattgtgtcagaatatggtgtgtggtaagatgtgttttttggggaatttcttgatttcatctaacctattggattagtttgcctaaagttttttataattatcttttattatctttataagatctataggttttttcagtgataacctctcttgcattttttattattggtaattatattctctctttccttgatctgtctagaatagggtttatctgtttttatgattatttggctttgttaatatactcaattctttgttttctgtttcattgatttctgccttttattatttccttccttctcttcccctcaggtttactttacttagtctttttttttttttatagcttctcaaggtggatccttaggtcagtgattttaaactttcatttttaatgtaagcagttaaagctacagatttccttttaagtacttgtaaagtttgttaatagttcagaaccctcaggttcagtaatttactggaaggactcacagaactcactgaaagctattatactcacagttatggtttattacttgaaaggatacagattaaaatcagccatgggagagataaaagtccagaaaatttccaaatgaggagtttccatttgtcttctctggagtcatggatgatgttaacccttctggtaacaatgtgtgacaataagcactgagtattccaaccagggaaattcaatcaggacattccaagggtttggagggagctaaaagcaaggttaaattctttactacatagtcctatttagcttcattattactccattctgaattgtttctgatttccttcttgagttctttgaaccatgagatttttagaagtgtgttgtttaatgttcaaatattaggaattttactagataccttgtttctcagttaattccattgtggttagagaatggattggttgtgatttcaatccttttaaatttgtgacttgttttgtggcctagcatatggtctgtattggcaaatgtaccatattcacagaaggtgatgtattttcttcagttgttaagtgttgtttatcataaatgttaattaggtcaagacagttgatactttgttcaatttgtcttatatttgtatagttctatcagttgctaatcaaggagtttaaatctcttactaaaattgtagaattgtctgtttctccctttagtttctgttggttttgcttatgtattttaaggccctgttattaagtacacacatttatggttcttataacttcctggtgaattaaatttttagcattttgaaatctctttttctttagataaatactctgtcttgaagtctgttttatcatatgttaatataggcactttagctttcttatgcttacagtttatataccttttcttttcattcatatgctttcactctgcctttttttacgaagtatatctctcgctttgcatgaagtaagattcatgctcagattctcaacatcatttagtggtggcccaagtcatatttgttttaatttgccttttaaatatgagaaatctgatttttactaattattaattaaaatcagttaacatactaaattacttctagtaatttttttagtggatttgcttggattttctagctgtgtaccagtatctcctgtaatgattgttttatcaactcattaaaatttttttcattctaaaggtaattttgtgaatgaataatacattcacatggcttgaaatttaaaagctgtatgaagatgaaaaggtctccctcttgcctctttcccccaggggtaaatctcctctcgtcaagcaactaaagttatctgtttcctatgcatcctggtttctccgtatataagcaaatatgtgtattttctcttcctcttactatccccccaactacccccaccccgccacacacacaggagtgtagtctatactattctggacttgttttcaccacttaacattatattctggagttttttctatttccatacctgaagacctttctcatcattttatgacttgtgatattctcttatttgaataagaatgatttatttgacaagttcattgttactggatatagtgatggatgtttttaattatttgttttacaaacaatactacaataaataactgcctacacacttcgattgtaaacatggcaatatttctataggataaattcctaaaagtagaattatcaggtcagaggttctatgtattcataattttgatagaagttgtgaaattgtccttttatagaggtagtaccagtgtacactccacagattcgtatgaaagtgcctgtttttcctatgtcctcatcagtatatagtatgttatcaaacttggatatttgacaatctgataatgtgagaagtagtatatcagcgtagctttaatttacatttatcctcttgggagtagtagataaacatatttttgtatatgtaagaattacttgatttttttttttctctaaattgtttgcttgttcttgttccatgcattagagagagggctggagggttttgtatctttttcttagggactaagaagtttttaaatgtgtttgtgaaattagtcctttggatttaagttacaattttttttcgtattttttaacgttttgacttctagtcaaatttatcagtctttttttaatggcttctcagtattatgttacagctatataggtctttgttatagttataaaagaatttctctagaagaatcttgtgttatagtctcatttaaaaaaatcttcaggatatttttgttgtagctacccattttcccccttgctatttattgaataatcttttaaccaatgatattggttgaagatataaactttattaaaaatagtaccaaatttctatttatatgccgattttcatctttgtttcactaatctttctgttcttgtaccagtaataccatatattaatcaaggttttataatagattttaaaatttgttgaagattgtgcacacttactccttatctatagactttctttttttcttgctggttttttacaagaatttcagttacctcttctaattcctgcataaatatttgaataaatgaataaattttctgttggcctttttattgggattatgttaaagataaaagtatagataaacttaggaaggagatgatatctttgacttgattctttctgccaagaacgtggtctgtcttcttttcatttggtaaagccggacatttggatactttggttttattcctgggcattttatcttttttgtttctatttcagatatggccttctatttccttgtaccatctaattgcttattattagtttaaatcagagatttaactttgcgtaaagtttgtgtaactttgcgtaaagagcagactttgcgtgaaggacaaactttgcgtaaagagcaaagagcaaactttgcgtaaaggaccagatagtgaatattttagcctctgtgggccgtctgcttcccagctccgccaccgcatcacagaggcagctagaaagcagccatacatcatacatggaaatgagaatgagtgtggctgtgttccactacaacttcattacaaaaacaggtggcaggtcctacttgaaagcagtccaacagaatttccagcatacttagttaaatgaaagcaatcgatatctatatattcattttctacctggatacctaactgaaatcttttattgtttattgttggtatatcgttctttatttttatttatttatttattaattttttacatttctcttggattttctggatttaccatcaggtgatctgtaaattgtggtaattttatccttgtccttctaatttttttatctcatagttttttttcttgtatctcctgaaaagtgttagcagtagttataatgatatgcttatttctgactttaatgcaaatgatgtgtttccccattaatcagattaatggttgactttttggtgaatagaaagatactataaatcaaggctcatgcctgtaatcctaacactttgggaggctgaggcaggtgtatcgctttgagctcaggagttccagaccagcctgcgcaatgtggtgaaaccctgtctccacaaaaaatacaaaaattagctgggcatggtggcttgtgcctgtggtcccagctacttgggaggctgaggctggaggatttcttgagcctgggaaggggaggttgcagtgagccgagatcacgccactgcactccagccttggtaacagagtgagatcctgtctcaaaagaaaaagaaaatatcttacataattaagagttatttttaaaatcaagagtatatactgatttttttaaatgccatcttagaagaatccgtagaaatcatttgaccctttacgtcatggatttctttgtttacttttcaggagcatactgtaatagtcagaataatgccctccctgcctacccttctgcccccctcaaagatgtctgtgccctatagatagccccttgaacctgtgaatacatggcaaaaggaaattaacgtcacaaatggaaataaggtttttaataaactgattttaagatagggagattatcctaaattatttgggtggacccaaagtttccttggaagaaggaattggaaaacagaatccgagagatgacagcatgagaaggacttggcctgacattggtggctttgaagatggaggaagtgggccccctgccaagcaatgtatatagacagtccccagaaactggaaaaggcaagaaaagagattcttctgtagagcctcctcagacacattttggacttctcaactacagaactacaaaaatgtgggttgttttaagccactatgtttggtaacttactatagctgccatagaaaagttttgttctcagttttagtgagtatatttcaccattaattgtaatgtcggttttagtttggtttatagtaggaagctgtccagttgtactgttttactccaagaggtgatagtggttgtttttcatcataatggatgtgtttgttgagtatttggtattcattaattttttttccttctgacttgttaatgaggtcagttacatgaaatgcttttttgatatttacctattctgacatttttggaatgtattctacttgggttgtaatattttgatgttctgagctcttttgctaatgttttgttttggaactttgtatttacattcataagtgagattggtttctagtttttttgtcatttctgaggaatttttttttagaatgttgtcctttctcatgattattgtttcagggctttatctcattcagtcatggccagttttggaaatttatatcttcctataaaatcataacaacacaattttgttcgtattgtattttgcttcccccttcctcccacgccctttccctaatccaggctttacttctgggggaaggagtaagtcccagtattggtaaggtataccatttttcacatgtatagctttatcatatgaaggttgaacacatttttattttttattttttggtatgttcaagatggtttggtatgtggaaatcctatcttggtatatgacatttccttccttaaaaagcttgaattagtaattctgttcttcttggcccttaaccttttggcgattgctgtcagtggtttcggggatttttaatgctttttttattccaagcaagtgaatgaatagtcatcttcctgtatccacaggggattgggttcaggataccaaaatcagtggatgctgatgcccaagtcatagaagacatagtatttgcatataacccgtgcacatcctcctgtattttaaatcatctctgaattacttataatacctaattctatgtaaatgctacgtaaatagttgttacactgcattgttctttatttgtattatttttgttgtatttttttccccaaatgttttccatctgcaggtgtttgaatctgtagatatggaactcacagatatggagagctgactagttgggagaaattgtttaaccacaggcaatagtttaattgtacctaaaatcttcattccagctcccagttaatgtatataatagctaattttattaacacactgatggatgagggaaaatcattctgtagttcctatcacaaagtagcaggtgttttacaaagagcatagttaaccccatttgaaaacagtttgtctggatgtggctctaagttggtcctgtagcagcttttgtcgtgttcaggaaaacaagcaatctaatatcaattgttataggattcttctgtttctattcctgcagcttcatattaaaccgttgtcaagaacaaaaagaatagtgtttcgtatgcatttctgtattgtggttagctcatttgaaatgtacaagtagaaaaatgaagtcagtgtaatgtggaaatcacactgattcacataatttttcctatacatgggagcagactgagcagtgggaataagattataatctttagctggagaacagaaaagctcttggctcttgagctacctgttgtgagcaaggtgttctttgtactctatttaagtaagttaaagacaagcacctacaccggggccttctgccacagagagattcattcctaacccagtatgactctttgcataggatagatttcattgtcttccttaccctaaaagtatctgtgttgtttgggcccccaccagccctattttaattatagtgttgtcagtttgtgcacttttactgcttgctgtggctcttgcctgcccgagcaatacaatttaatgactgctctttttccctgacagaggccatttattttaaccttgaaaccaagaatatagttttgctcttgaaaggataattttttagtggttaaagattgcaaaagtgaaagtgaggattttggagaagaaatgtagtaaatgtctgtggctttaaattaatgtattttattgatcttaaaatgtactttcctctacttttaacctgtctcaaatttggaattatttgcaattgatgtacttcacaatttatttggcagtggtttttttttcttttttgggggtaaatataattactggggcatcttataattgatgatgtgtactggattcatgagatacaatatttgctattagataaattttagaatttaaaatatcctacttttgactttcagaaaacctagttttcgaatggagatactgtaatattttgattttggaactgtttttgaaagttcatgacacagactatgacacagttttctaagtattttacgagatggagattttacaaattttacttactttattttgagacagggtctcactctgttgcctaggctggagggcagtggtgtgatcatggctcactgcagcctcaacctcccgggctcaagcagttctcctaccctcggcctccccagtagctgaaactgtaggcacacatcaccacatccagctaatttttaaaattttttgtagaggcagagtctcaaaaatggtcctgaactcctgggctcacctgatcttctttcctcagccttccaaagtgctggggattacaggcatgagctcctgtcccaggcctaaaattaacatttctgtacacaaaatacacattttcccttccacttcactgtcactgttaagacaaatctaacagtggttagactgcatcgttctctgacacggacagcattcctccttaccctgcagacttatttaaagtaattttcccagatccctttgagaaaatggttaaagttgtgaacacttcttcagaaataatgctcacatctccttacaattcttttacagttttctggtttgcacttttaggcaattacacttcttgtttttgttttgttttgtttttagcatattggttagaaacgctagagaagtgttgagtaagatgatactgccttgattgccactttaagaatgcctgtttcaccattaaatatgattgctggtagatgctttaaaagtttatttgtatttctgtattgctaagagtttttcttctcctaaaatcaggaatgggtttaaaattttgagattcttaggtggttcttagagcgttcattgagatgatcatggtaaaatacatgaagacatgaatgtcttaaaattgagccatccttattgttgggatacatttcacatcatagtgttggattcagtttgctttttttccttccaaaacatttgaattcatattcaaaatgagcgtcgtttcttgtgttttcaggttctataatctggttgagaaatttggaagttttttgtcttcctcaggaatgcagcaatcagtgtttccttgatagacttgaaatgcagatataatacagttacatttattgttatcactcgttttgtaattcttctcatcttacatttgttatggttttcatgcatttgttttatttgtatataatcgtggggtacaagtgcaggtttgctacattaataaactgtattgtggtgaaatgagggcttccagggcatccatcactaaagcaatgcacgtggtacccaccagacagcctcctatcatccacccctcccacccctccacccctgcaagtctgcattgtccatcattccacactctgcctccatgtgtacacattatttagctcctgcttgcaagtgagagcatgcagtatttgtctttctgtgtctgagttatttcactgaagtgctttggctaagctatttgggctcttttttggttccatatgaactttaggatttttttttctgcttctgtgaaaaatgatattagtattttattgtagtattacattgaacttccagattgctttgggcaacgtggtcattttaactatattcattcttctgatccatgagcatgggtgtttttccatttgtttgtgtcatctacaatgtatttcatcactgttttgtagttttccttgtagagatcttttacctccttggttgaatatattcgtaggtattttattattttattttattttgtagttattgtaaatgggattgccttcttgattgggtgtttggccagatcattattggtggataggaacactactgatttctgtacattgatttcgtatcctgaaactttactgaattcatttaccaaatctgagagtttttttggtggagtctttagagtttgttttttgtttgtttgttttttgagacggagtctcactctgtcgcccaggctggagcgcagtggcgcgatcttggctcactgcaagctccgcctcccgggttcacaccattctcctgcctcagcctcccgagtagctgggactacagacgcctgccaccatgcccagctaaattttttgtatttttagtagagacgggttttcactgtgttagcctggatggtctcgatctcctgacctcgtgatcctcccgcctcggcctcccaaagtgctgggattagaggcgtgagccactgcgcccggccggtggagtctttagagttttttagataaaagatgatgtcatcagcaaacaggaataatttcacttcttcctcttttctaatttggatgccttttgttttttcctcttgcctaattgctgtgacaagtcttctggtatcgcgttgaataagagtggtgaaagtgggtattccggtattgttccagttcttagagggaatgcttttaacttttccccattaactataatgttgactgtgggtgtgttatatatggtcttttttttgttgagatatgtttctcaaagcctagtttgtcatggacattttattatgaagggatgctgaattttattgaatgttttttctgagtctgttgaggtgagtctgttgaaataaggcctttgaccttatttctgtttatgtgatgtatcacatttattgatttgtgtatgttgaactatccttgcctcctcaggataaatcccactggatcatggggtattatatttttgatggtgctgtcgggttcgatttgctagtattttctttaggtttttacatctatgttcattagtggtattggcctatagttttattattttgctgtgtcctttctggttttgataacagggtaatactggcctccattcctcaacacatgttaatcctcatctgtttcaagaattcatattaagcctcactgctccttttatgttaatgtgttgctgtttttcttaaaatgaagtatattggcttgcatggaacaatatgtggtaccaaatatttcttttaaatttactactgaaataataagtatttgaggggtagatagggagatatttgcacactaataatatttgttcaactgtctggtattgatttaagaaccttgtactaaatattttattaaatacttagtttttggccttaattttagttattttggattttctaatagattcaggaatctgcatcatttccataatcagaaaattgtttctaaagaaagatatctggaaattatctaacaggaatgaagtagtaatttagtcacattcctatatgtaagtcatagtagtgagtaaaataatattgctgatattgttaaccaagattaagggcagtgtaaagttttatgtcaaaggtagtggcctgaaaaacataaaaaaggatgaggaaatgtgtttagaatgttcttactataatcatttaaaaatatgtttcctccttcatccctaaccctcatcacactttgtaattctttttagtataagtgttaggtaagttagacttggaccatccttagggaggccttagttttctacattctactttattggcaaactggttttatatgaagttttcagtgttacaaaaaattggaaataggctgagataaacctttagataacaagaaatacagatgaatattgctgtgtaatgtaatgatggccctgaaagctacttggaagtactttctcaaataataattgtaatgaacccaaggtttctcttttttgaataattacaggttgagcatcctttatccaaagcacttgggaccagaagcgtttcggattttggaatttttcagatttggggatatttgcatatacataatgagatatgttgggatgggatgaaatttgtttcatatacacattatacacatagcctgaaggactttatatacactatttttaataattttgtgcatgaaacagagttttgactgcaacccatcacataaggtcagatgtggaatttttcacttgtgatatattggtgctcaaaaagttttgaaaattgaagcattttggattttggattttcagattagggatgctcaacctataatagagaatagactttagttttggtaactgtatttttataaaaggttttcttaaaggtacaagtataagggaactcagaaactttaagagattcccattggctagagatatgtcaatttcagcttcagaaaagattttttcaatagattttatcaccagctatgtataatccatcaatttatcatgataatttttataataatttgaaggtactcatatagtgtaaaatttactcttttaaagtatatggttatgtgcgcagagttgtgcacctaccaccactaactaatttcagaaggttttcatcatcccagaaagaaattccatatccattagcatcatttctccctcttgagtgaaattgctgggtcttaagatacttcatgtaaccttttgaggaaccttcaaactgttttccagagggaatgtaccattttcattcccatcagtaatgtatgagagttcccatttttccacattcttgaccgcacctatcagtcttttttttattatggtcctcatgttggatgtgaagtagtatctcattatgggtttgatttgcatttatgtaatgattaatgatattaaacatctttccatgtgcttattggctgtttgtatatcttctttgggaaaatgtttaaatcttttgcccatttttaaattgactcatcttcttgttgagctataagatgtattctggacagtagacccttatgaaatatattatttgtaatattttcctcctcattgtttggtttgtctttttttttttttttggagactgagtctcgctgtgtcacccaggctggagtacagtggcctggtctcgactcactgcaacctccacttcccggcttcaaacgattctctgcctcagcctcccaagtagttgggactacaggtgcccaccaccacacccggctaatttttgtattttgagtagagacggggtttgactatattagtaaggctagtctcgaactcctgacctcgtgatctgcccaccttggcctcccgaaaggctgggattacaggcgtgagccaccgcacctggcccctttgggtcatcttttcggtttcttgatagtggcttttgatgaacaaaagtatttttttgtttgttttgttttgttttgttttgatgagtccaatttatgttttttctttggttgctgatgcttttaatgtcatatccaagatacgatttcctaatcctaaggtcacaaagatttacacttatgttttctaactgtaactcatatttaagttttggttaattttgtgttaatttttgcacctagtgtaaggaaaggatctaatttcattgttttgcatgcagttgtcccaatatcatttgttaaaaaaaactattctttctcccttggcacacacatgtccaaaatcaattgactgtaaatgtcaggatctatttctggactctttattcaattccattgatctatatatctatatttattccagtaccatagtcttgattaatgtagctttgtagtaagtttcaaaatcaggaggtgtgagccctgtactttgttgttcattttcaagattatttctggctattctgtgttcctcgcaattccgtgtggatattaggatcagcttgtcagtttctgtgggggaaaagtgcctgatggaattttgatagagattgcattgaatgctgtatagaaacctaactgatcaccttaggagatggcagggagccaatttttcaaatctgtcttgaaaactagtaaataagggcatttttcctgtttcacctgtgtgaaccataccaacagataaccaaatagtaggtgaagtatctctttatacatgtattccattgcattaatgaaaaataaatatagaattagtttgtcacaatttttgcaaatcccagtgaatgaattagtttaggcattgaatatcaagagctgctaactttacaaaaagagagacaggtattatatgctttctgataaaataacacaccaccacctgtagtcttaccaaaaggactgaacgtgagattaattaagttgttgcgtccagctaccaatttacaggaaatacggaagcaaaaggtctgcattgaagggccccatgattttgcagtcattctactggaacctctttaggtcaaatgccttgagtttttccataattatagggaataaaaaaggatcaagagggaacttataaattaaaagatacttaaaagacatagttttaaaattatttctttcaagaatgaggcttttttaaattttaattcctttcacttccctccaaattacatacgtacattcataagcatggatacacacatacacatatataatgatacatacatacagtgttgcttaaaaatgtttaaacagtgcatttatataaaattttaaatatatttatgtacatacatagttttatgtagaaaatacatgtcatgtgtatataaatatctgtagctttgaaacatcctttcctcattcaattatctatgtttttactttgtcctattagaagatgtagatttttggtcagtttaacttctgtgtagaatttcctacgatgggtgtgccatatttctttagacattttgttagttgattgataggcagtttattgtcagttttttaaaattccaaactgtagtgaatatccttatccatgtatctcttctaaagtatatcctaagttgttgagtacctgtagagtttcaaaagatggcaccacatttccttccttatatctactcctgagagtacttagattgtgtttccactcaactgagtatgtaaactgtgttaggttttctatgtttatgttaacgtcagccttgattacaggataaagttagagaacctttttttattggttttgaaactaattgcagtcatctgtgaaaacattattcttatatcctatcgaataagctaatgttgatgtaagccagattgatgttttccgtgtgattgtaccatttcacaaaaggatgttgtttaaaaagtgctactggaggttgtatagtaactttcagcagtcaagcccatagttaccattctttttttttttttttttttttttttggtgtgcatttacaaacgtacatttttcctcctatctatacaagagataactgatattcctccttaatactgtctctcattcctagaagtgggattactggatcaaggagtgaaaacattttcaaggcttttgaaacatactgccaaactgccctccagaaaaaggcctctactgtgaatgtgatgatggatgcccatttctctgaatgctgatgctgtattttttttttctctcactaaagaagctgagcgttttttcctctaagtttactgacccatttttttctacttttattttaagttcagggggtacatatgtaggtttgttacatgggtaaattggtgtcactgaggcttggcgtaggaatgatcctgtcaccaaggtagtaagcatagtaccaataggtagccatccaccccacacccccttctacctccccagtcaagcagtccccagtgtttattgttcccatctgtgtgctcatgtgtgttcagtgtttagctcccacttacaagtgggaacataatagtattttgttttctgttcctgtgttagttcagttagaataatggcctccagttgtatccatgttgccacagaggacatgatttaattcttttttatggctgcatagtattctgtggtgtatatgtaccacattttctttatccattccaccattggtgggtatcttggttgattccatttctttgctattgtgaatcgctctgcagtgaacatgcatgtgtcttcttggaataattactgatcaatcaattgattgactggtttttttcccagtagtgggattgctgggtactgacccatttgtatgcctttttaaaaaaatatcactttatgttcgcttttttttttttaaatcattgataagagcaacttaataaaccttggtttcttgttgaaattctttttttattgtgccttgttttgtgtcttttctttatgagtaggtttattcgagggtgatgggaaagaatattttatctcagtgtgtctttatttatgccataggccttctcagcttggtgtgaggaagctttttttaaaattatggtaattttttagaaatagattgcatagaggtgtgtgtgtgtgagagagagagagagagattatagttaaaataaaaaatgtgattgtctgctgaactaattttcaggtagaaattaaaatggctgacttttaaaaaatttgtgtacaagttaacggagtaagaaaaccagactaaggtgcctaactttggcttttccattgactttatttaaataattttatcttagagatacatgattcagttaacattgggtaagaaatgagcaatcaatattcagtcttctcttgtcacctagctttgaattatttctaatgtttaaattaaataattttattattggcattatttttaaagtaaaatcctatttctctgagatctgatgtattaaaccataaatatactttttatattgctaaatattgagtatttggctagttatgaaaaccatgatttgaattaaactcatgttgcttatcagggcttcttcatgtttattttctttacagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggtaggatagtatctatttattattgttatgaattacatattacttttgttatacatatagctcatgctcggagagaagtattctttcatgtaggttcgccctaccccacccccccattttagtttcatagttatggagaatttcaaggtgcttattagtactccagaaaacatttttaaatatgtattttataaatgaatgttagtcagtgatgctatctttaagtctaaaaattcccacgatggaaataactattaaatttcaaataccacacactgaaatattttcagacacttgtttttaaatattagttggtatagaaacagtgcatttccagcactttggaaggctgaggtgggtggatcacttgaggtcaagagttcaagacaggcctggccaacatggtgaaatcccatctctactgaaaatacaaaaaaattaaccaggcatgatgacacatgcctgcagtcccagctactcaggaggctgagacaggagaatcacttgagcctgggaggcggaagttgcagtgagcctagattacgccactgcactccagcctgggcgacagcaataactccatttcaaaaaaaaaaaaaagagcattaacatcatctttaaattccaaatatgtgacttttcttgatcctatcatctctcccctcagaagtaactataatcctgagtatatttaccctttcttattaaagttctaccatatatttcgattgctaatcaattgttttgcatattttggactttatataaatggactcatactgtatatttaacttgcactctttactcagtattacattcctcacattgataaatttcactgctttagagttttctattttatgaatatactacaatttattttacttttgatggatatggatttattttcaggttattactagtgtaaaaagtgcttgtaaaaacacaggttatatatacatctttgtggataaagccagcttgtttctcagtagctgtgtcatttccagtttcagcaggaacatctaacagtttttaattgatccatgttctcttcaatcggtattcttatttttggcattgttttggtttcaaaatggtatctgagtgtgattttaatgggaattttactagggaggtatgatatatttattggtcctttaggtttccttatctgttacgtgcccatttaagatttttgctcatttttgtattgggtcgttctttttattgatttgtatttcttttatattctgaatattaatcctttgttggttgtgtgtattttcattaaggatcatttcttactagtaaaatttacctggattttgtaattctctttgaggagtgatatcatactactggttaaaatttttaatggttatagtacgattcagattttctatcagttaattttgctaggctatttttttctagtaatttttaacatttcagatatattttcaaattattatttatgatatcctgctaataccttttaatatctatagcatatgtaggcatggtcccttttttattcataatatcacttatttcagactctttgttttccgtcaccattcttgccaaaagtgtcaatttcaaagatggtcttttcaaagaaccgtcttaaaaaaacaattatcttgagtccctgccctgtttgccaccacccttacccctctgttcttatacacacatacacatacataaagacatgtttatgtatgtacattcatatgtgtatatgtaaatataagttacatgtaggatagctgaatatcaattaaagatagtgttcagtataagtaatctgatcctcccttggggaactaaaagagagttaaggagagtaaacagccaaaaaatctgattttttggctgtttaccagttagtggcagaaacagttcttctatcttttcttcctttctctttttatcattattatttttttcttttttggtttctttgagtttattctgttttcttgtttttctagtttctcaagtcacttgcttattgcactaattaccagccttcttttctagtagtattcttttataaatgtttcttgaaacagcatttttaaatgtatcccacaagtttgaatatgtaatgttttcttattgtatttttttaatgtctgatgtgatttgttttttgttagcctcgtgagttacttagaagcgtgtttaattcttaaacattagagactattccttccattttgtcttttttgtttttgtttttctgagacagggtcttgctctgttgcccaggctggagtgcattggcagtcatagcttactgcagccccaaactcctaggctcaagtgatcctcccagctctgcctcccaagtagctgggtctacaggcacatgccatcatgcttggctattttttttgtttggtagagacagggtcttgctctgttgcccaggcttgttttgaactcctggcctcaagtaatcctcttcccttgacctcccaaagtgctgagattacaggtgtgagccactgcacctggctcatatcttcttttggattgtattttctcatctcactttcccttattactagcttggaagttaaaaattgtttctcttcctttagtggttattgtagaaattttaatatatgtttaacttttaaaagtctaaagtaaataaatgccattcactcttactccagacaacataagaacctcagcacgggtaaagccctaacactgcttgttgaatgtgctgttcttgtcagcctgcttttatcttgattgagttaatctaatttatttattatttttgtccaaaaacactcccaggatatgtataatttttttatttctgatgttttgaatttccggtcatccttattgttacaaaccaaccaaagccaatttgcacatggccaactctggtcttttggtaggtattttagtagttattttggtgtgtttgcagattatgacacaagcagacatttaaacagtgagccagcatgcatattttatgtagcctattctttaaatctcatgaaacctcagctttccgttgttgcctaaaatgctcattctaagcagataaaacaatgttccagacacaagattttgtttacccagagtctccagatgtcttagggattaaacctaaggtgttatccctaagggtttaggcctctccagagtcttccgtttcccttatgcaagggtgtattatgtctctaaattaattcaaaaaattcacataactgggatgctatggatttcaccagtgaaatcccattttgctgattaataagccactaccttcatcagtgaaaacctacttcattataattgggaagactttttgtgtaaatcaaagattaatatgacaaaacccccctttctgttgttgttttgttttgttttgtttgagttgaagtctcgctctgtcgcccaggctggagtgcagtggcgcgatctcggctcactgcaagctccgcctcccgggttcacgccattctcctgccccagcctcccgagtagctgggactacaggcgcccgccaccacgcctggctaatattttgtatttttagtagagacggggtttcaccgtgttagccaggatggtctcgatctcctgacctcgtgatccgcccgcctcggcctcccacagtgctgggattacaggcgggagccaccgcgcccggccgacaaaacccttttagcagccatctccgtatatgattcttgtaattaaatgcaaggtgatcaatcttgggatgtgaattggaacgcagactggcctttgggaggtttacaagttctccaggtgtttctaatgtgcgggcacagttgcgaagcattgtgccaccactattacggctactatagttgacccttgaacaacacgagttggaactgcactgctccacttatatgcggatgaaacaaatgcagatttcaaacaaatgcaatcaaacataaaagtatttgtaggatgcaaaacccaagtatacagagggctgacttcctgtaagtgcatagctgacttcaggacttcagtatgtgaggatttgggtacagtatgcgaggattcacgggggactagtcctggaactagtcccccgtgaatgcaaagcttgaggtattttcctgcactactgtgctatctgtgttgagctattaatatttacaagtaaacttctgacatcatttgtcgaatcctccttctagagtgagagacttaaattgatagtattgagagagaaagcattcatactttaagattttcactgctttcttaatctgattcatttcttccttaattttctgaccataagagatgagaagtcagttttttggtatctgctttaaattgctttttctttacatatacttgctttttgtttattctgacaatgataaaggattatgtccctcacagctttttaaagaaatattttatagaggcttaaaggagtatgttattaattaaagtgtcctttatcatcagttctaagacttaccttttccacatttaccatttctgaaattggtggaaatcttgcagttgctggcattttgtcatggccttatctgagtggcgatctttgtgtagtcatatgtaaacctttcctgacacgttttgttaagatcaagaaagtaccagcatgctttcctgagtcttaggatattatgataatcattcagctggttctatgagaagcgtctgaaaacctggccatctttgtgggccattctcttgctctgccttgttcatcttgttctcttttgttaggtattaacaggatcagtctctgaaacaattataaaccatcctctggggttcttaagtgaaaccactagtcccctttccctcactagtcccctttccctcactttggtttgctggctgtctgattcatatttgcaaactgagtagataaggattttcaatcccagcagaaaaaaattgtgtgtattctctatcatttgtttctaaatcacactttaatatgttaatgttttttcctattgtaaacttgttaaacatattttcttgtatatttcctgtgtaatatgatgtatcaagtttttaaaaatttaaactttaaaaactttaaacttgatacataatattgcctgatatatttgcaccataatttgatgaccatgtcagctctcagatatctgttatctctatttttattaggttttgtaaagaaacctgcaatgagtaatctttggacatgaaaagtatttagtttctttcctttggatggattaccagaagtcagattactgagtcagaagaatatgaacgtttctcaagttcttgaaactttctgacagattgtattctgatagaattgtaatttaagaatgattaagactgtttcgtttggggaatttctacctgcttcccctctttcattcctaggttactgtggcagatgccacgtaaaataattatttgaggggtgtaatagatttggagcaggtgagcattatagcagagtaggtagggttcctttaactttttgttagaaaaccggaattgaaggaaaacaacccttattttgacataagaaggcaagctttaatgctttttcatcttaatttttaaaaaaccagaatgttataagaagctcaacaatttatttaaaatacagtgtcaagtattagactagtagtctcttttttaaaataaaagctaatatagagagcttttcctcttttatagtattgtggtttggagtgaacagctgttacgctgcatgtagaagtcagtatatgaattattattttataatttgaaaaagtatcttagaattaacagtggtttgctgagtagattgtaaattaggcacagctttagtcttcacaattctaataaaagctaatggtaaaaataaaatttaatagatgctttaaaaatcaactgctaggatattagttgtgtcaagcaatacatgcatttagcaaacagttattaaacatctgtgctagtaactgtgttagacatcagtgattagtatttttttacggaaagatagttaacacagtatgatgtgacatgaaagagggagaaattaaattcttggagttttctgaaaaaagcaagttgacatttgcataaagtgttgaaggatgtgtaagatgccaagtcagaggaggaggccgttactggggtaaataaatacagtggaagggtgacaatcacaagaaactgtagaaatgcaggaaggtttatgttattattgctgatacttagggtgcatgttaggaaatgagggcaaaatctaaaagacctgtatgatgaatgttcttatgaaaggtttgccaccatgaaacatgccgtgaattaatctattagattattgtggtggtggtggtggtggtagtggatggtggtggctctccttactggaataatgagtaaagtaagatagtgattgggttactttattcagggcttggcataaagataattatgattttataatttaagactctgaaagggatactttcttgccagtgttgggaagaatatcaagaaagaaataggggatataatagttttttaaaaatcttaatgtcgaagagaaggacacagtgggtaaattttggggttatgtaagagtagtgtcaaggttctaaaactgaaaatgagctgagaattaggaaaaattgttagaacagtaaatcgaacaaataaaaacctcagccttttcccaaaaagtttgaaatgtacatgaagcaacagggaggacagtaggagtattattgagtgtatgggaggatgcagtgatcattgaagaaacaagtaatttatatttggtttttgtcttcaatggcaaggaaaattatgctcaaactattgtatacaaagtaaacattactaagagggacttgaaatcaaacagaaaaaacagggtcaatgagcagataattgtgctaaataagtatatttcctagcattttatttcatccagtagtattgagaatataatgaaatcactagcagctcttagtagtttttaaaaaattgtaagaaatgggagtggcagaaaaatggacacaagcaaatataagccttttgaaccaaatgctagaggaatagaagttttcctgtttctagtatataatgagcagtttttgaaatcaactttatctttacatctctggaacatatagaaacatgattgaattttatcatggacctggtatactaaggtgagcatatagtttgcatgcactgaccactagatggtgctcatacagaagggattttgtatgtgtgacattgagggttttctagataaatagcaaatctgtgttcttgtcactcttctcagtcttgtcttatctcaatacagttgtatgttttgaaatttaatagcccacattagaaaagagtaataaaaatgcctgttatattgcatttacgttacattagctttgtagttactttgggtttttggtgggttttttttgtactttagagtttcagtattgcttttcctcttgtcctttacctttttacatttttcactaagattatttagtaaactgggcatggtggtaacctcagctacgtgggtggctgaggcaggagcatggattgagccaaggagttcaagaccagcctgggcaacgtagtgagactccgtctcaaaaacaaacaaataaaagattatttagtatttgcctttgtttctgtacctaaagactgctgggtttgtgactttagaaacgtacacaaataattgagagcctatccagtataaatttttaactttttattaccatttaatattgtaaatattcctcatagtcataaatttttcataatcatgttttgaattacatagtaatccactgaactaatcgtatttagtttactaacttaagctttctctattgtttaggctagaattctatagattatattatcactctgaaaaagaaaacacattacggaaaaaagaatattctttgtatatcatattaagatgttaatagtgattccttttggtggtttagattgcataccatcttttcatccattattttaaataggttttccaggtttttctttaatgaacttaaatttggttttaatggagtttttatctttcatctctgctgtgtaatgagagaggatattctaaagcaaagaacagttggttgccttccgccttccacctcccagtctaatctcatgtgaaacccctcttgtgatttaggtatagattttttgtgtgcatatactgactactggccaatggatgaggtgttcctagatttttgtaggtcatgtaacaggacattttcataaagaagtctttcccaaaacttgaagttgttttcttgatgtgaatggatttggataggaaatttgcatcaagaagtatttcttccctgtacattggggaaatatgggaggcagtgatctgtcaactttagattgtaccctaagttctttggctctgtagggtaaatagatgcacactaagagcctaccattgacccctaagttctctggctctgtaggataaatagatgctcactaagagcctactattgtatgtcttttggtactgtttacagtttgaggtaggagatttgcattcaacagttgtattcagtatcttcatccatactaattcagaataacagaacccatatcagttttctcctccccttgaagttttcatcagacatggatcaaggcacatattttagggccagaccaattaccgtagcatttatataaaccacactaatcaggtctttactaggtacctggtccataacaaaacttgaatttttttctgggaggtttcattttttccttcacaagaggattcttagttacctgtccgcccttagtattttcttacattctctactccgaattagataggatcactctggggccataaattgtcagctactgccggcacagtccttgggaagaagcaccaaactttctggtataatctctgtcacaaaatatcttgccctcaagagtcccacatggctctcacccttactgagcacatgttcacttctcagcagacgcatcatagagacagcattagcatgttttcttgcggagtcaagatttgcagtggacctcaacattgtagtttgacaaaaggctgcatccagttggtgctggtaagcacgtagacaaggaagattctgtcagtccacatccgaaaaaatatccatggctgaggttgggacttacgatatgctcttatcagcttaaaaattagattattcaaccaatagtaaattatcaagtagcgtttttgttcacatattgttttaaaatgaccattgttgtaattactaatatagcacagtgttaagagggcttgcttgggagtttgtggttctcaaacttgaaggtacttaagagtcacttgggaagcattttaaacataaaaattcccaggttccccctgcccgtaaacattttgatggggagaggatacaccaatctgcatatataactagcgccccaggcaattctcaggcgaactattatgttaacctaaatattagatgttagaatatgttcctttagcaatcaggtgatagtatttggtgaaccagagtggtatttatgtagagttggataaaacacatttcactgattataaaacgaaaaatttaccagcgttaattctttctcatttttagaaatttatgaccttgtaatatgaatgtttataaaatactagagagatgatgctgataatttcttgaaagttcttttttatcataaaggttccagaagcaaaatacttgttttagtaattaatctaccttgagacccagttgttaatcattaaaaaccaatacattacataaaatgataaaggaaaatccatttgtaatgaagcgctatcgttagatagtcagagtttaatgtaggcagcacctttgaacaacttagagccagtgccagataatgtgtaagatctgcctggtgtagaaatttggatatgaatgacaaagattcttttagtgaaatcattttaacagtcagaactatttgcagagagaatcctcttatatgttttaattcagttcatatttataatttatataagcagtgaaggtgccattggattttactacagactgtggttgaaacttggtaatccagggtttttccacgcagtgcattaaatcaggcagccccacagggtcttggtagtccagtgtttatagcatccttctttacctgctaatcgacctcacttcctggatttcaatccatctagttatcagctaacaaaagaacagcttttggttcctgcagacgctggtgaaaaaataatcatgagaaagaaatccaccttatgtcgtcttttttgtctgcaaaaataaactcagccatcatacagctaacaggtacagagggaagatacgagctctttcataggaagaaatcactgagaaaatgagcatcatttctcaaggtttttattttcactgatctacaagtgatgctgctgtaattgtagctgcagtttttaccgatcattcaccactcagcagctggtagagaagtaagcctgcttggcaaccacctgcagggctgcagagatgaattacattttcggaaacaacacacttctatactctcgcggcagtcgaggaggcaatactagctctagccatggctcagcaggcccaaagcagaaacactgggcaaaaaagggctcgtcagatgaactgcaagctgagccagaaccttcacgctggcagcagatagttgcatttttcactcgaagacacagctttattgactgcatctcggtagccaccagctccacccaggtaacataccacttgttgaaattattttcaatctatttctgtttacgtttgctctgtaaaaatgtcttaatatagattttttatttaaagaatagccttgaaaccttggatgtgtagaaatgtatgttttctgtccatccgtgtaggtctttagcacaaaagggggaacaagaaatatttttccttatgctcttatgtaataccaaacaaaatagcctcagattcaattgaatgacttttctaaaaatataagcccattgatacataaaatatgaattaataatgctcatctcctttttagactgtgctaaatgctgtagagtatgatgtctgaccaaagaaaatgctgatttgtttagtttttgtatgttattagataaccttagggagactgttacagtaaagaaacagaagatactttgaaatattttcatttttcagtgttttgaaaatagattcaatttaatataattggctagtattatatatactgacatcttagctatattatggcttattcaagggatttaatgaatcgttttttgtaaatattatttatctagcttaatttgaaattaagtgaacttgtgcaattacacagtcatggaatattttttcacatagtcaaatcacaatttaaagagatgagcaaatactaaaagtctctcaaaattaaaaaaaatcacataacaccactttttgaggaaatgagctattgtctatgggaggaaaaataaagaaaaattaataattgtttgaaatacctattgtttgctacaagggtggtttgaggaaatattcatatttctaaatatttttaagcagtcagttcaactttagtaaaaataaaaggacgagaaatggtctaaaaacaagttgagaatgcatttgtcctctgacatcagtgatatttaaattaggaaaatacatacatacacattccttaggaccttttaaaataaattcccttaaagctgtcttttaaagaaaataatagaagcagctcaataaatataaactataactgtcaacagttctatatttctttatatgttttttataaatttctttactgtttttggttactagaattgtcttttaatggtgttgatttaaaataacatcagctttcttaagtaagaaattctacttacttttctcaaatatttgggagaaatggaattacctaggaagggggagtcattatgtaggcattgaggttaagttacaatcaaaacttattgaatgggcaacgattgatttaactcttaaattgaatactgccccaagaattttactaaccttattttgactgcaattacatatatcacgaaaggatgcaaagactaaaggttgacaatgttattcattgtagattaatactagatgatattttccattgtcaacaagacagatatctttagaactttttatatatatatatggtttatgtaaatgcacacccttctatatatgtatgcacagataacactagcattgatatatctgtcactcggtttattaaaagcaggcaaatgaaaagacaggaaaagtagttcatgtataaagtgttgaaaccacagagttacgttatagccgcttgggagtaggagcagaacgttgctgtgattgcgccagaagagagtcatgacccctgttcgcagtcagctctgcaaagccattttacatgacagcccccacccagtttggttcagagcattcctgtatgctagtatatgagttattaatagtttttatttctttcagacctctttcctgattctcatcttgtctttttcattacctttctattttatttctagaaataggagtattagggtagaggttttagcttctgtttttcttgcactggagtaccaacattttgtttttcattttatacatttttgtaactgatacattggatagtttatatatcttaatttttttataacttactggagttgatttgacaagttaaaatataatgggactgaaaaataacttgagatataattggatcttacttgatactagaatacttttttaaattgcacttactgactcatggctggcagctttcttttgcagcactaagggatttattgttagaaacaacgtagattgaaatttcatacttagagcatataatatatacctatgaatataataaggtcatagtgttttgtactgcgattggtaaataacagaggtctcttatttcactgatgtcaaaaatactctaagatttgacagaaagattaactttgaatctaattccatatgactaagccacatgatactttttgcagattggagagttgttataaatcaagttctattagtatgaaaactatctggtttagtatcccccccaaatacagtatgaaaagtatctgatttaatatccccccaaatatacacaatacataaaaagaacctgtacttattttacagattcatttaaattgcttgtctgctggaggtattcatgttcataactaagattatgtgccattttctactatgatactggaactcaggaggaagtcattaatgttttttgaatgataaggaaactgagtggttataaacttttgcaagacacctagcttctcagttagggtttggcatgtagttggtgttaataaatgcttatagaattaattaatttttattccattcacctcaaatgttatctcctggccttccaaaatatgacacctaatctaatacctcttcagtacctgtattgattggatcttctctcttccctcacaagtgtctttggtttttcacagcagcccatctccttttccactgccttttcttcccctccattcttcatactatcctccagtcacactgccccgattcccctgatttcctcacccctttcagtccccactcagtagtgataaccaaatagcttacacactgtctctcagttttatcatttcattgtatctcattttacattgtgggttttttgagaggttgttttattttttaatgttaaataaaaatgagtttcttatgaattacattggtgaaactttttcagtttgaggcttcatagtgtttttgtccttaatttcaaacgattagtatagaaaaagttctctatgcattgcgaagccctccttggttccgcaccctcagcgtccctcctattcttgtgttgagggtcactcaataatcggccccgtcctacttagcatacacagtcctgttccaatctgggaccagtttttatattcagcagggttttatagaactccagcacagtgctgctagactttacttgattaacgcctaggtgaaaagttttatttacttagtgatatcgacgtttattaatgtcagtagtaatcatatgaactttaaataactgtgaagtgttcagtcattttgaatgtgtgtatagcagctattcatacattttggactacttgaaaatctcaacatatagagcactataaatactcaaaaagcccccccccccccaaaaaaaaaacacaacatgccaaattaagctgagagcagcaaagctgtattcttaggaatatggaacagacatgaaaacttgtcagaattgaaatagaataataaagttttcttaaagagtaaatattagctgagttgaataatctgcttagaggaaaaaccctgtcctaagtcaaaaatataggaaaacattgttcaagtgcctgtgtggaaaaatatttaggctaatttgtacactttaaaaaatattgtttgtctgaaacagatgccttctgagttatagaggatttaatttttagagctatgcattggatatattgtccaatagagagaataacagtatcagtgtcattgagtcacttctaccaaataatttaatgtatatattaataaagtacttaggacagcatctgacacagagtaagtgctacattagagttaggtgcccctgttagcttatttttatatcatttaactctaatagtatatgaacaaattcagatatagattattaggaattattgcacctaggatagcgcagtacattcaaacattcagtaaatattgttgactgattaagttaatttgtaagtacaagccatccactttttttaagaaccagagatctcaacacctttaattacaggatttaagggaggtgccccaaagagcctttgaaattcttgatgagactaccagttttttgacctttcctcccctcctagcactcccttctacaaattggtgaaaaccagtcacgtgtagatgactaaatttaagtgattatccacttggtaccaagctcccctaagcatcccccaaacatatcatgaggactatttttagatcctaaatcccttttagcctgtcaccacagaaagtccagaccatccggattgcagctctgccttctctataccaactcgcagactgcacgttaaacttccaatacctgattcctggtcttattctcaaataaataatcttgctttgtgttccagcctgctaaaataaatgaactgtgtgcctaaagcttacccatattcacttctgtactagatcgtagtccctttggttgttcaagaacttctgaaatccctttctctcttcactgcatcatctgtcttgcctctgtactgcccctagacttgcctctataagtcctatcaggatgtacacctgctataatatctttcattaaaacaaccatccaaaaaaccctcgttgtgtgagtgtagattatcaaatccagtggccagttctcagtgttcattttacttgaccctacaacaactgttaacacaattgattactccctcctctaaattcttttttctcctttgactcgtggatagtactgctcttttaatattctaccagcctcattttcctttatagtatcctcctttttcctactgctaaatgttcaaatgtctcagggctcagtctttgaactctctttttatactcacatttcaggtgatcgcatctagtcctatgcccttaaataccatcagtatttctctttattccagagttaatccctgtacattagacttttatatctaactttctactcagtatctccacttcggttaagcatctgaaaggtaacatattaaaaagagaatttctagttttattggtctcaatcttctttattcagtatgccattcactaagatgctgaagacaaaaacccttaaaattatcttttattccttttttctttgctccgtatccagtctgatgccaaatcctgttggctttttattcaagatatatttatgatttggccacttttcaacacttctgcaactactgattcaataatatgttgcctgaactacagcagtagacatctaacttctctcgttaatattttttgcttcctctaaggtagcaccccttcactccagacattactctgtcttcttacctgattctttattatacattttttactgtctttttacttgactgtcagctccatgtgggtgggatttttctgttatgtttattgttgtatcctcagtttctgtgacagtggctggcacactgtagataaccagaaaatatttgttgaatgagtgaagagacagggacatacgaacttgtgctaaggagggcccaagcaggtgtgtttgtctgtcttttcccttagactttctgtgaagcgcgcatcacactttatttagcattgtaatagttctctaactgatgattcttacttgccctctgagaagaaatacacacaaggaaatgaggtagggagagaagagaattcaatttcctcaaaactgggataactatataactcagaccaaactaggatactttaatgaaaagagggaatcattaataattaaagtgagacaacaggcataaatacagacttcccaagtaaatagaggcatatggggtcactctgttataaccatttattttctgactattcccaccaggcaacaggtctgaaattcacaccaagacatctccatcttggaccatcctagattgattgacctaaccgtgttatcggtacataccacattcattttgtctcatgtgtaatgataattgtgttttgataaaatattttttcttcatctccaaggaatggaattgttcatattcattagtgtagtgcttttgtactaaaaagtagactacgtatagggtaggtagacaatcttcttaaactgctttgaaaatactgactctaattgataggttattttccagagaaattggtggaaatagtctcctttggtattgactccccaaacattcacagtttggatggaaacgctgttgtactggctgtgagatgctgacccttggcagacacatttgtttcttaattttctactcaaaaggctactaactttgcgaaattaatatgatgactcagacttggaaatcaattgttccccctttgacacaaaaaatattgtaggatctattttatgtttctgtttttctggaaacttttacagtgcacctacatgtactgactcaaaaattggttcttaaacactgtttcaacacatttttatcatttgtacaataaataaaaataaataaaaaataatataaaaaataaaaataaaatttatatcatttgttcaataggacactctagaaaagcatagagatgaagattaaaccaaaagtagttggttacaatggttatataagcttttttaaattacaaaattgaccatacgatccagcagttgtactccttggtatttgcccaaatgaattgaaagcttacatccacccaaaaacctgtacagagatgtttataacagctgtgttcataattgccaaaacctagaagcaaccaacatattcctcagtgtgtgcatggataaagtgtggtgcattcagacaatggaatatcacccagcactaaaagaaatgagctatcaagccatgaaaagacatggaggaaccttaaatgaatattaccaggtgaaagaagccaacctgaaaaggatacacacccttgtttccaactagatgacgttctggaaaaggcaaaactatggaaacaataaaaagatcagtggttgccaggggttaggtgagagggataaataatagagcacagaggatttttaggacagtaaagccattctgtatgatactataatggcggaaacgtcattaaacacatgtcaaaacccatggaatatccagcccccacagtcaactctcatgtaaattatggactttgtgatgtggcagtgtgggctcattgattgtaacaaatgtacattagaaatgcaggggtgttgattatggatagtttatgtgtgtgagcagggggcatatgggaactaaaactgctctaaaaaaatatataaagtctattaaaaactataaaattggtgtcttaatgtagattagattggcttagcttgaagacatttgaaatttatgatataaggtctttatagttaggaaatgtgttttattcttctttgtagcttctgtatagtgtcttgattgtttagatggcgtttctgtcaaggatagataggcaaaaagaagtttcacaggctataatttatatattctaaatatattcagagaagttttaaagttaacctttaaaataatgtgttaataacagtgctgaaaagtgactgaaccatgcttatgggatcagggcaagtcagcctgagcaacatttttctcctgtattttcaagtaatgtttgtttgcatgagaattgtacttcatacctcttatcacgactctaattcagtagtcatttggataatgattttgtttaatgtcagccactaaactgtaagtttcacaagagctgatgctacagggtgtgtggttttttcccttggtatccccagagcctcgcatggagaatgcacttgataaatatttgttgaatgaataaacagatgttatacaggtgttaatttttatttaatctgctgttgacgaagtggaagtttggaacttctaaatattgttggatcactgtaaatttcccaagccatttttatgtaacactatggcttaaaaactagcaagtctatgttaccagattttgtaaagttgtgaatttcagaagtaattcagatccttctgtgaaaaaattgtgaagcatttatactcttacatatctgaagaacttaaatttttatcatgaaaattttacttagtatcagtctctttaaataaattttcttaaattattccttgtacttcctggcactattatttagataacatttccagccctccatttttatagcaaagtttagaattttgataaaggtaaaaatagttgttcagactatgtagagaacagtagcctacagttaccaccttttaaagaaaactttaaaccaactgatgtggtaattttaacaggcgtatgcaaatacaaaccaactggcagtgccacctgggagcagtggaattttatagaagcctatacacgcaacttgcccctccaggcatttatttaaaagattttccctcctcacttcgtaacaggagcacttcctattcattctttttcctttaagccccaatttggtagcatttctgaacagtattttcagtatctgtgaaatcaaaactctgacttcttgactggagcagctttgaaatgtgaagaagttacagctgtgacagagtggaaccaaatgattgctttacaatttgtgttgttttgttgttctgagaaaaagaattggggattataacctggtgtttaattatttgttaatttttttttaacagccacgttcaagagcaataaactggcatttaaattaaaacagatcccaccctcatttatctgtatataaatctgactaatcttggtaggatgatctgatgtatcaaagggttataaatttggaaagaaatcagttggaaagtattttgtaagatagaaagaaaacaaacaagatgcatatcaatattaagaattaattgctttagccaaactaagtaccatagcaggattttgaagggagaacaaagaaaagagaataaaaatcatatcattttaatcactttttttccaaactggaaggctatattcagtatagaggcaaaattttttcagttgtaagagcacagctttattatatagactttttaattaaagatattttaaagaactgtaggtgaaacttgaaatttccatatgtatatcttgtttccttgttttttaaattgtcgcttccatggtttttggggagagagaattggcttatttttattgtagactaagaattgcaacagaattaaaccatttatagttagtaaaagttaacttaggtgtcttaaagccattttctattttcttcattgacttatttagccttttctttctccttttttaaaagcagctaaagcaggagtcagcaagctacaatctgtaggccaaatgtagcctgccacctgtttttgtaaataaatgttttgttttgtttttgagacagagtctcactgtgtcgcccaggctggagtgcagtggcgcgatctcagcccactgcaatttccacctcccgggttcaagtgattcttatgccccagcctcctaagtagctgggattacagatgtgcaccaccatacctgactgactgggtttcgccatgttggccaggctggtcttgaactactgccctcatgtgatctgcctgcctcggcctcccaaagtgttgggattattacaggcatgagccaccatgcctggcttgtaaataaagttttattggaacacagccatgcctatttgtgtattgtgtatgactacttttgaactacaatagcagtgttggatagttgcaacaattactgcatggtccataacgcttctttttttgtcatttccaaaaatgtttgctaacccctgatctaaggattgatgcagtatgtatttctttttacaggtaatatatattgtctttgcagtaaaatgtagtggtaacaataaagacaaaatctctttttgaactattttaaagagataagtaaagagtactgggtaagtgtaccatctttagaggatgatgacctggatttaaatttatattctgccatatcgcctgtgccaccttgggcaaattacctccatgcggagtctgtctcctcatctgtagaaaatggggatgaaagtgttatctttttcaaaatttaatgagaattaaatgagacaatatgtgcaaagcacttattataatacattaattacatcagtgaggtcatcatcatctttatcaactacccttttatccaccactaccaccgccaccaccatcattttcatttcaacaaaatattctgacctttaaatgaggaatctagagatacggagaagcaaccatgttttagctagagggttggtaactttaatagggtgcagccagggaaacagaaaccacagcaactaacaataaaaatacactacatgggattggttagatgagtattggagaactggaaaggcaaaatgagaatgccaaggtaaaatcgagactaacttacagaagtagctacctgtaggggaacaaaggacccaagctgaaattagtggaacctcagaggaagggcaccatggattttaaatatgagccctcagtaagaagttgtacttcctaatgcagtttgaatagaaaagcgatgaaaatattttaagcaaatatgcttgaccaagacatgtttattttcaaatgggacattattaggcaattcattattgctagatagagaacaacatgaaactggcaattttttacattttgaaacttctgttctaaggttatcaaactgtaaaacatcttgaacaccttctgattggtggtggctgcccagaaacacagaaataaccttttagcaatgtctactatgtatattgcatgaaagtgggtaggggaaggaagactgtacctacccaatctattgcccaagtcattttagagtgctgattaagttgatttcttttgacagtcgcatggttttattcattcaacaaatatatattaaatacttcctgtgtgcacttttctaggcactgggcatataggagtgaacagaacagaaatctgctctaagtagaagaagacagataataaatataattatccaaaatgcagtcacatgtcagttaatgggaatacggtgtatatttatttttgtatataattatacagaagataaaaagtatagtataataaatatacaaaccagtaaaatagttgttaattatcattctgaagtattatataccgtacataattatatgtattatacttctgtacaactggcagtgaggtatatttgtttacgccagcgtcaccacaaatgtaatacattatactgcagcattacaatggctatgacatcactaggcagtagaaatttttcagctccattataattttatacatgtggaccatcattaaccaaaatgttgatatgtgacgtatgagtgtatatggtattctggaggaaaaataaaggaaagaaacaatagaaaatgtgtgtatttgtgtgggggaaatagaagaaggcaacttgagagagtgataacagggacctgaatccttacagacttgtagagggtgaataatacaaggcaaatctgattactgggaagcattaagggcccattttaggttattagtcatgaagtctgtggttttgcttatttctctagccacattctgataaaaatcaggtaaaaaagcacattattgcatttggtaattttatccccatttgtcaattatgtaaccatatattgaagttttagtgtctgtttactttgaaatgtttcgtgtttggctcatcctttactaggacaagattgtcatctgaatgctgatagaatactgtcttttcataatggagggatgagaaaccttaactgaatattgtgagtctcacaggtagagatagattcatgaactagatgatctgtctgtgtgaactaacacacttgtactcatgtttctgtaatggaattaattgctagatctgttttcctatttaccttgttttgttttaaatttaatgattttaatacccttagtgatttgtttaaaaatgtgtttagttttataattgtttgcttgtgagatagttatgacatggaagtcatatgaagctggttcaaataacatattgttggttttttactataccggcttatgtgaaagatacctgtttgcagtgacaggaccaaaggacatttgaataaaaaaacagatttaaaccataaaaatcagctttttctgaaggtactgggcccccgttgagtacagtgattcctaagcagagtttttataaatctactgtgctatattttatccttctataaacattcaaaaggcttgcagttttttttagtttctctcttacttttaaatagcttctttgacatttaatcagagaaacatgccacattacagcataatacatctttaaacaaagaaccaaagaacttagattaggaatattaattatgccatacaaaaccaaaataagatccttactaacccacagtgacacgacagttgatacttttccttgccatctaagatattggtaccaaaagatttgctaattcatatatctcattttctctaaaaatatggaagtgtgcatacaaaaattaactcaagatagattaaagacttaaatgtgaaacccaaagctataagacaacctaagaagacaacctaggcagtaccattctggatataggaacaggcaaagggttcatcatgaagacaccatgcaattgcaacaaaagcaaacattgacaagtgggatctaattaaagagcttctgcacagcaaaggaagctgtcaacagagtgaacagataacctacagaatggaagaaaatttttgcaaactgtgcatctgaaaaaggtctaatatccggcgtctataaggaacttcaagaaatttacaagagaaaaacagtcctattaaaagagagtaaaggacgtaaacagacactgttcaaaagtggccaacagtcatgaaaaagagcttagcgtcactgatcattagagaaatgcaaatcaaagccacgagataccatctcacaccattcagaatggctactttaaaaaaaatcaaaacaagagatgctggcaagtttgtggagaaaaaggaacacttatacactgttgatgagagtgtaaattagttcaaccattatggaagacaatgtggtggttcctcagagacctaaaaacagaaatacaattcaacccagcaatcctattactgggtgtatactcaaaggaatataaattgttctgttataaagacatgaacgcttaggttcattgcagcactattcacagtagcaaagacatgcagtcaacctaaatgcccatcaatggtagactggataaagaaaatgtggcacatacacaccacggaatactatgcaacaataaaaatgaatgagatcttgtcctttgcagaaacatgggtggagctggagggcgtcatcgttagcaaactaatgcaggaacaaaaaatcaaataccgcatgttctcgcttataagtgggagctaagtgatgagaacaggtggacgcatagagcggaacaacacactggggccggtgtgaggggtggagagtacgaggagggagaagatccggaaaaataactaaatgggtactattcttaatatgtgggtgatgaaataatctgtacaacaaatcccagtgacacaagtttacctgtgtaacaagcttgcacatgtacccctgaacttaaaataaaagttgaattaaaaagatacagtagtgaatctttgtgtatattcttaggtcagtttacccccttcatataacgtgttaatgtaaaatataagcattattagctatcagatagtatgttcatttatcgtctttggagttgcatcttatgctatgaaagtcattttaataaattagtgagaaaatgtttttaaatatatttagatagccttgcaactcttttatacctgagtcgaactcttgtataaaagatcatttttagtggctattgtgagtgttaataggccttcctcactccagacttctcatcagtcaccaagatataccaactctacattcaaaatgtgtcttgatttgactgctcatatgtccattaccaccattcagtttaagccaccaataacctttcagctggattattacagtaaactcctaattgtcccttctgtctcttcctgtattaatcagggttcatatgcacataatgaaaaccacttgagtgctttaagcagaaaaggctttaataaaagtagtaggctcattcaatatacatttatttttcaatgaatcaaagtgagggagggcggtacatggtcataaatgtggatgtgcagaacagatgcaaatggctgtatgtagtgagtgttcagaccactttatgaaaatctgttttaagtgctgcttttataattttaagatcttaaattagatttaaaatataaagctatagagaaaattaatctctaaaaacaaatcactttaaacatttgttcagatagccatccatttgatactggtttttaaaaggtactttaaaatatgtacaatatatccaattttgtagaaatttacaatttccttgtgacggtgttaatatcatagcctctgttgccatggaaacaagtctctgaaggcagcctcagaggctaatgattccatgatgttgctgtggatagaaacaactgagaccgttgctagtcacatggtcaagattttttttaaaacaacaacagaaaaactttagatctcatcttattgagtgatacaaatggagcaaaacaaggatgatggcataacagtcactgtctaatgaaatagttatataagatttttcaagtttaaaatgccatactgaattctgtaataaccaaaatataatggttactgtatattgctgcttcattatttatgttagaatcttaagtttgacattttctaatttagaatcttatacagctccccggagttttaccctgctctaaaacctttgcccaaagcatcctgtgatcagatctgatatctttgctgttcctcatcagtcagccttcatttgattattatttgtttagagctgcatttttgtttcaagtgaactaaatgaattactttgttgttctgtaattgtttgttaccagaattggttatcagttgtgattagggaattgtgtgtgttgatgcgtcgttgactttctcagcggtgttggccttaaggaagaggcaggggcctatgttcttcaaggaacttggtcagtgccctgtagagagggggatgggttaagatgctgtaaactgggaatttttttaaatggtattcacatcctcgtctaaagaaggtgattctagaagaggctcagagacagagggttacaagtgggattaaaatgtaacattaaaggattcatggtttatcataaagggttttggagagcacctgcccagtggagaaaatttttgtgctttgctttgaaatttgacataagcatgtacttttgtcttattttggctatcaaagtagattattaatcagctattatcctattgttagggctggagactgttaataagaaaacatattacatttgtgacattttcaaacacttaaaaaataaactttagtgtccttaaaagaaccaaaccaaaacaaaaaacaacagaggcacaaggaagcttttagaggtgatagatacgtttgttactttgattatggcagtggcttcatagatgtatgcctatgtgcaaactcatcaaattctataccttaaatatgtgcagttttttatatcacttctacctcagtaaagttgtttttaaactagaataaaattgaattaaaaataacgttagactttcatgactttgacacttttgatgactgcagctagttactttgtaatgtatcactcaatttgggtttgtctgatgtttaatgattagattcaagttatatacctttggtagaaatatcctggaagtattgtactctcattacattttatcacatgatatatgattttgatttttcccgttactggtggtgttaactttgatcacttgattcagatattgtctgcagatttctccactgtcattaatgctttgaaaggagacacttttgtatgagtatatcccattcatccactggaatggacgtttcacttggcaacaggaagttttaatattcattaatatttcttgaatgaattactctattactatgatggctgccaaatgatgattttataattccatcattacatttttagttagcattttgttgtaagaaaatgctcttatcttcatttatttattgatgtatttatttatatcagtatgggctcccagattcctattttattcagtggatgttatgccattgttatcattgagttacagattgttcccagtctggccagtggcagcccttcaagccaacttctgtgtcctttgtcatcctctttgagtacttcccttatcttctggtacagcaagatgtctacacacatcttgtgcttgctgagctctagcactggagtcagccatttcttcaaagacccatggtttggttttgtttggttttgtgttgtggtttttttccccccgagacggagtttcgctcttattgcccaggccggagtggaatggcgtgatcttggctcactgcaacctctgcctcctgggttcaaagcgattctcttggctcagcctcccaagtagctgagattacaggtgcccgccaccatgtccagctaattttttgtatttttagtagagacagaatttcatcatgttggccaggctggtctcaaactcctgacctcagatgatccgcccacctccgcctcccaaagtgttgggattacaggcatgagcctccgtgcccggccatgttgtgttgttttaaattgcagaatgagtatttagaaatcaagatttggatgccaggtgtattcgtgctgttgagctgttagctgcatccaggtcctcatagttagcagacctatgcacatatatacacacacatttatgtctatatttatttttgtatttatctatatatattgaaaactgtttataccaatacctccaattttagtgtaacaccataggtctcatgctaattttctatcttttcatatttataactgccttttctgacgcaaggaaacctgctgtcagtatccttcatgtatttatttattggaccagaatgccctgtatataagcaatctcctgtcatcattgctgccctagttggacgcccttctcacgctgctcaggctccagaagatcccatttagtccactgacagcacaaaaccttatgccagactgcagctactgcctcatagatgctatctgtctcacttgggttccaaccacacacaggctgccgccacggctttgtccatgtagacaccctcgtcaccatgctgaggctccagcaccctttgccaggctattgcctcccttccactccctgcctacagatgctttcctcaccctgcgtgagcttcagcaacatgcactttcctattcaggaggtcatctgcaccaaggttgtgatgatactctaccatatcatcctctagaagccttatattgtttacttctctcaattatgtcagcaaaccagctgaaattaatcttatgtatagtttaagggtaggaatcagtatttgtttgatttttccatgtgtatatccacttgatccaagcacagttcttacaaaaccaccacgcttttcttatgcattcataaatcagaagtcagaacctatgggttttcaaacattcttagaaggccatgtaaatattgcagtgagtatcagttacgattgttattaattttgagctcataatgtggaattcagaattttttttctccaggaacaatatataaatggtgattggagtcccgagctaaacccacggaggctttattcgtagtatacttttttattgtgttaaagtttacatcaagtttaccattttagccatttgttaatgtacaattcagtggcattaagtacattcacagtgttgtgcaagtatcatcactctcaatcttcagaacttttcatcatcccagactgggaacattgaaaagaaagagaaaacacaaaatccaatgctttaaaaatctctttctacaggaaataataaatccaggtaacaggagtccagagtgtgaaatacattttcagtttgttttctagagaatgacacttaaagatcataataattgtttttctgttaatattcacaatggatctcccatccttccccttgcatttatattaataacgccactgtgtattccttgtcaacaactggaaaagtataattcagaataaagaagcagcgatagagaaaggcactcatgatcccaccccagagattaatttttcagacatttctttccattttttatgtgtttcatcttcccttttttacttaatgttttgtcataagcaatgtcccatataatttataaactgttcgtactgataattttaaatttctgtatgataatctcatataattttcttttctttctttctttctttttttgagatagtcttgctctgttgcccaggctggagtacagtggcgtgatctcactgctcactgcaacttccacctgctgggttcaagcagttctcctgactcaccctcccgagtagctgggactacaggcatgcaccaccgcacctagctaatctttgtattttttttcttttttttttttttttagtagagacggggttttgccatgttgaccaggctggtctcgaactcctaaactcaggtgatctgcctgccgcgtcctccgaaagtgctaggattacaggcatgagccaccatgcccagcctcaatctcatagagttttcattttttacttaacaattctgacacctttgggtatttcaaatattccacgatttaccaaatagaagcagtgttcaaaagactatcttaaaaccttagaacaccttatgggagtaccttaaaacataggcttttaaaattatttccttagggtagatttctagaattactaagtcaaagagtttagacttttttttgaggagggggagacagagtctcactctgttgcccaggctggagtgcaatggcgcaatctaggctcaccgcaacctccaccttccaggctctagcaattctcctgtctcagcctcccaagtagctgggattacacgcatgggccaccacacccggctaatttttgtattttttttttttagtagagatggagtttcaccatgttggccaggctggtcttgaactcttgacctcgcgatccacccgcatcggcctcccaaagtgctgagattacaggtgtgaaccactgtgcctggccaagtttagacatttttaaagctctagatatttactgccaaattactttccctaaagtttgtgtgaatttgtatatccaacagcagtgtgagaggaccagttttcatgcatttttaaaagcttttttggaatattttttattggtaaaatatgtataacttactagtcttttaagtggaatcatgcaatatttatccttttgtgtctggctaatttcacttaatgttttaaaggctcatccatcttctagcatgattaagaattttattcctagggctgggtgcagtggctcacacctgtaatctcaacactttggaaggccaaggtgggtggatcacaaggtcaggagttcaagaccagcctggccaagatggtaaaaccctgtctctactaaaaatacaaaaaaaaaaaaaaaaaaaaaaatagctgagcatggtggcaggtgcctgtcatcccagctacttgggaggctgaggcagagaattgcttgaacccgggaggcggacgttacagtgagctgagattgcaccactgcactccagcctgggcaacagagcgagactccatctcaaaaaaaaaaaaaaaatcatacccattgtgtgtatattatcacgttttgtgtatccgttcatctcctgatagacacgtggtttctttccgccttttgactgttgtgtgtgatgctgcattgaacattggcatacaagtgtccaagtccttgctctcacttttgggaatatgcctacccagtgcatatttacctacccaattgctagatcagatgctgattctatggttggtttttaagaaaccactaaaagtttcctcagaagctgtaccattttacatttcccaccagcattgtaccagagttccagtttctccacatccttgccaccacttgttactttgttttttgttttgttttaattagacacttcccttgtagtggtgaagtaatctctcattatagcttttatttgtattaccctaaggactaatgatgtcgagcatcttttcgtgtgctaattggccacttgtataccttctttgcagaaattattcaagctcttcacacattcattaattgggttgtttctctttgtgttgttgcgttgtaagagtctttaaatgttctggatattaaacccttatcaggtgtatgatttgcaaataccttctcccattgtgtaggctgtcttttcacttgcttggtaatgccctttggtgcacaaaaggttttaattctgttagagtctaattgatttttttctttcatcatttatgatttctaaggttccattaccaaatccacggtcacaaagattaaccctatgttctcttgtaagagttttatgttttcaaatctcatatttaggttgttaatcaattttgagttaatttttatatataatgtgagatgggggtctatagaccttcatcttttgcatgtggatatccagttgtctcagcaccattgttgaagagactccatacattgttaataaatcttaatttgactaatttggtaggcagaaaagatcattgccattttattttgcatttatgaatgaagataagccctttttttagtctggcaatttgttcttcctgttttaaggcctgttaaggcaggctgtcctcatctgcttgattttagtgtttttcttacatatataagatattttatttatatagcaaatgggtcttattactaaacaactttcctgtgttccagtttcatccttttaaaaataacaagccagataaaacagtgaactttttagtttaatttataccaggttctctctacgttgttttttcatttttgccagatatgtctggcatgtaatagacaatcaatgttagttgaattaattacaggcatgttgaggcaagttattactgttcttgataacagaagttagtatcacggatttgtaaactctctttgtctgcctgattgggctaataaaattacttttagttttctgaatgcatagaggaaagtagtgagatgtattctgagtgctagaaaaaatattttgcagtctgtctatgaagcaagtgtcttatctcccagagaaggaaggaatattgtaaatgataatcttttattattatgatttaagcatctaaagagtaggcattcattttattacagaatcattaaaattattatgggggtataactttctaaaacaatttctagagaatattttctcatttatattagtgtaatgtattaatgtttttcctgttgcatagttatttctgaaaactataatttatctttatggcacagctttttgttatgtgtttcccttttattttggtgtttttcctgattttttgtcattgatgatttttagccaacagaagctgttcttccctctcctcccactgtccctgtgatccctgtcctgccagtccctgctgagaatactgtcatcctacccaccataccacaggtttttattagtttcttttttctttataaaaatttcatttgcttttaatgtttcatttgtgttcttttttaaaactgtttgagctgttttttgtaatttggtaatttactttgggcttcagttagtagttttagggacttaaacatttgggatttaatataagtggagtcaggatttgccattttattaggttgtctgtgaaatgggacacaatgaacttcataatattgaaccttagatttgttttcatgcctttgtacttagaaatctgcttaaaacagtttttaaacatttttactttagaacactttattcttctaaagttagtaaaaatcattgtactcctgatcttgtaccaatgtatcattttatttaacactttgtttcctgttatatatttatcttctttggaaatattcattcttatgttatttgattagataacacacttcacatttattaggtaaaaataatagccaacatatctgggagtatatgggaatgctctgtgctatcttcacaacttttctgtaaatctgttgtaaaattttacttttaaaaaattatgtgtaacagtttaaaaataatagccaaatgtgagagagtctaatcatttttagtttttcaaagctttactacttccaaggggtggcttgagacattaactgcccttccaacagttatccaaagtcaaaataatggtagtggtattaaagataataataaagatctttggtgtgaaagatcacgatctcatttaaagtgtaaataaatgaacccatagatttttttttgccattattgatctgtagcctaaaatctgggtaaacatatgtttgctgtgtaaacagtttcaaaataagctccattggggaaaaaatgatatatcagctgtgattattcacatctcagtgcccttcccctctcctaaaaagtgaagtcagtgggaacatccatacaaccaaggattctaggggaaattacagtgttacaatgacttcagccttactgtaataagactgaattgtaatcattataataatactgctactatataatttttgattatgaaaataattaaaaattaagtcataaaaccaacaatgaatagatgaatccaaatggatattctctctatattgcaggaaaaaaattgaatttataaataaaatataattctgagcaaacagtttaagggttattatggcatcataataatgtaacatctttccaaatatatagagtttattagtacagttttttttttttttaatagaattgaaagtttattttactcttctcacttcagtcaattttttggtgttaaaatagttttctggaatcctttgagaatttgtaccagtctctttatattcatttgggagcctgtcttttcctattcagaattctctcatttatttactccaagcaaccctaacttagcatcccactgcatttgaaaattgttgagatcttgcatagtcttataaaaatacacgttttaaagtcagaatgacctggggttggaattccagtcctaccacttaacctgtgtaactgcacacttcacttaaccacagcgcacttccatttactcatctgtaacactgaagatagacaggagtactaacttgaggcgctttacagtgatggagaggatgcttaatgcacgtcaggtactggcacataatcttagccgcccatatttttagtgttatctcatatttctctgagacagcaaactaaggaacaagttttgttttgtttttttaaatgaggatatttattgaggatacacacaaaaaagacctatttattctgcatagcttcactttaggttttaaatacactacggaagttcatgaaagatagttttaccatttttgttgtgttatgtgagaagccaatgagtgcacctcattttccagaataagtgtgttcctaattagtgaagtacaatgtgtacattataaaattaaaataatggactaaaatatccgtccccaagtaaaatttaaaatacatactaacatataacccaatttcaacatattaagtgaatatgtattcttaaaagatccactactttacatttagatgcgttaggatgtattagaaataaaaacagaagaaaagatttagaatctagtctgtctttgccactcaagctagttaccctctctgagttttatacccccttcatctattaaaatggggggtaacgccaacctgactcctttaaaatgagtttgagagtcaggcaaattagaaagatacatagatgaaaactttttaaaaagtatatagtctttcatgatttgtagaacacttttatacttttcagagtactttcacattgatcatattgtttgtactttatgaaagtcttctacaaatcagaattatgcttattatacagagtggcacagataaaggtaatatttaatggctgcttaatattgcagaaagaacgtggagtttatagtcctacccgactccaccacttcctagcttcacctgtttctacgtgtgatggtgtggaaattactcaacttctgagagcctcagtttctccacatagaaactgagtacagagtaggtgacagttactagttcttcttactgggagtgtaaacacataatctctgtgatactagcctattaaatccagaggcttatttgcaccctagagtaaatactctgctttaaaactagatgttttaaacctttatttctatcagttctgaaaagctatcatgtaattaaagtattgttgaaaatgctttaagagctaattttttgtgcatggtcttttttgatatttgaatatgtgctttgaagatgaatagaacatcgtctctgtcctctaggggcctactaggtgtttgtgcaagagacaagtttaacaaatagctcccgcataatgtgagagtaattaccttagaggtatgtccagagcagagcatcatactgcctctgggctttttttttttttttttttttttgaaatggagttttgctcttgttacccaggctggagtgcaatggcacaatctcggctcaccacagcctccacctcccgggttcaggtgattctcctgcctcagcctcccgagtagctgggattacaggcatgtgccaccacgcccggctaatttttttttttttttttttttttaagtagagacgaggtttctccatgttggtcagactggcctcaaactcccgacttcaggtagtccgcctgcctcggcctcccaaagtgctgggattacaggcatgagccactgcatccagccagttgtagaattttatatttccaccaaagtgcacaaggattccaatttctccacatcctcaccaacactttttattttctgttttcttcatagtagccaggctagtgggtgtgaggtgacatctcattgtagttttgacttgcatttgtgacacatctgttcatgtgcttattgtccatgtgtgtgtcttctttgggaaaatgtctgtatgagttccttgaccattttttaattagggtgtttggttttatcgtcgagttttaggagttcctctgtgtattctgggtctcatgtcttgtcagagattacagacaagacatgtctgtacctttgtgtcatatccaagaaatcattgacaattccagtgtctcgcttttagcctgtgttttcttctaacagttttaagttttaggttttacatttagatcatgatccattgtaggttgataattgtatatggcatttatttctggattctgttttattcccttctgtatgtctgtctgcatgccagtaccagactgtttctgttactgtaactttgtagtaagttttggaatcaggaagtgttagcccgccacctttgtttttctttttcattaccattttggctttcagggtaccgtgaaattctatgtgacttttaggatgggttattctatttctttgaaaaccctactgggattttgataggaattgcattaagtctatagattgctttgggtaatattgacatttttgcaatagtaagtcttccaatctatgaccacagatcccttcccatttatttatgtcttcttaatttctttcatacatgttttatagttttcattgcccaagttttttactttcttgatgaagttaattcttcatttaggaggctcagtgttctgaaaatttgttcttttcgatgctataataaacagaattgttttcttaatttccattttagattgttcagtgttagaagaaatacaactgatttttgtgtattgactttgtatcctgctactttgcttaattggtttaataattctaacagtttttgtgtagaatctttagggtgttttacatataagatcatatcatttgtgaacaagtaattttgcttcttcctttctaatttggatgtcttttatttctttttcttgcctaattgctttgacaacaacttcaactattcagctagtggtcatgttgagtacaagtggtgaaagcagacatacttgccttcttccttatcttagaggaaaagctttcagtctttcaccactgagtatgatgttcactgtgtgtgttttgtatatggtttttcttaggttgacatagtttccttctattcccatgtgcacttgagaagaatgtgtgttctgttattgttagagttctgtgtctctttggtatattgtgtttgttcatctcctctatttccttacttatcatatgtctggttgttctgcccattatggagaatgtggtattgaagtctccagctattattgtagaaccatttctttcttcaattctgtctcatttttgctacttaacattttgatggtctgctattaggtgcgttaatttttgtaattgttacattcctatattgaaccttttattaatgtataatacctttgttgtctcataaccttttttttatttaaagtctattttgtctgttatgagtacagccactcctgctctcctttggttactgttgcatgaaatacccctttctgtccttcagtttcagcatatttgtgtctctggatctacagtgagtctcttgtgtacagcttgtggttggaacattttaaaatttttattctgccaatttctgtcttttgattgaagagtttatttacatttaaagtaattattggtaaggaaagacttacttttgtcattttgctatttgttttctttatatatatgccttgtagcttttttgttcctcatttcctgcattactgtcttctttggtctttgattaattttttgtagtgaaacatttaactttcttgtttcctttgtgtctattctttagttatattttgtgtggttaccatggggattacatttaacatcctagacacttctaatctcaatttgtacaagcttaactgcaataatatacaaaacctctgcccctttaactgctctgtcccaacccctttcagttgttgatgtcacagaattacatcttcatatattgtatgcccaaaaacagaaactagtaatttttaatgcgttcgtttcttaaattatgtaggagacaaaatatgaagttacaaatcaaagttataatgttagcttttaaactaataattgattttcgttatttaccaatattgactttgtttattaatattaggcttatttatttatttatttataggcagggtctcattctgtagcccaggctggagtgcagtggtgccatcacagctcactgcagcctcaacctcttgggcccaatcgattctcccgcctcagtctcctgaatagccatgactacaggcatgtgcctaccacacctggttaatttttgttgttgttgctgttttgttttgtttgtagagatggggtttcaccatgttccacaggctggtcttgaactcctgggctcaagccatctctgcctgcctcggccacctgaagtgctgggattacaggtgtgagccaccatgcctggctaggctaagttttttttttttttaaatttgaaaatgtaatggtctcttcaatcatgtggaaaaccaaaagcagatttacataaccattgttacaatattactaactagtgtttattattacctatgtatttacctttactgagatctttatttcttcatatgactttgagttgctgtctagttttctttcatttcaacctgaactgctacctttagcacatctttcagggcagttctagtgataacaaactccctcagcttttgttcatcagagaacatcttaatttcccccttaattttgagggactgtcttgctggatataggattcttagttgacaggtttgggtttttttcgtcttattttagcagtgagtatttccacccactgccatatgacctccagagtgtctgatgtgaagtctgctgataatctcattgaggatttgttgtatgtgacaagtcacttctcttgttgctttcaaaaatctccctttgtttttggcctttgacagttctagtataatgtgtctcagtgtgagtctgttggatttcattattgtttattgagcttcttggatgtttatattcatgtgtttcatgaaatctgagaagttttggctattattcaaatattttttctactcttttatctgtcatttctcatgcaactcccacaatgcattagttggtctgcttgatgatgtctcacgggtcccttaggttctgttcacttttcttgaatctcttttatttctgttcttcagactcagtactttcccttgtcctatctcatgttcactactttttttacctgctcagatatgcttttgaatctctccagtgaattttctgttattgtacttctcatttcctgaattttataatttttatttctcttcattgatatttccgtttcgttcatacagcactttcttgcttttgttcacatcttttaattcttttttttttcttgagacagagtctggctctgtcacccaggctggagtgcagtggtgccatctcggctgactgcaagctccgcctcccgggttcacgccattctcctgcctcagcctcccgagtagctgggactacaggcacctgccgccacgcccggctaattttttgtagttttagtagagacggggtttcactgtgttagccaggatggtctcgatctcctgacctagtgatccacccacctcagtctcccaaagtgctgggattacaggtgtgagccactgtgcccggccatcttttaattctttaataaagtctttgtctagtagatttgctatcaggtttttgtgggtttttttggttttttggttttgttttgttttttttgacagagtcttgctctgttgcccaggctagagtacagtggtgtcatctcggctcattgcaacctccacctcctaggttcaagtgattcttctgcctcagccttccaagtagctgggattataggcacctgccaccacacccagctaattttttgtatttttagtagagacagggtttcagtatgttggccaggctggtctcaaactcctgaccttgtgatctgcccgcctcagcctcccaaagtgctaggattacaggcgtaagccaccacacccagccttatttttttttaaggaacagtttatattgatttatattttttttaataagccacttattcttgtttatttaaacagcacacttgaatttaataatttggtaactctgaaaatcagattctccttcttctccagggttttctttttttgttgttattgtttttctgattgttgtaggctatcaaagatcagcctcaggtgtaaacgtagggtcttcttagatattttctgagcctatgccttcccctgggcatgcacagtgactttctaatttcctccatacatgtggttggtttttaatgtcctagtcttcaatgtctggctcccaaaaggggaaaaagaaaattgaattggtgtgtaggaaggggaggcctccagctctttcaatctcctggaagtcagttcagcctgggaggttggggtggggtttccaacaatgaggaggaggtggaacagcagtatccagggcctgtttgcacctttgtgatgagaagcagcattcagagcacagatctccagtatttggagaatgtaattttctctgcccaccgtggcttgtgcaggcggtacacagttgactgagggatagagtgtggggagctgctgctgtgctaagcctgcaggtcactgaaattaactacagttcacctggaagttgccagccttcagtagactccaagttccaaaacatctacatcagacacatgctgccactaaaattgtgttcaaggtggagaaacagatttgtggtgcttcctactctaccttctttccagaatccaccccatttgtttttacaatcattttaacctgcagtgatcacctcagtcatagcatttaactttgaatgcaatgtgtctcaaattaggatctaagaagaattctctggagtttgtgagttttgcattggaaaagcacttgtaaagcacttgttcataattgagtagaggagaaagaaacactagacaaataacataatgaaactttgatcaatgctgagaaggagaaatacaatgcagattgtaaaagtggattttctaaactattttgacctattttaaaataattggatcttagaatgtattttaacacgatttttaaaaatgtaatattgccctctgaaactttgtaaggctgcttcagtctgttacagcagcaatcactacaagatcctttgttgatgaaatagaatggtaaaatttgggtgagccatgtgcccagccaataaacttgacttttttttttttttttttttttttgagacagagtctcgctctgttgcccaggctggagtgcagtggtgctgtctcggctcactgcaagctccacctcctgggttcacaccattctcctgcctcagcctcccaagtagctgggactacaggcgcctgccacgaagcccagctaatttttttgtatttttagtagagacggggccaggatggtctcgatctcctgacctcgtgatccacccgccttggcctcccagagtgctgggattacaggcgtgagccaccgcacccggcctaaacttgagttttaaaaagtcctaccctgggtgacagagcaagactccatctcaaaaaaaaaaaaaaaaaaaaagactttgggatccttaaccaagacagcgagtagtagaacaggtaacatggaaaatcaaacaactacaactaaaagacttggaaagagtctacgtgaaattatttcagatgaagaaaaagccctcattgcaccttggttcaagtgaccctgtaatctcagacctggttctaggtctctctatacctccctctaccactcagtgacatttgagtataggtaaatcacagttattattaaaattcattttctccatctgtgaaaagatagcaatacctgtctttacccagggggactgtgtgaggctctagagaagtaatataaaagaaaatatgttgcaaatcataggaagctatagaaatgcttattctgttactaaaatttatataccattgtgtatagttccaacttggacaacagtgaagctctataattcacttagagattgggggtagaggcagtaaaagggcaaggatattccagaaggaggaactaaaaagcccctaaataatttgacccaagcatcggtaataaggcttaagaaacataattttgctcacccatgttggccagactggttttgaactcctggtttcaagtgatccaccagccttggcctcccacagtgctaggattacaggcatgagccactgcacttggctgaatgccagtatcttaatagcaaccctgacccagagtatttcacaactactttagctattaacctctttaaaactgagtacttggctcaaagtgattttttggtttactttttattatgcaaaatttcagaaatattcaaatgtagaaagaatagtacaatgaactctatgtatacccatcaccagctgcagcaatcaactcgtgtacttctatttgattcataacccctcctactcccaaccttccattgttttattttgaagtaaatataacaccttatatcatttcgtttatatatatttcaatattagcgagactttctaaatgaatagaatcaaaaggtaacttctataaaatgatgatgagttggtactgataaacagctaacataataattatggtataaattagattttgataaaaaccaactttttccactgcatgtttggtaaaaaatcggcagagggaccaaaaggctttcttgccatagtgtttttaaaatgtaatttcttttgtaactttaaatatcctattctttcttgcccttttcttctgtaattgcttaagcagaataaagtgaagttgtattattaatttttttagcaacgtaaaataccagtttgagtaatctcaatataccattgggaaataagtaatttgaaatattcataaaatctcaaatgtctgtaagttgggtagctttgcttaaatagcagttttataagtacaatttttatttgttgagtggactttcaccgaattattcaaaggtagactattatttaatggtgggactaaacataaagtattatatttaattttatttttatatataatgaagtattagctactcatttttaacttactgcttgatgtagcccaaatgcatactgtttaattttttaaccatgaaactaggttgtctttaagcattttgtcatatcatttagctgtggtactgtgctgaaaataatgtgttatttgaagtttgaatattcccctttattaaaagcctgtacatttggaagaaaatggttattttgtgttacagtgttactttatacagcttttatgtataattcctcaggtaattgaagtagaaccattaatgtgtgtaagcatatcttctaaagtttgtttaaaggatagtcatcttttttattctctgaaagtgttatgtgacttggtactttcataactttaaatatgcagaagaaagaattttgaggggaattacatcagatttttattatatttttcatttgttattgcattttattctttagtttcatatacataataatttctaacctaaccagaaaaccaagattttttttcaatccaaacttaactaggtgtgtgttattctgcttatttttcttgctgtaataaatcactgttaattctgtgagtggtctagaataactggaaagcagtcattgcagctgaaaataatcgggtttttacattaagagtgtgtttttagtttctaaaagtttacaattgatttctttctgtgatgaacttttttttttccttgtttaaaaacagttcactgtggggaagaattttctcctgggtgatgaaatgattgaaatctttactgtatctttgggaagagaaaacaatgatttctaagcaacctaggaagagttattggttacactaaagaatattcatgggttttatgagaaggctatggtgatctgtgtaaaacttaagaaaatcatggctgctttagcagaaatagcaatttatttcttaaaagcaaatctgttttaactgcttatacataattttttctgtttggtgctggagaaaggatatattatttaacatataaaaagctcatataagattataacttaagaaatagcaagtctttcctatgcctctaacattgtgaacatgaacatgtaatgttttattttcttgttaacacatttacaatttcttcttaaaggcaaatcctcccccagtactggtcaacacagatagcttggaaacaccaacttacgtaagttccatttcctccccacattgaagtaattctgcctttcctgttccgttttttgatacaaatgcgaagaccatggcattgttttctctaatacatttctcttaagatgttctatcactatatactatagctgtaattgctatagtaaattaagtagtatggtcctcctttggtcatttttttttccttttgtaaagcagaaattttgaaatagaaattcgtaatttaattcagaaattatgatggctaactttcacaaaaggttgtctctgaccattggttgcttacacagtgccatatatttaaatcattttagaagtctaattgaatgactagatttttagtaaccaggttttttttgtgcattcatatatacgaaaataattagttataactttgtaattttaaattgatcagggacaaaagtccacttgttgcataattttattatatgaaagttccagaatagataaatccatagttactgaaagtagattagcagttgccaggtggtgggtgtagggcagaatggggagtgactgctaataggtacagggtttgtttatggggtaataaggatgttctggaattagaaagtaatgatgatggcacaactctgtgaataaactagaaactactgaattgcatactttaaaaaggtagattttatgatatgtgaatatctcaacataatttgttaaggtaaaaaagtagaaaaaggtgagttaataacataaatgcaaattaaaacaattaatacatcttaaacattatgttatcaaaagagcaaaaagtttgtcagtacattctgctggtgacagtatggggtaaaaatatactgctacatttttgttgaagtttaagtggataaaactttagaaaatgccgcaatttcgtgataatgattgagtctaaaaaccattatttttatattttttcttttgtaactttttgtattgtatgtaagaagccattgcataatccaacatcacaaagacttagagttaagttttcttctaagagttttatggttttgcttttagattttggtctttgattcattttgagttgatttttgtataatgtgaagtagaggtccaacttcattcttttgtatgtggatagcatcactgtttgttgaaaagactattctttccgcattgaatggtcttggcaaccatatagaaaatcagttaactgtaaatatatgggtatatttctttaattcctttcaataatgttctttagttttctgtgtacaagtcttggagttcttttgttaaattcacttctatgtattctctctctttttttttttttttttttttcttgagacagtttcactctgtcacccaggctggagtgcattggcacaatctcagctcactgcaacctccacctcccagacccaagatgatcctcccacctcagcctcccatgtagttgggaacacggacacgtgccaccatgactggctattttttttttttttttgtatttttggtagagatggggttttaccatgttgcctaggttgatcttgaactcctgagctcaagtcatccagcccgcctcagcctcccaaagtgctgggatttcaggggtgagccatcatgcccagccagtattttattcttacgatgctgttataaatggaattgttttgtttatttttggagtttttattgctagcatatgggaatataattgacttttaggtgtttatcttttatcctacaaccttgctgaactcatttattacctctggtagttatgtagtttgaattttctatatacaagatcatgtcactggcaaatagagatagtttacctctggatgccttttatttcttttttttttttaattttaaaggatgggaaacttcaggattttattttttgttttttggattttttttttaatttcagtaagtttttagggagcgggtgttgtttggttacatgaataagttagtggtgatttctgagattttggtgcacccatcatctgagcagtgtatactgtacccagtatgtagtcttttatccctcaccccagtcccacgctttcccgagtccccaaatgccaatgtatcattctcatgcctttgcatcctcatagcttagctcccacttatgagtgagaacatactgtgtttggttttccattcctgagttacttcacttagaataataatctccagttccattcaggttgctgcaaatgccattatttcattcctttttatggctgagtagtattccatggtgtgtgtgtgtgtgtgtgtgtgtgtgtgtgtgtgtgtgcacaccatatattttttatccactcatggaaaaatgggtatttgggctggttccatatttttgcaattgtgaattgcgctgctataaacatgcatgtgcaagtatctttttcatataatgacttattttcctctgtgtagatacctagtagtagaattgctggatcaaacggtagatctccttttagttctttaaggactctctgtactgttttccatagtggttgtactagtttacattcccatcaacagtgtaaaagtgttccttttcactgcatccacgccaacatctatttttttttatttttttatgatgaccattcttgcaggggtaaggtaatatcacattgtggttttgattttcattttcccgatagtgatgttgagcacttttccatatgcttgtcagccatttgcgtatcttcctttgagaattttctattcatgtccttagcccacttttggatgagattgtttttttcttgctgatttgtttgtttgagttccttgtagattctggatattagtcctttgtcagaagtatagattgtgaagattttctcccactctgtaggttgcctgttaactctgctgattattttgttgtgcagaagcttcttagtttaattaaatcccatctgcatatctttgtttttgttggatttgcttttgggttcttggtcatgaagtctttgcctaagccaatgtttagaagggttttctgatgttatcttctaaaattttaatggtttcaggtcttagatttaagtttttgatccattttgagttgatgtttttataaggtgagagatgaggatccagtttcattttctacatgtggctagccaattatcccagcaccatttgtcaaatagggtgtcctttccccactttatgtttttgtttgctttgtcaaagatcaggtggctgtaagtatttggctttatttctgggttttctattctgcttcattctgtgtgtccatttttataccagtaccatgctgttttgatgactatggcctcatagtatagtttggagtcaggtaatgtgatgcctccagatttgttccttttgcttagtttggctttgtctgtggaggctcttttttggttccatatgaattttaggaatgttttctctagttctgtgaagaatgatggtggtattttggtgggaattgcattgaatttgtagattgcttttggcagtatagtcattttcacagtattgattctacctgtccatgagcttgggatgtgtttttgtttgtgtcatctgtgatttctttcagcagtgttttgtagttttctttgtagaggtctttcacctccttggttaagtatattcttaagtattttattttcctttagctattgtaaaaagggtcgagttctttttattttattttattttatttatttatttatttatttatttgagacagtgtctcactctgtttgttgcccaggttggagtacagtagcacaatctcagctcactgcaacctccgcctcctgggttcaagtgcttctcctgtctcagcccccaccctaccccaccccttggcccccgccctgagtagctgggattaaagacgtgcaccaccacacctggctaatttttgtatttttagtaaagtactcagtgctacctaaaaagccccttttatgtgctgcttagaaacctacatcatgaattggcattaaattaagcaccaggaatatttactgagcacctaccttgtgaggaaacttaaaggtgaaaaatctcagattccttaaggcagaaatcataaggtcacagtatcaaaattttacgttaatgccaaaagggccatataagcacactcatttggaaatgttttcgaaaataaaattttagattatttagaaataaacaaatgaacaaaaatggagctcagtgcagctagcagttgtgggatttggcctaatccatatgccaaggaaaattggtaaattttgaggtttctaaaaatagaatagagtaagcataaattgagcattcaactcaaaaatcttttttagaaaatcaaaggactaaagaactgttaaaaacagaaagtaataccatgaaatgtaatagattcatcaataatgtcaaaactgcttattcgataaagactgatagacttttagcaagtcttgagtaagaaacaagatgatgcaaataacctttagaataagaaaggggatattgctgcaaataaaaattttactcgtaacaaaggacttcctgtcaagtaggtaagcctcccgtactctagatgcacagacatgatcaacacagctcttgaagttactcctcctaaactgagataaagagattttacgtgtgtgtgtgtgtgtgtgtgtgtgagagagagagagagagcaagcaagcgagctcctggtcaacatagaccccatctctatgaaaaacaaaagtaaacagccaggcatggtggcatgtgcctgtagtctcagctactcaagaggctaaggcaggaggatcacttgagtccaggagtttgaggctgcaacgagctatgattatgccactgcattccagcctgggtaacagagtgaaatcccaactctctctatataaatgcctttataacatataatctctaagaggaaaatgtctatagatgagaaagaagagggaacaaaatagtaatagggtttgaatctaggagaatcacaagagttaagaacccaaaagggtagtagagatgggcttcaaaagttctcaaggaagaaactcctggtccctatattagacctgaattaagggctacattttatagtatggttaagaaagcaaagtagcttatgtaggttttgttatttctcttgcagttatctatcattgcataacaaactaccctgaagcttaggggcttaaaagaacaacagttcattttttctcataatgaattggatggctctgctttacatggtgtgggttagggcacttgacaaggttgggaggtccaaatagccttattcacgtggctgatagttggtggtgctgactgctggttaggagtgtagctggggcttttggccaagggttttggttctctgttggttagatctctctgtaggctgtttgagttttactcatgttatagctgctgggttctaaagaaaatatattccaagcaaaggcaaataatactatcaggcatcagatgacctagtctcagaaatcacacagcatcatttgtgccacatttattttagtcaaagctagtcacagggcttgcctagatctaattgaagaggaaagagactccttttgatggtagggtgatttagttatattgcaaaagaatgtctggaatggaagatgtgagccatcttcagaagtagaatttatcacagtccacatttgatttagatagagttttgcccagcctcatatcacgagaaattttaaaggaaggattcaaacccatgttcatctgattccagggacttgtttcaccagtggcctttactgtaggagttaacttctttcaggagagactaggaaataaattggagggagataaattgtgaccaagatatcttgaatggtgactgattttgacataaaacatgtaagtgaaatttgtgaccgaggaggcacaaaattccagatgtcgaagtggaaaattgcaggatatgtaatggaaagagcaagtcgttcacagaaagggttggtatgtaaggcctatgaagaggtgaagaatgaagggaagtagtacattggggtcagttcattcgaagacatgattaccaacccatagagtttggatatttctaggaagggagagttgtgaaagttttagaggaagtatgttatgggctttaaaaagatccagctgttgccaggcacggtggctcacgcctgtaatcccagcactttgggaggccgaggcgggtggatcacgaggtcagaagatcgagaccatcctggctaacacggtgaaaccccatctctactaaaaatacaaaaaattagccgggcgtggtgggcaggcacctgtagtcccagctactcgggaggctgaggcaggagaatggtgtgaacccgggaggcggagcttgtagtgaaccaagatcacgccaccactgcactccagcctgggcaacagagcgagactccatctcaaaaaaacaaaacaaaaaagatccagctgtttaaaacagtgatttgggcagtggggaatactaatctaagcgattaggcagactgcattgacagtattccattccagaggaggttgaacaaggcctgaacaaaggtattagaaatgagagtgaagaggtgatgattttccaaaaaattaaggtgttcaaatcagaaacagttggtaactgattagatgtgtggatcaagacagagaaggatcggaggttgaaactattaaaagctgaatgtacctatcctggatttgaaagtcatgataccacgaatgttgtcaactcattaatcacatttgtatttttccattccttgaaaatcttccccagaattattaaaatgaagctattgtgtttgattactgtcgcattcaacaggttttcattaataaatcatacaaaaattttgccttgccattttggattttacactctgaagtttctgagctgcttttcttttcccctgtaggttaatggcacagatgcagattatgaatatgaagaaatcacacttgaaagggtaaaaactattatcttaatctgttgttctagagaactttgtaatatactgctttttcatacagaatccaagggagatctctcaaaaacagaactatatgatattttctaagttcccagttcataaaattggccaaggtattttcaaaacatttgccttttctttagtaaccttatttttttaataaactttttattttacaatagttttagatttacaaagaagttgtaaagatagtcccaagagtttccatttactctggattcagcctcctctattgttaacatcttctattactagagtacatttatttcaactaagacacctgtattcatacattattattaactgaagtctctatttccttactttttatgttattctctctcagaggcccatccaggaaactacattacgtttagttatcctgccgccttagacccctctagattgtgatagtttctcagatttttcttgctttttaattttgtttatattgtttatatgcatatgataatgaagtattgttcgtattaagtaagtagtatactagtaacatggtcattatatcaattttcttttctagcaaaataaccatacttctaacagacagagctgtattaaaaactaattatggtatacttgcccaatcagaaaatgacttgaaggtgcaattcagatgtgcaaattttcttaagatatgtttttccctcaagaatatctgcactcacgcctgtaatcccagcactttgggaggccgaggcgggtgaatcacttgaggccagaagttcaagaccagcctggccaacatggcaaaactccgtctctactaaaaatacaaaaattagccaggtgtggtaacgcagacctgtaatcccagctactcgaatcaggagaatcacttgaacccaggagtcagaggttgcagtgagccgagatcgcactctagcctgggtgacagagtgagactctgtctaaaaaaaagaaaaaagaatatctgcattcagtttttattgtatgttataatagtaatgccaccttatctggctagcattttatggaaatctagtgtttcacacaagcagatttcttaagtaactaaatgtgtgtatactcaagactgaaatcctagataattagatttatttatattggaatagaatctgagaaaaataaatctgagagagtctcttacatgtatatctttattgccatctacttaaattcggatcacttgctcaagttgggtggctactggagtaatattcaagtaagcacagtattaatgtactgtacatactttaatatagtagtttgtgatgtctcctaactttttatattattgattttttatcttttcccagggccttttaaattccttttgtttagttaggactatacattgtatttttcactggttgaagaacttgagtacctaagtaatttggtaacctcccataatccactggtactgttcttaagattcaggtaattcatgaagttagattgaaaaacatttttttattaaaatagaattttaagacaaatggtggtagagtgggtgtttacactgtttaatactaacagttaaatgataggtccacatatatttgcttacttgagttgcctgaaattcagttagaacattcttcaagaaataaacattttttaataccattggttaaatcaattatttttaaaggctttttgtagcagtcgaaccctttctgtgaagaacatattcagaaatcttgtttctccagttcataaaacaagcaaaaagtagagctgctttggcaaaatttactttgctgtcaagaaaattcaccaatgttaagttctcaggttggtctttcagtcagtgtgaaacaatgccttttgctaatcgggtatattggttaaacatgtcagggactgatggcagctatcacttagcagccacaatttggtcatttaaaaataagctgatgtcaagttagcagaagaaaagcaccatcgccacccccttttttaaaggctaaaacagtatatgggttttgcctactcagaaataacagcgggaagatcacttcagcatttgtctcttaggagagatgtgccctaccaaacatggctgaggtgcagtctaaaagaaacagacttacagtgacacctctgcagatgggtgactaatccaacgacaagttgcacatacttttaaagaaagaactgtggagtatacttcaaaagtccttggtgtattttcttgaacctcacctgttcagcagtaatgcctctgaaaggactttcctccagaacaagtccatttaatttagaatctttatattactcacccatatacctttatttgttgtgttccttatgttagtacagtttctgcgtcctttaatgacaggaacctgtccataaagataaatcatattcagtctcaattttttttcttctatcctcagggaaattcagggcttggtttcagcattgcaggaggtacggacaacccacacattggagatgactcaagtattttcattaccaaaattatcacagggggagcagccgcccaagatggaagattgcggtatgttttgcgctttttattgtgatgctgaatccactttgtgtatttttcttgaagcagactggataagggataaatacaaataacaaacacgatcatgataactagcatagggtagatgctttaacaacattcaagtcaatgaatgagataattatgctctaagcattgtgttcctgttttcatttagactccagttttatcttagatattataacattttgaataacaaatttggttgatggtttaaatctttgtgagcatatttatagaaatcatgagtttccctttgtgttttcagatacactcacagaatattttccatttcctctctggctgggaaacatgtgtataaacttatttaagtacactcacagaatattttccatttcctctctggctgggaaacatgtatataaacttatttaagatacggaggatagaggatcacacatccatgttgaatcccacaccacaaagactatatgcaaactttaaataatatattttcttattgactagatgaaaataacatttgtctctgtttaaatttagtgttccattttggaagatatattttgcaaactttgattttttgagggtcataaattatgtcatttttcctatttccttgtttgttgttcaaataccctgaagttttaggactaaagagtttatgtagtctgttaaaaacagcatcttattttaaggacgttgatgccttacgcagtttttgaatttctaagctttataattctcactgggtatgacaggtggtatattaatgaaatcaaatagatataaaaattaatcatttgaccattcatgtaaatgtagacatttacttcctgattctgttagatatagaagcttgtcaggaccagttttaatattttaattatgttttgtttaccctctctacccaatttgagatgaccatctttttttcctggtggaataccatgcaatcaaagagaccagaactagggaaaaggctaagactaggaacaaatcagacttttaaaaaacataacaccatggcaaattataagttctttacctacgaaacctttgaattaagtgacctaatctttatataaatttcaaaaaataacttaattgttttatgtctaatatataggttggaataggcactcagaaaattatttttactttatctcagttttcacactatctctgtgaccttaaactcgtgatgtgagcctcagttttcttatctttgaatcacagctctgtcacttattatctgggtggccttaggaaagttatttacattctttgtgcctcagtttctccatctgtgaaatagggattaaaatatatattaagcttacaggtgtcatgagggttaaaataccaagaaagtgcctggcatgtggttagtgctaaataaatgtttgctatttttataaagtgtgtcttaatgcctacacagaataagcatgcaggaagtatgcaaatggtagctgtaattattatttaacatttttatataatctattattttcactatttcttttgttccttttgctggcccttgggaaatgtttgtatttgtttatattagtttttgatatactttcttcatttatgttttctggaattactccagaattatttataattctctttaccttaaaaaagaagtaacaaaaaattggtaaagtggaaaatttatatttaaattatatttaatttttatttttaatatttaattgttttctcagggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtatgtggtaagtcaaactaagataaatctttaagaaatctctgagttaaatatacctatgaactttatctgtgacatacattccaagtacagtattagtaatattctacagaacttgagtggattttaatttctccgttatttctactgatttttgtcttacgtagcattttagaatatttacatttctaccaagattgcagcatttgaaaagttcctttttttgcggggtttttttgtttgtttttttgaggcagggttttgccctgtcaccctggctggagtccagtggtgcagtcatggcttactgcagcctcagcctcctgagctcaagcgatcctcccacctcaccctcccaagtagcttggactgcatgcacacaccaccacactgggctgattttttttattttttgtagagacggaggcctccctgcattgcctaggctggtctcaaactcctgggctcaagcagttctcccacctcagccccgcagagtgctggtattacaagtgtgagccactgcacctggcccaaaattcttacgtttattgatgtatgcttttatacattttactgcagtgagcatatatataaatttataagttttttatgatttttatattcaatatttgctcagcatgtttttaagagtttttaaaagtagggaacaaaatatctatttgttttataagtggatatgtccctatttgtattaagtattcttatattgaagacttctagcattaaaagagtgaaatatttgtgtccttgaacactttgaagtttagtattgctattaacttgtgataatctacaaaatactttaaatgcaggtacacaggctaagttaaaagaagaagtgtttataatatgtattatgagcagttacatctgcagtaaaggactgttaagatgtgattgctgaatttttaaaacattgatggcttgaggataaatggaaatagtagtttcaatatgtggcttcatggaagagggaggatgtcaacaaatgaaaaaggaatggagagctgagaaattatctgatattgaagctatgggatttaggaattacagaaattccttacttaaaattgttaattcatagaatattgaagaagaacaaaggtattcacatttttaaagcctgttggttctgcccaccatcaccagacaatgttgttatttcttctcaataattttgttcttgtgaaaatattaaaagtgtaggtaagcataattatgatggaaacaaaagtaaaacataatttcgcaatgtcactttggaataacaagtgcatttgcgaaaagatactaagaaggaacatgtgggataaaaggaatctattcgtaactctaggagcagctgtatgtctaagtgtcccttgattgcagaacatatactagtagataactaaatagattcttttctattttaaaaaatattagtgtgagggaataattaccttgtagttttcaaccatttctttctgggcttaagttcatatttatggatgagaatctagaactgttttccaaacaggtcttgggtttagcattgctggaggtgttggaaatcagcatattcctggggataatagcatctatgtaaccaaaataattgaaggaggtgcagcacataaggatggcaaacttcagattggagataaacttttagcagtaagtataagaaatctattgtcttttaaatcattttgtagtctgtttatttttctgatagatactggaatttctccataccaaaaaggtctaaatgatgtttaaattagcaaatactagccttgctgtatcaaatcctaaaaaatgattcttggtaattctttatttgtcatttctcttttctctgctagctcctcctcccttttccttttattcctttgttgttgttgagggcttgtatgcacagagtgtttcatcataatccttaggtttataaaacaatgtcatcatttgtttatgcatgacccttttttattttacttcacttaatagtataatgaaacctagtaattacccagcccaagaattagaacatcaaccattttgtgtttcttattcctttgcttcttaaaaattgtttaatcaggccgggtgtggtggctcacacctgtctgtaatcttagcactttgggaggctgaggtaggtagattgcttgagcccaggagtttaagaccagcctgggcagcatggcaaaaccctgtctctacaaaaaatacagaaattaaccagacctggtgatatacacctatagtcccagctccttgggaggctgaggtgagaagatcacctgagcccaggaggttgaggttacagtgagctgtgattgtcccactgcactgcagtctgggtgacagagtgaaagcccatctcaaaaaaaaaaaaagtttaattatatacatatgcctaaataattttgtttagtattatttgttttgaagctttttcaaaacactattgcactgtatgagactttcatctccagtatttttttcactcaatattgctttactgagacttacccatatcattgcttagagctaaagttcattcattttatctctacatactattccactgtatgtctgtactgcaatttatttgtccagtcttcatcagtgtattagtttgttttcacactgctatgaagaattacccgagactgggtaatttataaaggaaagcggtttaattgactcaccagactcaggaaacttacagtcatggtggagggtgggggaaagcaaacacgcccttcttcacatgccagcaggagagagacgtgccagcagtggaaatgccagatgcttataaaacaatcacatctcatgagactcactcactatcaagagaacatcatggggagccacctccgtgatctaatcacctcctacaaggtccctcccccaacacatggggattacaattcaggatgacatttgggtggggacacagagccataccatatcaatcaataactgtctcagtccatgttccttagggaaacggaatctgaagaaaagctaaagtgctaaggtattatttggctgtgtgatctcaagaaggctagagtgagtaaaaatgaggagtgaagcagagaatgaacgagagccaatagaaggtagaatgtgtctgagctggctgtaattttataaggtagcttgttgcttgtcatgtataacagtcttctaggcagacactgtaaaaaccatccgggcatcataaaccttacatccagccatccagagaaaagaaagaaaggtttatctgctggcccttttattctcctgtctcttgtctaccccctaggggttatttgtcccaagcttttggattgtgttacccaactcccctgggcgcagtttctagggaagccagctcctatactccatggcacaacacttcacccaagcccaaaaatggtagagttgcagtggtatgacaggtcaaacataggtttgtgacatgttatggccctcactgtgtggaacacatcagccatgcccagtcccagccagaagaggctcagaaaactgggaagggcaggagacaagatgaaagtagtataatagtcaggactctccactgagcaagcagccaaggcctagcagaatctgaaaaggcacataaactggatctggcatagtaggaagttggtttttaaaaatatactagcaagtactggtttttaaaaatctattttaagtcttttttttttttttttttttttggtattatgaataattttcctgggaagagctgctgtgtgttctggtgaacatgtacaagaattttacttgactgtcatgggattattgattatcctactagtagcattctttttaaaaaccatcctgttgttttccaggctgcttgtaaaaatttacatcagcaatatataaaagattcctttgttctacatcctgtttagtactgtttattgttgcaaggagactttttttagttaatgatggcgaaaaggaaagagcagaacttgaactatgtttctctaacttatcctttcacagctaagatcaccactctttcctcaaactataaccagtaccatctcaccatcactcatcactcacacacaaacacagtcaagacagccttctgttgcactagttttctcagttttactttttaatttcttggctaccatgttttcctttatggtttctctagaactggctttggtggtaggagacagcaacctgtgctgataccattgtggcaagtctctctcttaaatcaacttttagtgaggcttttgttctcttaattacactggaatcattcaattctcagtcctcatcttaattgacttatctggctggagtttgacacaccttcctccttctaacactttttcatttgcctaatagtcaccctttatcttggtatttctcttcttagtagccactcttcattctgtctttctgatgtctggtgcctcctcatatctgtaacctctaaacattgaagtaatccagaactcactccttgtccattttctcctttttactattcactcccaaggtcactgtttcttaatgtgtagaagacgactctggtagatggtcaaataacttttctctggcgtaaaactttgggatcatcatcttacacatttcacattaaatccctcagcaaattgtgtcagctcttgtgtcaggtatctagtgatatgtgagaaaacacagagattaatggctaaaaaacaccactcatgtatttgtttacaattctgcagattggatagggcttggcaggaacaacttgtctttgctgtactaggccacaaaatccactgttaggttggctgacacatatggtgggcaagttggctcttagctgggaactcagctgggactgttagccaggtgcttaattatccagtggtctctttgcgtggttagggtgagtttcacacaggatggtggctaggttccaaaagtaagctttccaaagaagacaagcactggtacattgtttttatcaatcttctctttccttcacaactactgtacctcattggctaaagctagttacgtggacaagcaaaattcagtgtagaaagagatttttacaagggtgtgaataccaggatgcatggcttattgtaggccaccaaagaaacagtataccacagctatttaatatgtatttcagcagtataccacagctatttaatgtgtatttcagaagtataccacagctatttaatgtgtatttcagcagtataccacagctatttaatgtgtatttcagcagtataccacagctatttaatgtgtatttcagcagtataccacagctatttaatgtgtatttcagcagtataccacagctatttaatgtgtatttcagcagtatgccacagctatttaatgtgtatttcagcagtatgccacagctatttaatgtgtatttcagcagtatgccacagctatttaatgtgtatttcagcagtatgccacagctatttaatgtgtatttcagcagtatgccacagctatttaatgtgtatttcagcagtatgccacagctatttaatgtgtatttcagcagtatgccacagctatttaatgtgtatttcagcagtatgccacagctatttaatatgtatttcaaaatgcaggcagtccttgctttgcatggtaatgtggagccataaaaatgaccatgctgctgagactctgcaaagcaatgttaatcatcagtgaagggaaattattattctgtgacctttacatttttttgtgaaaatattaaaaactgcaatagtcaactataaaggtacaaattaggaaaaagtgaaaaatatattaaagttaatattgttaatacatggtaatttaaaacggaaacattgataatgttttacttatttgcaaaaaaaaaaaatgtatcaaagagaagaacaatccaaacctaaagcaaacagaagggtggaaataataaagattagagcagaaattaatgaaataggtaatagaaaagatgtaagaagacagacaaaactgaaagttggtcctttgaaaaaaaaatcaacaaaatgacaaaccttcagaccagccaagaaaaaagagagaaggctgaaatttctgaaagcaagcatgaaagagggaaaacaagagactattatgagtaactatgtgctaatacctgaggtaacttagatgaaattgacagattgctagaaagacataaactaccacttctaatcagtgttatagttgagattctatccagggcaataagaaaagaaaaagaaaaagaaaatcagattagaaaggaagaaataggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagctgagatcccgccactgcactccagcctgggcgacagagcgagactccgtctcaaaaaaaaaaaaaaaaaaaaaaaaaaagaaaggaagaaataaaactatatttgctgatgtcatcatattgtatatagactatcctaggaacctgctaatagaactaataaattagtttagtattggttgcaggatacatcactacctaaaaatcagttatatttctatacagaagataggtgaatggccaaaaaataattgaaaaaaaatcaacttgagtattacgaaagtagaaatttaaaactaattgatgtataaattaaaagatgcatcattttacagattttttaaattagttgataatgtttaatgttggcaaaggtctaagtagatgggcactctcatattctgtggtagtgagtataaatttactaaaaccatttaggagaacaatttaaatatttgtgctcaattgtgttctaatagttttccaatctaaatatgggaatattaacagatatgatctttaataaattatgatatagccacacaatgggctactgtgcagctgttttgttacaatgtagtaattctattaatttgtgtcccaacatggaacagtctctaaggtaccttacattaaaaatcctaacataaaaacaaaaattttagtatgttttcatttctttaaagataaaaatgtctaaaacgcatccacacacattcctaaatgcctaagaatgagagaaaatcaagactgggagaataggaggtatggagactggaatcaagatgggctattctgttaacattcaacgacttcacatgtcatgataaacaacttactgagatcatagacatcaaacatgggtattttctttcggcatacctttattttccttaaaccactctcttattttccctttcttttcgtgaaattgtttccaaaactcagagaacaagtgaatatgtcataaatgtcttttgggactttttttaggtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactgtaagtctgttagcatacgtttgcttaaatttatcttacttcttcagttgtgatgccattagtgaaatgttctcagtataataaagtttaaacattatgcaaatatttttaaagaaacaattaagcatgttaatctactcattttttaaaatctactttaagtcaaaatttttataattagaagggggggatccttttcacctttattattttatagtagtagttacatttaaaggattttcaaacttttatgtaagtaacagtcactaaagaacatttgcaaatattgaaattgttttgttctaagttttccacttgagcacagaaatttgcttgaacaagccgttcattctattaacaagcaaagtacaggcatacctcattttattgggctttgctttattgcacttcacagagactacatttattacaaattgaaggtttatggcaatcctgaattgagcaaatttatcagcaccttttttcttcagcaacatgttctcacttcatgtctcttaatgtctctgtgtcacattttggtaaatctcgcaatatttcaaacttttttcattattattatatctgttacagtaatatgtgatcactagtctttgatgttactattttaattgttttggagtgccacaaccacactcatataagacagcaagcttaatagataaatgtgtgtgttctgactgctcctctgatgactagtcattcccctatctccctcgctctcctcgggcctccctattccccaagatacaacaatattgatattaggccagttaataaatctacaatgacctctgagtgctcaagtgaaaagttgcatatttctcattatatgtcaaaaagatttaacttagtgaggaaggcatgttcaatggcaataaagggagaaagctagacctcttgctgcagttagccaagttgtgaatgccaaggaaaagttcttgaagaaaattaaaagtactgttacagtgaacacactaatgataagaaagcaagacaatctgattgctgttgtggacaaagtttgaagtggtctagatagatcaaaccaaccataagattccttcaaaccaaagcctaatccagaacaagaccctaactgtgcttcaattctgaaaaggctgagagaggtgaggaagctgtagaagagaaatgtgaggctagcaggggttggttcatgaggttgagggaaagaagtcatctctataacatgaaagtgcaaggtaaagcagcaagtgctgctgtaggagctgcagcaagttatccagaagatctggctatgatacttaatggaagtggctacaccaaacaacaatttttcaatgtagatgaaacagccttctactggaaaaagacaccttttaggactttcacagctagagaggataagtcagtgcctgacttcaaagcttcaaagtacaagctgactttcttgttagttgctaatgcagctggtgattttcagttgaagccaatgcccatttaccagtccagaaaatccaaggaattatgctaagcctgtctgcctgttctgtataactgtaatgaaacctgtgctctataactgaagcaacaaagcctgaatgacagcatatctgttgacagcatggtttactgaatattttaagccaactattgagacctgctgctcagaaaaaaacaaaaaaaaaacactcctttcaaaatattagtgctctgagacaatgcacctagctgcccaagagctatgatggcagtgtgcagggagactgatgttgttttgatgcttactaacttgtcatccactctgtagtccatggatcaaggaataattttgactttcaagtcttactatttaagaaatacattttataaagctatagctgtcataggtagtgattccgctgatggatctgggcaaagtaaattgaaaaccttctgcaaaggattcaccagtctagatgcctttaaggacattcatgattcatgggaggaggtcacaatatcagcattaacaggagtttcaaagatgttgattccagccctcttggatgacttggaacaggtcaaaactttagtggcagaagttactgcaaattggtagaaataataagagaactagaattagaagtggagcctgaagatgtgactgaattgctgcaacctcatgataaaactttaacaactaaggagttgcttcttatagataatcaaagaaagtggtttcttgagatggaatctaatcctggtaggtgaagatgatgtgaacattatcgaaacggcaacaaaggattttgggatattacataaacttagttgataaagcagcagtagggtttaagagaattcacttcagttttgaaagaagttctactgtgggtaaaatgctaacaaaccagcatcacatgcttcagggaaatcttttgtaaaagaacgagtcagtggatatggccaactgcatttttgtcttattttaagaaattaacacaggcaccccacccttcagcaactaccaccctcagtatcaaggctatcattattaaggcaagatgctccaccagcaaaaacattataacttgctgaaggctgagatgattgctagcggtttttttttagcaataaagtatttttaaattaaggcctgtacattgtatttttagacataatgctattccttacttaatatagtgtaaacataacttgtacatgcactgggaaaccaaaaaatttataatgacaggctttattgcaatattcgctttattgctgtggtatggaactgtaatatctctgaggtatgtctgtaattctgaggtttctggtgctgctagttcatggcctgcactttgagaaacactgatttacaatatatctaaaattaaagggattttctttgctcttaggtacatgaggagagatactatttatctttgtactttcaggttctagtgcttatatttgtatgcagttcagttgtgttgcagttgattaaattgttcttaaagtacttacgtatttttaggtttcttactttatatatatatatatatatatatatatatatatatatatttttttttttttttttttttttttttttttttttggagacagaatctcgctctgttgcccaggctggagtgcagtggtgcaatctcagctcactgcaacctccgcctcccaggttcaagcgatcctcctgcctcagcccccctagtagcagggattacaggcttgcgacaccatgactggctaacttttgtatttttagtagagacggggtttcgccatgttggccaggctggtctcaaactcctggcctcaggtgatccacctgcctcggcctctcaaagtgctgggattacaggcgtgagccaccgcacctggccattttatattcagttttttaaatatataagctgagaagagatttaagtatattttttaatgtgtttgtattggtggaaaaatgaaatctgtatttgttctttgcattgagttaatgtttgaagaacccgtaaataataaagatcttaaacgtactgggtataacctgcttttgagtgctccttttttaaattgtagaattttagaaatattggtgatttttaaagtaacagtgcttccaattttagaactgtcaagattcattatattactaatcattatcagttaaaaacatgacattttgaaatctacatactgccctccagtaatgtatcttcattatctgctcattgatttattaattgctcaagtataattgaattatttccttaatagtatttaacctgtctgatgtacagggatggtgtcttatacttcttttgtgtcaaagaaaagaaccttgctacttatttgaaattcttacatatacttcctctagcacataaactttatataaaggctttgtgtattttttaaataatgagccattttattcatcaattcaagtatcttattttaaatgctgcctatctaataaccatgtgcacattgtgacagttgttccacgaattgagtattagtgccctgattatgattatgttgttttttttttttaagatggagtttcgctcttgttgcccaggctggagtgcagtggcgtgatctcggatcaccacaacctctgcctcccagattcaagccattctcttgcctcagtagctgggattacaggcatgcgccaccacgccctgctaattttgtatttttagtagagacggggtttctccatgtttggtcaggctggtctcgaactcccgacctcagatgatccacccacttcggcctcccaaagcgctgggattataggcatgagccaccgagcccagctgattatgttactttttcccccatctgttattgaactaataaagcattatgaaaaagctgacattcaccttgcagtttcaacttgatcataatattttgcttccagtcccttcccttcttaggcaactgtagatgtgggtttcgttgtacacttctgcatatgcaattcataaacaatctgtttgtgttttttgaaaagcacttgtgtttaaattttttttacataagtgagttttacttgtcagttcttctgaagcctgcacagtcaccctgctgtcaggctattcagcttactctctatccctggctgtggtgatctggtgttctcttcatcagtctggctgtagtcactgaagactttagtgcgaaggcccattgtcgttttgccactgttactcatgctgtcattcctggtcatgtccaaaaaccacactaatgattcatccaacaccctgactttttggtttcttcatctctttctgactatcctgccctccacttcaactcagttacttgcttctaagataatactttagattttgttatctataattattaactttcatcacctctaaaataccagtttgatcatcccattgtgtgactacaaccctcagttcattcacctctattctagcaattccatctcattttgaccttcagtcatttgacattattattttgttgccccttgtctcaatttttctatttgtattagcttagattccatggtttctcatgttcacttcattgcacatcttcaagtcctttgcccccttcttcttcgcagcagaatcccccaacactggtgcaggcaaactctgctatttcatttatggttcctaaaaagcagaaccatggagaaaagcacaaaattctgctttttacgtatggccataaatcatagatagtgccttactcttgcctgcagtcctactacatttccctaattcactctcccactctaaagaatttttctctcccctcaaaccttcacttgccatctactattcatgaatgatgatctcacttcatatttcatataagcacccagaagagaatttccttatttttccactttcagatatacctatgtaattatatttttaccccgaaactcgactttcacttgtgttttaatgggagtcactgtcattgttcctgttgaaaaccaggtcttccatttgtatactgaatgtcattgtttgttgtctgcagagaatcttgttcttgcagctgtcccttctctctcttgcataatcaaatcctctgtctactggatcattaccatcagcacacgaacatgtttacatactccttatctgaaggaaataggagggatcgtcctacagtcttaagatacctctctaacactgctccttttctctgcttaatatcaccgagagctgattttcctaccatgttaagacttcttcacatcaaaaaggaaaaaagccaggcacaatggtgcgtgcctgtggtcccaattatttggcaggctgaggcaggagggttgtttgaacccaggagtttgggggttatagtgcactattattgcacctgtgtctggccactgcactccagcctgggcaacataatgagacccatctcttaaaaaagagaccaggcacggtggctcacgcctgtaatcccagcactttgtgaggccgaggcgggcggagcatgaggtcagcagatcaagaccatcctggctaacccagtgaaaccccatctctactaaaactacaaaaaattacccgggcatggtggcaagtgcctgcagtccccactactcgggaggctaaggcaggagaattgcttgaacccaggaggcggagtttgcagtgagctgagatcgcgccactgtagtccagcctgggcgacaaagcaagactctgtaagaaaaataaaaaaacatacccagtaaagaaatggggaaagtctataaaaagattcttttacctgagacaggatctcactcagctgctcaggctgcagtggagtgacacgatgatagttccttgtagccttgaattcctgggctcaggccatcctcccacatcagccttccaagtgtctaggatagcatgcccagctaatttttaaaattgttttgtagagatggggtctcactatgttgcctaagctcctaacctcaagtgatcctgcctcagtgcccccaaagtgttgggattgcagataggagccactgcacctgacctctttatttaatttttaattgaattaaaacatatattcagtaagggtaccaattttaagaatttagcttaatgatcagtcacatggctttttaaaactgctatgtattattccattgtataagtgtacaacaatttttttcattttactgttgagtcacttacagttctgatcttttatgagtgtagctgctgtggatgtttttgcacatccttgtcagacataagcagtcatttctcatggagtgaggttgctgtgttacagggtaggcatatgtttagtctccagcggatactgctgaacaatttcaacagtataggaggcaattaagaccccagtttttctacatcctcaccaacccttggtattatccatctttttaattatgaatagtatgtatatgtataaagttatctcatgattttaatgattattatttattcatttattgctggttgttcctgatgattaattattttcagcatttttgcctgtgcttattgctttgactcttgttcaatgcaatgtctgttcaaatctttttacatttttccattggttttattattgatttaaaggaagttttatgtatttgagaaataactctaatcagttacatctgttgcagatgtcttcactgagtttatgttttccctcaaaacaatggtactttttgatggataaaattttttaattccttatcagtcttttctattaaggtagtgcttttagtgacctgttgaaatttttcctatccttaggtcataagggacttgtaggagctttattattttgcctttcacatttaggtccgatccattttgatctaatttttgcatgtaatgagagattttttaatatgcagatatataattgatctagcatcatttattgaaagaccatttctgccactgaattgcattggtgcttttcttttaagtgaccacatatatatgaacctatttctaggctcttctgtttcattgaactatttgtctttgtaccacctgcagtctcttaattatcataattttataataaatattgatgtaaagtaaatcttaattttgttactgttcaagattatgttgggtctttgaatttcctttttaattttaggatcaaaaacattacagatcggtttaggaagaattaaattgagtttcttaatcagtccattaatatgaatatctcttcttttattgaagtccttcttacattctctctgcagtgttgtatagtagaggttttatatgttagatttagtcctggctatttgatgtttttcatgctattataaatgtactactttgtaaatgtttctaattttaactgatatataggaaatatctgttttgtatattaattgcttagtcaacaatcttgctaaatttgttaatgttaggttttataggtctttcagatcgtctacgtatataaccatgtcatctgtgaacaatgaattttacttccttctttcctatctttatactgttcattttcttttttcttgtctgatgcattggtaagacctccagttcagtgttgaacagaaatggtgataataaatatcactgtcatgttcacaaactgggggacacagtatttcaccattgtatatggtgttaccagcaggtcttctgtagataccctttttgtattaagaaagttaatctttattcctggtttatggggagtttttatcctgtaagtattgaattttatccaattatttatggagatgatttttctcttttattttgttaacgtgataaattacattgattttctaacgctaaaccattcatttgtggggggaaaaaacccacatccttataatatatattatatatcattgattttgaactgcttatattttgtttaggtttacatctgtgttcacaagcatgaacttaacgatagtgtcctgaaatttttctgtcttgtaatgtttcagaatgttatttcatctctagatgttttgttgaattttccaatgaagctatctatctgtctggccctggagttttcttgggaaggattttagttctgaatgcattttccttagcagacacaagaatgttcagattttctttctcttgttacctaagaggactagataacatttgatttttttttttttttttttttgtggtgattgtcaagcattgatggaggggatgtttctcacagaggcagccttgcaagtgagcagatgtcaaaattggaaaacaatttttgtactagttagaaaaatatttttagcaagaatagtaaaagaaatagggaagatcatagaagttatacatgaactatagaagataaagagccacaatgtttataaccaaaataaggtagtcaaaatatgatactcaggaataaaagtaggaaaaaaaagaagtctgttgaatctaacagagaatacagtttctctgccgacattaaaatgttcctgttttttacagtatatattttctcgcttttaacttatattctctttagctgcatggccttgctacttctgatttggacaccagtcttttcccattctcacttcaagctcttctacttgcttttctataaaatcttatagtgttgaatcattcatcttaatatataagaaaaatgaattaggcactcttgtgcttctctgggggacctttttacataagatttggggtataagaaatagtactgttttatctgatccttctttgaggccgtcatttctttcataggaacattaatttttagtctctgttgtctgagagtatgtggtacatgtgagattaactgccccagaaaggatgcattgactaaagggatagtctggatgtgtcagggaaaatgtatattttctggtttgggcatttgactggatttcttgtctagttgttttttttgtttcatctaaatatgaaaatgcagcaaaagaatttaagagtcaaaaatcagtaaactctggatttttaacaggctagtgattgtagaggttcacgtgggtatctattgattgagggctacataccaattcacttgaaaatcccatattcttactgaccacccaggaaagactttggactttcaaagttaagagccattggtagaaagtcctttggctcaaatacaaacgagcatcttatatatgaactggataggaaacaattgctgttggatactgcaaacctgtaatatcaatagatacactgcatctctaaaatactatcgtttcagtcatttcctgttgtctttcatccagttcactttattcctttatgttacctatctggccactatagtaatttgaactaataattcctgcatttttgtactccagtgcgtagtatgctgcttccctccatagaagatatgctctaatttaataaaaaagagattaatgcttgataattaaataatacagctacttttgaagtgctttgtaactttatcatagttgaagcctcaagaaagttaaatattgcttcctctgtgttttggtaatgattggaataattcaagtgtcttatgtctttgtaagctacagctgccatgtgttacctacctgtgtctttagaaagcatggtcaggaatcactataattttctgttattagcttttgctagaatggaaaacctatatgtggtatttattactattgaagtgaaccaacgtttggtttttgcttttttttttttttttttctttctcgagacagggcatctcactctgtcacctacgtaggctggagtgcagtgatgcgatctcggctcactgcaacctccacctcccaggttcaagcaattctcccacctcagcctcccgagtaagtgggactacaggccacaccaccaagtctggctaatttttgtatttttttggtagagatgggatttcaccatgttggccaggctggtcgcgaactcctgacctcaggtgatccgcctgccttggcctcccaaagtgctagggttacaggcgtgagccactacgcctggacgacagtttttgcttgtttttcgtttttgctttttaccaggtttttattcttctatgggtgaatttaaaagcatagatgtaaattaggttgacagatctgagctagtataaggacatagtcttttcgcacttattggaaagcctctgatttttattattcacaatcaaatttggactgtatataattctttaagtaatctgggtgtggtggcttatgcctgtaatcccaacactttgggaggctgaggtgggagtatcacttcaggacaggagtttgagactaacctgggcaacataatgtccagttttttggctgatgagtaaatcttctctaccaaattctgatatataaaggagtgcatataaattacacattaatcactcataaatggaatactgattggcttgtttcgtgtttgaagtatttttcactttgtttattttgaagcttcttctcagcctgttgataaccatgttagcccatcttccttcttgggccagacaccagcatctccagccagatactccccagtttctaaagcagtacttggagatgatgaaattacaaggtaaggaagttaacatttatccttcttacataaaatcaactattaaattgaattttaatcagccatgtaagatagccacaatttttaggactaaaaaattttattgacagttagtgagcttaaaggttaatttttttccataggaggattcattgaagagcctgaaatatacatgttttatttttacaaataaattaccactccttttttaaaattaatactgcttttctttgaggcttggtaaattgtccttaggaattagcttagtaaaactaagttaagaaaattcttatgcatattttaaagtaacattttatatgttccttatctaatatataccataaaaatatggcagttatttgatttgtgttcagaattcaataagtggtggtttggtttggttttagcaggagggtcttactctgttgcccaggctggagtgcagtgctatgaacgtacatcactgcagcctccaactcctagactcaagctatcctcccgtatctgcctccctaggtactaagattacaggcgtgatcccctttgcctggctggtgggtgggtttgtttgtttgctatatatccttgatattctgacacacaaaatttactttcatctaaaattactacctgcactgaaatgtatagattaactgtctttttaatcccaaagaattctaatgaggtagaaaaaaattggtgaaaaagcattgtagatctttttcatattattcaatatagtaataagacactatagagtttgctttgtaatttgtacacgtcttttatattacagattcaacattaaaatgtgtactaagtaatgtctgttcttaacgtttattgattacattattgttagcattattattattttttacttatcagactcctgattctaggcagtgatctttaggacagataggagtgtttgtctcttttctttcataaagaattagcaatgttggaaacttaataggttgtcagtaattgtgtttgggatgaaaattagcagaaagaatagtgttcttatttgtttgtgatgggaatatccaaggctgctagtcttcaggcagtgcttctagagtgacctttcattgccatttatttttattactttctaatagtgcctatttaaggccgtaaagagggaaactgtaatagtgaatggcttatctagtctttaatctctttgcatattttacaaactaaaaaataagttatatttgcaccttgattactgttcctcatgcttcttcacttgagtctcttgtctagaatattgcattggacttttaagtatgaaccactcccttttgataatcacactactttgtaataatgaagtataaaatctttccaacattataagttcttcacaatttgactttaagcagtctttcagatgttaccaatatcaaaaaagtaaaaaaaaaaatcacaacatacctacattttggttctaaagtttattttttaacagctttattgagatatgattcacatatcataaatttcacctgtttaaagtatacaatttgtggtatattacatcagtttttaaaaattgtagcgaaatatatataacaaaatttgacattttaactatttttaagtgtacaattcagtagtgttaattgcattcacaattttcggaacccttcactatttccaaaaccttttcattacttcagacaaactctgtgaccattaagcagtaattctcccttccactgtcttcccagcccctggtaacctttaatctactttttgtctctatgaatttgcctattctggatagtttataaaagtggaactgtataatatttgtccttttgtgactggcctatttcacttatgttgtcaagatacactcatttgttagcatgtatcagaatttcatttgtttttatgacaatactgttcaattatacatatatgccacattttgtttattcatctaatgatgggcacttgagttattttcaccttttggttattgtgagtaattctataataaacactggcatgcaagtatctgtccaaatcactgctttcagttacttgggatatatacctaagggtggaattgctgagtcatatggtaattctatgttagctttctgaggaaccaccaaactggttttcgtagtgcctgcaccgttttatattctcatcagtaatgtgtgagttgcaatttctttacatcctcatcaacacttgttactttttgttttgtggtttttttaatagccatcctagtagacctgaagtatctcattatttttatatctctttccctagtgactgatgatgttgagcaccttttcatgtgcttacattatttgaaaatcagagtgtattttcccctggaaatactgttgaatttcagctgagtattttttaatcaagtataatttcctaatataaaattctaattcatacatattttaaagcataatgggaacagtaaatccggaattcaccatctaatttaggaaataaaacatcactaatatgataaaacctacctgtgcccctgcagataggttttaattatttcatataaaaagcctgaagatgggcatttccaaggttggtatagcaaccttaggcctgtggtgtcttcggtatactcttggtttcaccttcctgattataatatgtccaaaccagtaaagggattgtattattcagtcgtgtggggttttgtttattttgtttcgtttttttgaggaaaggaaggtagcaaagatgctttgtccttgataaggtttgtctgtctctagaaaatgacaataaaatttcccttcatttaccagaggttagaatggggttatactctcacctcagcaaaggggcatgggattgcaataacttgtttaggttggttatggttcatccctttgagactggagaaagggcctgccttctctaagacaaaaggatacctgccttttaaacttctaagtaggggcagtgattgctttgaaggcaataaagtgtgcaacatcagcttttcatgagtatgtgtatttcctgataagctcttataatacttttaaatttccacgttttttttctgttttggtttcatttctgttttatataacacaggttttttgcttttatataaaattagattttttcctttgatttgtaggcttagaatctctttatctcgtagttttagaaaaaccatttatattttgtctagctttctttgtagtttgataacataaaaattatcagtaggtagttctcactgatagaatgtcaggttttatataaaatttccaagatactcaattttttttaatttttagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaagacacgttagtcaagatcacgtttttgttattttcactggacctatttttaaagcaaggtcttctgtttttttatatcctaaagtaatggggatatcttggttatcttcttaacattttacagcttaattgtagaattgtagtgtcagagaacatattatataataggtgttcttttatagaaaggggtcagtttttataaatgtgcttgaagaaattatgtgttctctatttattgactggaaagtttgctatgtgtctattaactcaagtttgttacttgtgtacttctttatactttaatctgttaccttcttgatctattgaggttttgaaagctatccaaatatgatttttttaaagctacccaaacatgggttcaacagttggtcctcatagcattaggtttttttagtatgtcttttgaaattgtattattgggtacacatagttttatagttgttattatgtaatgaacatcttgatttataatagtggttttaccctagaatctatattgtctgctattaatgtggctgattttttttttttggcttgatatttgtgtcatcttttctcctcttcttactttcaatttgtgtgcttatgttgttacccatacacaatttttgtctaaaacttacctatagttctactgtgacacacagactttgggaaactttaattctaatcatgccatttctagtattttacttctgtttcatgtttatacccataaattgtaatttttatttttgtttattaaaagttaatccacaggtcatacaatttttgtttaccgtcccatcttgtatcttccctcttctgtgtttctcagtggaccactaacagcatttggattgtacagttatttgttgtataggactgtcttgctcttcatagaaaatttccctttttttttttttttttttttttccttgagatggagtctcgctctgttgcccaggctggatggagtgcagtggcgcgatcttggctcactgcaagctccgcctcccgggttcatgccattctcctgcctcagcttccctagtagctgggactacaggcacccgccaccacgcctggctaatttttttgtatttttagagacggggtttcaccttgttaaccaggatggtctcgatctcctgacctcgtgatcctcccacctcggcctcccaaagtgccgggactacaggcgtgagccactgcacctggccgaaaatttcccttttttaaaagctttcatatacatgctacatgctagtaaaactccctagtcattgtaaaaagcaaaaatgcccttcagatatctaaatgcaccttagtgtgcaagcccttgatttgtgctttcagcaatggttccttaatcgtaaatattctagactttatctgaaagtatctttattttatttcactttaaaagttagttcaatctagaattacacaggttgatagctgttacctctcagtattttgaagatactgttttatgttgtctggcgtgttgtttctatttaacgaaagaagtctactctgtcttgttcgtaggtgacttgtgggggtttgctggctgcttgtaagatgctttgtgtttgatgtgctgcagtttcactaaaatgtgaaactttgtcgatgtctagcatattatttattgtgtttgggattcattatgcctactgagtcagaggagtcatgtctttcatcaattctaaaaacttctctcatcaattctgaagacttagccattgtcttttcaaattttgcctttcccatgttgtatgtactctgtccctaaactcctatgagtggatgtgaatctgtttttcatgtctgttaaccccaatttcatatttacagctctgtctccttgtaattcaagtttataaattttcttttcttttttctttcttttattttttaagagacagggcttcagtgcattgcctaggctggagtacagtggctattcacaggcacaatcatagagcactattatagcctcaaacttacgggctcaaacgatattcctgcctgagcctcccaagaagctgaaactgtagcagcttcaattttcttatctatatctaatctgaaactacatcttatctataccttacctataactgtatcttaactatatcttatctatatctaatctgaaactatagcagcttaaattttctttatctaatcttaaaagctacgattttaagatacagaaattgtcggcttggttcaaaaaagcaagaccaaactatatactgtttatcagaaatttactttaaatataaaggttcatgggttgtaagtaaaagtgaaaaaaggtacactatgcaaatagcatactaaagctactgtcttaatatgagacaaaatagaatttaagacaaataatgttattatacatagatttcataattataaaagcagcgagaaagataaaagtgtcatttcatcaagaagacatacctagtaatactttcaaaatacatgaagtataaattatcagaactaaggaaggaaatggacaaatctacagtcacatttggagatttaaatgccctcttctttaattgatagaacaagtagacacaaggaaaagaagaagaatctcatttcttacttcatgttgtatagaaaaattaacttgaaatggaccatagaactaaacttctaaaagaaaacatacaagaaaatcttagtaaatatggattagacaaatttcttaaatagtaccagagggccaccaagtcagttcaatagagaagggaaaatctttttaacaaatggtgctataatacctagatatctgtatataaaattataaacctaaaccagtcttactccagacataaaatttaattctagatggattatagatctaaatataaaactcagaaccataatcttcctagaagaaaatatcagagactatgttcacaggcctagagtaggtaacagttccttggacaaaatgcataaaacactaaccataaagaagatgacattaagaaaccaaatacgctgggtgacgtgactcttgcttataatcccagtaactcaggaggctgaggcaggtggatcgcctgaggccaggcgtttgagaccagcctgatcaatatagcaagaccccatctttaaaaaaaaaatttttttttaattagccagacatagtagtgggcacttgtagtcccagcaacttgggaggctaaggcaggaggatcacttgagcttaggtgtttgaagctacagtgagtgagctttgatcccaccactgcactccagcctgggcaacagagcaacaccctgtctcaaaaaaaaagaaagaaaaaaaccaaataggcaagccacacagtggtaaaaaatattctcagcacatacatgacatactacttgtatccacaatatataaatatctcctacaaatcaacaataaaaagatgaataacccaattaaaaatgcaccaaagacttgagcaggtacagcacaaaagatatgtgaatggccagtaagcacatgaaaaggtgcttaacattaggcatcagagaagtgcacaaaccgcagtgaatgaagaggtttgtagggagttgaataagagtgatgtaattgttctatattttgattgtgggtggctgcacgaaattcacatttgccaaaacttaactatacactaaagaagattgattatgcctagataaaaataggtattcttgaagtcgtaatgaaatactatatcccacttagttgaacaacaaaagaaaaaaataacaacattcattgatgaggatgtggagcagctacaaccctcattcactactagtggacgtgtaaatggtataccactacaagaacttttgggaaggtttttaagaagttaaacatacatctaatcttatcacccaggttttacccaggacaaatgaaagcatacatcaacaaaaacactttgacaagaacattcttaacaaccttattcataataatctagaccttgaaatgacccaggtttccatcagcaggacaattgctaaattgtggtatgtttacacaatataatactactcagcaattaaaaggaacaactactgaaacacaaaacaagtatgttgagcaaaacagataacaaaaatacaatctatataattccagttacatgataatcaagagcaggtgacactaacttgtggtgctgtaagtcagaaagtggttgccagtgattgggactgactatagaagtgcacagttgaacatcggtggaaaagatacatgtcttgtctggggtagtggtttcatgatttttatggttagcaaaatcctttcagctgagctgttcaaatttctacatttcattgtaaaatatactgtaatttatttaagttacagtatgataaggaaaacttagtggtagggaatggacttaaaagattaatattgttgaacatattacctagttatttagggaaataaaattagcttagagcctcacttcacactttgtgtccaaataaattttcgtttagcctagagttcagtaatagatgtttttaaattgtccctttggaaccactttagataggtcattgatacagtgctaaagtgtgtgagaccaaccaactcaacctagttcacccagaacattcatggttttagaactgaatgccccatgtctggaaaccctttggtcttgattctaaaactggaagtctcagctagtccagggaagtagctcaccctaatgtgagtgcagttaaatacagcattatgtttagcaatatgcatcagtaaccttaaaattttaatgcttactgaacttctctagggaaatgccctaaaagcactaggaaatagtagaccgatcaataaacttaaaaggaaaattggaggagtgaattctccataaggcctttgaaaacctccgtgtatccttggaaccagaaggccacacacatgttcagggctgtgcgcatgctcaggaaagactagaaaaggccttaaactctcacctctacctgatcatgagcctctgtgcaagcgatttaaggcagttgttaattgcttatctgagtgttaaaggtgggccccaaaatgcacatatagcccttggaaaagagtggaagatttgtaagtttcaggtatttaaggaaatatgtattcagtcattaaccactaagctaaccagacagagacctcagtggccacacacaacaaagaatacggactttataacattaagaaaagtcactaacagacagcaatgacaagcgtagataagaggacagttctgctatctggagttgccgtattatatttattttaaatgcctatttttcgtcataaaattttgagacaagcggaaagaaaagtatggcccatatacaggagaaaaacgcaatcaatggatatcgttcctagggaaggtcagacattgaacatgctaaacaaagacattaaaccaggtattttaaatacgttcaaggaataaaagaaaaccatcctgtagactgacatgaaagtaaaggaacaatatctcaccatgtaaaaaatatcaataaagagttagaaattatatgtaagaaccaaatagaaattctggagttggaaagtacagtaacttaaatgaaaaattctctagacaaggtcaacagcagatttgagctggcagaagaaagaatcagcaaacttgaagatgggtcaattgagattttgatgctgaagaactgaacaataacaaagaaagaaagaatgaagaaaaattaacagcttcagagacctatgggatactatcaaatttaccaacataatgggagtatgtgaaagatgggaaagagagaaaaaagaagaaagaatatttgaataaatactcgcccaaaaacttctagaacttgattaaaaccattaatccaagaacctcagtgaactccaagttaaattaatttaaagagatctacaacatagacacattacaatcgaactgtctaaagccgaaggcagaatattgaaagtagcaaaaagaaatgactcaccacgtgcaagggatcctcaacaaggttaatagctgatttctcatcagaaaccatggaggtcagaaagcagtgaaataacaaattcaaaattctgaaaagaaaaaaactttgttgactagaactctatatccagcaaaactatcttttgaaaataaagaagaaatcaggacattgccagataaacaaaagctgaaggagttcatctctcaaaaacctgccctataggaaataagagaatccttcagactaaaatgaaaggaaactagagagtaactcaaatccacatgaagaaataaagagcctaagtaaaggcaactacacaggtaaatataaaacaacataagggtattgttttatatgcaactctttttttctccaacctgattttaaaaacaactgaataaagcaataattacaaatttgatgtgcacacatcgtataaacataaaattaatatgacaacaccacaaggcgggtaaagaaactaggttcttataaaatgtttgtttgtttacttatttatttttagaggcagcatctcactctgtcccccaggctggagtgcagtagcacagtcatagctcactgcagcctcaaacttactcaggcaatcctcgtgcctcagcctcccgagtagctgggctgcaggtatgcaccactacacctggctgaattgttttctttatttttttagagataagggtctcactgtgatgcctagccagccctcaaagtgttgtactcaagtgatgctcctgcttcagtccttttgcctgagccacctgagtcactgggattacagtctagaaccaccacatctggctttaaatttttacttataatccaagataaccactaagaaaatgactaacaaatatatgtagtaaaattaatgacatgggaattaaaatggtacactaggaaatatctatttaatataaaaataatgcagtaattgaggaatagagaaagaaaagacatagaacaaataaccaaattaagtaaattctacattatcagtaattatattaaatataaacagattaagcactccagttaaaaggccaaagatgttgataaagtagattagaaaacagaatccaactacacagggtctacaagagagacactttagactcaaagacacaaaaaggttgaaagtaaacgggtggaaaagatgcattacacaaaaagtaaccaaaagacacctactgtggctgtactaatatgactaatatcaaaggacgcttgaagaaaaacattattactaaaggcgaaagacatttatagtatatcattatgtagtcatagatggtatatattttatagttatatactctaattaccaatacatttctagaaagacataaactactgaaactaactcaagaagaaatagagaattttaatagatttaaaacaaggaaattgaattagtaatcaaaaactaacaaaacacaaaaatcccaggaccagatggctgcactggtacattctgccaaacatttaaagaattaacaccaatcattcacaaactcttccccaaaaaggaataagcatgaggaatgctttccagctcattctgtgtggccagtattatccttataccaaaccaaagacatcacaagaagaaaaaattacaaaccaatatcccatatgaatatagatgtaaaaatcaacaaaataacaacctggatccaacagcatgaacaaggatgatgtaccataaccaaatggaatttattcaaggaatgcatggttagttcaacatagaaaaaccaatcaaagtaagacaccatcttaataaaggacataaagcacatgatatctcagtagacacagaaaaagcaattgtcataaaccaacagcttttcatgataagaacactaaatagactaggaataaaagggaacttcaacctgttaaagggtatctctggaaaccctatagctgacatcatactaaatggtgagagactgaaagctttccctctaaaatcaggaacaagacaagggtatctgctcttcctacttctattcaacattgtcctggaggttctagaaattaggcaagattaaaaaaaaaaaaaggctaccagaataaaaagcaagaaaactatttctgtttgcagatgacataatcttgtatagaaaaaatcttaagaaatacaacaacagactgtcaagctaataaatgagttcagttaaatttgcaggatagacaaagaaaacattgatttataatactatcaaaaagaataaaatacttaagtataaatttaaggacatggatcaacaaaagtggtatatccttttttttttgggtttggtttttttgttttttgttcttgagacagagtcttgctctgtcgcccaggctggagtgcagtggcgcaatctctgttcactgcaagctccgcctcccagcttcacgccattctcctgcctcagcctcccaagtagctgggactacaggtgcctgccaccacgcccggctaatttttttgtatttttagtagagacagggtttcaccatgttacccaggaaggtctcgatctcctgacctcgtgatctgcctgccttggcctcccaaagtgctgggattacaggcgtgagccaccacacctggccagtatatccatttttaatggattttagtggcgcattatttagcgccactaaatataaggaatgaagtactgatacatgctccaagggtgaacctggaaaataagtgaaagaagccaagcacagatggctacatattatatatcccgtttatttgaaatataccgaataggtatatataggtatatgtacagtatggtcagaaagtagcttcgtagttgccagggatggagaggagacacaggagtgactgtcagtggatacagagtttctttttggggtaatgaaaatattttggaattaggtggtaatgatggttgcacagacttgcaaatataccaaaaaccactaaactatatgctttaaaaatgtgaattctatggtatgcgaattatttctccatttttaaaaatgtcggtgtaaaagaaaaaaagtgactctaaggctatttatacaagtatctctctcagtactggaatttcttctaaaatatccttaataatgtatcttcaattgaaatgttcagtgatagtctggaaagtctttaatatgtagttttgttcaacaaattatgctcttaaaagagtttggtgcacagaaataattcattaacattcttaatcttttctacaataatctgtgaaaaacctgtctttctttatatttcttgcctgatatgttctcccaggaattgggaggattttctttatgcactaagtagaactgtttatacattgtattgagttttatatggccatcatcagctggagatactaataaccacattgtttacatttgtttatgttatggattttagatcttggttttcattgaggggggtggggggggctggctggagacagagcgtccctctctctgtcacccaggctggagtacagtgatgtgatctcagctcactgtaacttccgcctcccaggttcaagtgattctcatgcctcagcctcctgagtagctgggactacaggcacacaccaccatgcccggctaatttttgtatttttagtagagacaggtgtttgccatgttggccaggctggtctgagactcctggcctcaagtgaaccacccacctcagcttcccaaagtgctgggataacaggtgtgagccaccatgcccagcctcaaggggtatgtatttaaatttagttgcataatggtttctttttagataatataaaacatcagatctttatatggttaaaatgttctttatgtaaatttatgatcccaagaatttctgggctcatagtcaaattttttaaaagtgatatgtgatctttaacagattttagattagttctcaacaaaacaagtttttgtgtaaaaattgcatgatgatcgttcctttccaaaaattttcagtgaaggtcctgaacattgccatattctattcattgttgcttcttaattttttttaattcggtatttaaagtttattacattcaagtataatgcttccatgaatgtcctcttaagtttgtcttattgtggaaaaggaacaatctcttaagataatgtaccttgcactatatatgtatatatgcgcgcaaagtattggtaacctttgagaaataagaattaagttgcctcttcttctggagtaggattgtacctactggtagaattggataattatttcacctaaggaagggctcttaattcaaaaaataactcctggttcatttaattaacatttattctaattaaatcagtccttgaaatctgagctgttttaatatttctaaataatagctttcctattataccaaaagaatggaagttttagtttgtacaggaagaaaaataattggaactgaattgagcagtaggcgtgagaatgtggcaggaggtaaatggatgctacaagcaaaatgactttccctcccattgcttgagttcctagcaaaataaagtgtgcaaaatgatgccacttgatttttcaggttctcaaattaaggtacatttctcaatggattgatacccagccttctaggggaaaatgttttggttttactaacttgacattaagcaaggtggttttagtaaataaaatagctttgaatgataatattttgttttactacacaatatatttttagtcaatcagaacaagaaacattttagtggtaaagttattgcaactaattttttaatacatgcttactcaaagaatagactattgtgatttctaatcacagtgattcttttctcccaaattaagatttggtttgatttacaggtaaacagtgttgacctcagagctgctagtcatgagcaggcagcagctgcattgaaaaatgctggccaggctgtcacaattgttgcacaatatcgacctgaaggtaataacattcttattgtctatagttattgcttattttagtttttaaaattcttcctctttaatatttaataatgtttaacttccaagctaaacttccttttttgtgctttttttctgatttgctaatccagtatttgtttagtctgaacctagttctttttccagatcaaaagttgtttgtttttttggttttttttggtttttgttttttgtttgttgagacggggttccactcttactgcccaggctggagtgcagtggtgcgaactcagctcaccgcaacctctgcctcccaggttcaagtgattctcctgcctcagcctcccaagtaactgggattacaggcatgcaccaccataccggctaattttttgtatttttagtagagatagagtttctccatgttggtcaggctggtctcaaactcctgacctcaggcgatccgcccacctcagcctcccaaagtgctgtgattaccggtgtgagccactgcaccctgccaaaagtattttttaatgatgtgggaactggcatccacaagcttaacccacaaaacccccattatgtgggttaatttaactgtttacttttttaaatctgttctgtaactgaagacatagcttttaatgtcccttttactactttattgatctgaaaaaataataaaaaccataagcagatatagtaataatgcccaaaaaaattaggtcacccagattttttctagcttttgaattaggttataattattaatatcaagatttaagacatgtttctaatagctgttactgccgctatttaaaataaagagaagaatgccaagtttggagtatactgtgtgtctagatggtgaagtatggtggatgtgactttactaagttcctgggggaagaaggtggtgatggagaatttgaggtcatgccatagtaaacatatgtaagactctagtgtacatcagcataaccacatctccaataaaacctcagtggaatttagaaagcttaaatacccaaaagaatacatagcatatttgttgatgctcataaacaacatgatgaataaggaaaagatgatgtgagtaaaggagctaaatgagtaattctgtaatttatcaactaattacatttattcttttttgaagcagaatttcttttttaatctagtatgttttttagctgatcaaagcagcatgttgagcattgcttggtctttcttaagtatgggaggttctatcaatctagtaaaaccttggccttttaggcttagtaactaaacaggggaaaatttgtttaattgggagtaaattctgaatattaattcacattaaccaaacaatagagactaacgtatgaagtcagaatgtcaattcgttaatttttgtgagaaacaaatctgccaatgggaccctatgttgtacttttatcttctggccaacatattccaccccgtaggtacactatatggaagccgagttacagtcactggttccttagtattatagacagcctctcatttatatgtttataaggaatataaactttttaggtatggttacgggtaacttaatatctgctccctaacctcaaaacacacagaacacacaaaagcagtaagaaaaacaaaacatacacgcatgctcctacccacacaacttcacttaatattaactaaaactaagaaggcaggtatgatacctggacaaccaagtagaggtaaagactccttaagcagctgaggtcttgcagaagccacacggaaagaggggaagagttaaaatatggaatgttgagaatgtttgtgatggcacaaatttaggatatggtataaaatttcactcataatgtggtttggtttagaaaagcagaggacccgtatttggataaagcagcctgcctctgtaggatcagataatgtgacagtatttgggttttaaaacctgtaaaaatgtcctgtgcctctatctttcctgcacccctcgactttctggaatagctactctagcaaaatctagcaaagtaataagtaattttttttgtttgttttaagatggagtttcactctcttgcccaggctggagtgcagtggcacaatctcggctcactgtaacctccgcctcccaggttcaagcctcccaagtaggtgggattacaggcacctgccaccacgcccggcttatttttgtatttttaatagcgacggggtttcaccatgttggccagactggtctcctgacctcaggtgatctgcctgcctcggcctcccaaagtgctgggattacaggcgtgagccacagcccccagccccagtaataagtaatttaaaagtagcctcacattcatacaaagataataagaggtggggaaaagcatcaaagcttagtaacaggttagctacacgcacacacaacacaaaaacattaacacaaatcggattttaagaagtacaaaaggagtcatccgacactctgataatcagcatcttgcagttagtatctttcctaaaggcttgggattctctgccttgttgataatcttatatatatacatacaagacagacagatagagacaaaggtaagcttttggtagaattaagttttttatctttcaggatctatggtttgccttattagtcttccaaaaaagtacttttatgggtttttcagcttgtgtactttgaactttcttgacttggattctgattatgagaaaaaataatctctacaagacatatgaaggaacattatcttctaactcctttcagttttattaattccaaaggcaaggaataattcactttggggggcctttactgttaatctttttggagaatcattatcagaaattagctggacgtggtggctcaggcctctaatcccagcactttggaaggcctaggtgggaggattacttgagcccaggagttcgagaccagcctgggcaacatagcaagatcttgtctctgctaaaactttttttaaagttttttaattagccatgcgtggtagtgcgcacccgtagtcccagccaaggcaggattgctatgatctcaccactgcacttgagcctgggcgacagagtgagaccccgtctcaaaataaaaataaaaataatcgaacatgggaactggaaatataatactatactcgttttggactccatatcccaaagttataaagttttatcacatacttcctatagtttaagaatctcttggccaggcgcggtggctcacgcctgtaatcccagcattttgggaggcctaggcgggcagatcacgaggtcaggagatagagaccattctggctaacacggtgaaaccccgtctctactaaaaatacaaaaccaaaattagccaggcgtggtggcgggcacctgtagtcccagctgctcgcgaggctgaggcaggagaatggcgtgaacccgggaggccgagcttgcagtgagccgagatcacgccactgcactccagcctgggcgacagagcgagactctgtctcaaaaaaaaaaaaagaatctcctgtgatagtatataatagtaaaactgtacgccatgcatgatacgaaccatgttatgtttattcactcttttaactcccaagataatcctgtaagtaagcaccgttatccccgttttacgttgtagttgaataagctcttccataaagagaccaagtaatttgctagttacacaactgttaaacggttaagatttcttctagccccttttaagcgaagaaaaaccttttcctccacccttgtatgttcagtaacgggcctgtgaagtaaactgacaaaaaaaacagattaacatggaaaaaaagtttcttgtatatggatgcaagaggcaacagaagaaatactgaagctagcttgtggatgaagttaaaagcttgtacacctaatctagtagggaaaggaaggagggagaaacagcttttattagaaaaacgtacatttcttcaggaaagacaagtttttaggagaagagatgggggataaagtttgtgatgacatttgtctaaactggtatgactggtctttccattcttcggggccatcagactcctcagagggtatttatggtaacttcatttctcggaagctgcaccttttagtcagattagagaaactccgagaaggcttttttcctgcatctgttgaatctcagatatcttcagcttaaaatctttgtggcaactctggggttctgggtgggtctccataccctgttcttactctttcaactactcattaaactcttggaatctctcacctcaaatatttaatcttattgttcctcaagagtattaggccaactttcagagcttatatctcaatcttttgttcagaaagcattaattatattgtaataataccataaaagaaataaattggaaagaaactcaatatataagttaaatttattttctctttcccattggttaggtcttatatttgtgacatattttattttcgcaagaaaaaaactgtttggtggcataatccctattttgcaagtgaccagagtctagagaggttaggccatagtcacttaacttttctgcgcttcaaagctttgattgaaatcttgagttacaaaggtagatttctaacacccagtgtcctgactttattttcattattacttcttataccaaccaaagggagaagaggtggagataatctgggaagattgcagtggactagtggcatttatttgcagacatttgtcatttcttatcattttcagtagtagataggtaattaaaatttttttcagtctcctgctttcccacttcccttgctgtatttttctacgcgcctgtgctgcagttgacccttgaacaacacaggtttgaactgcgagtgtccacttacgcacgtgctgttcaaccaaactgggatagaaaatgccatatgcctgtcagattccacaaggcctcctgttagacttgaacatgcacgggttttggtatacgtggggttctggaactaatcctccgagtatgccagagagctattgtacttaaaacaactaactggccttcttaaaaatagtttccctttttctttaggccaattaatagtatccatcctctgagaattgtttctcttgggtttaatatctgtgtttaatgtattttattacagttataaatgaatgtttttctttatagggattgcatgttaagaagagattgaggaagtccaatttcccccataccccttcctcactttttacttctagtgtggcggtgaaaacaaaggttaaaatttgaaaggggatatcaaatgaaaaaatcagcttttaaatatctctccttgtataagcgtatacatactaacttgtagccagcagttcagatacgtcctaatacgtttcatgacaagaaatatggtttgatacaggaatttttgagatgttgaatggagaaaatctcttatgtaaaattatagctttgctgagttttgatgtaattctaggagaggagtgtaaatgacttaactgaaaaaagggatgaaactcttccgtcaaaataaaaatttaagaaaataggtgtagtggttagcacttcgggaggctgagacaagaggatcacttgagcctaagagttgaagatcccctgggtaacataggacaccctgtcgctgcaagtaattttaaaaatgagctgggcatagtgatgcatgcctgtaggctcagctacttgagaggctaaggtaggaagattgcttgagcccaggaggtcagagctactatgagccatgatcgtgccactgcactccagcctggatgacagagcaagagcctgtctccaaaaaaaccttaaaaacaaaacaaaaatatgttggtgggagtatttacgaaaatatacacaggataggtaaaatgtggagactgataggactaaaagtatcaattgattgaaacaaaaggaaaaggtaggaatcttaagtaggtaaatgaaatagaaggtttaaaggaaaagtaactttaaaatgccgaagtatgttttgaacatatagaaaggtagctgtgaggaattgttaagagtaaggcaaagacttggccaggcgcaatggctcacgcctgtaatcccagcactttgggaggccaaagcaggcaaatcccttgaaagcaggagttcaagaccagcctggccaacttgatgaaactctgtctctactaacataaaaattaaacaggcatggtggtacatacctgtaatttcagctactgaggaggctgaggcacaagaatcacttgaacccaggaggcagaagctgcgatgagccggaattgcaccactgcactccggcctgagcaacagagcgaggtgggggcgggtgggaagactctaagcaaagactataaatatgaagatctgaatacagtgaaagaaatagatcacaaatttaagaaattatcaggaattgacttagctcttcagtatcttaaatttttaatatctgagactatgttaactgctttgtagtaacttagttactcattaagaaagaatatttttctgcatcactaaaaagtaatgtgttctttttacacagaaagcttttaaatttctaaaatgtagactatcttaaatcactaggacttctattaatcagatcagcaaaattgctaaaaactaataatgctacatgaaatgtaatacacatcttatttaaaaagcattgcagaacttttaaggaattagcaaacaaaacatgaagggaaactaggaactcggaactcagggctaaggaagcagagaagtctcttttgtttcaagagcaacagcgtacgggcttgggagagccagttaaattttcagatatttttcaaactaaaacatagcctttattaaaaataaaattatacagaaatacaaataaattatatttaaaatagtaaaattaaaaacaaaggtaatattgaaaagtcatcacttcctagttgttttctaggaagtaaaataatagaaacataaaccagtgagactaacagaaaatacaaaaagagggttgggcgcggtggctcacgcctataattccagcactttgggaggctgaggtgggcgactcacaaggtcaggagtttgagaccagcctggtcaacacggtgaaacccctgtctctactaaaaatacaaaaattagctgggcgtggtggtgcacgcctgtaatcccagctactcaggaggctgaggcaggagaatcacttgaacccaggaggcagaggttgcagtgagccgagatcgcgccactgcactccagcctggatgacagagcgagactctctctcaaaaaaaaaaaaaaaaaagaaagtacaaaaaaagatagtagatttaaaactgaatcgcccaaaactcctcctctccctcaaaaaaattaggaaagccaaaccaaaatttgttaaaaatctacaataaaactagacaaaaagatgaaagatatcctatgaaccccaaatataagctgatgtaaacaaggtattaacagctacaagaccatctgatatcagcatctgtgcaaggggatgcaacaggagaagcccaatgttaaccagtcctcacaagaaaatgcagtaggtaaatttgagaacaccaagtgaactataagagtttttgtacaatctgcatgttgagtgcaaggaatctacactaagatatgaaggggccacgagcagtctgggccctatgacacagttaaccagctgtagttccctttccatttaaagccccacactaaggaagaactgctgggaataaaatccaaattgagtaggatagggataatagagccaaaggaaatagaaggttcagattaatgggggtaagtaaagtttcaggaaatctcacagtgtctgaggtcatgtctttaaacacttgagagaaacaacaaaatagagagttctagagctgtgaagttagaaaacctatcttgactcgtaactcctatgtaaaagttggggaaaactaatttcatattaaaatgagcagtaggaaaagatcacagtcaaatccatggaaacctatttgaaaagtgaaaataaggattagcgtaatgtctccacagtcaagctgtaccagaaagacatatagtttatgaagctagtgtaaaataaaattaatattttgaaacaaagaaaaatgatagagtatgtcgaagaacaacatcaataagttgatagaactcagaaaattagtagaaataaaaacattgttttaaaaactaaatttgactaaaagagacatacttccttaaaccaagaaggtgaaaaagaagaaaaatttgtaaagcaaaaatagaccttctctttctacaacttgatcaatttagtcctaaagccattatgtagaggagagaaaaatagtttaatctacacctcacatctggagaggtttaggagattttcggtggcccattggacttacccatgaggttggcttccatgcagggtaatgccttggtttcaggagtcagagcctgagggctggtgaggaaagcacatatgggaatgctcagagcccagtcagggaagtggatggctgttcaaattcagattgaccaaattaatatatatgttaggttattgttattcataattttcactgttgagaagagagttacaaatatggaagggaagaaaacttaaacatgaatcctgtaatactggattagaactgaagaagttggtttgaagggatggttttccattgatacagatgtaaacataaatatctacgtcagtgtgtatgtatctgtgtgtatgttattttccctggctctgcccactgagagggcctgagcctagtgccaccccaagagcagtgagcacctagcatccagatcttgccttgcaaatattatttcccactgaaattactaaggcttttttgacaaacggcaggttccccaggagtcaggcaaagaaaatgctagattgttctataatatcctttgccagaaaacaagcaagtactcaaggaatgttggagacatgtcaaatggacccagaatctaacttcaagggactctcactggccaaatcaggagcaatctcagcattcagttggtgataataatggcagattataacccactgaataaagtaggaaataatgagtttttactcatataaataaatgaattaattgaaagtttgatgagaatggagaattgtacacagtttcagtaatttatttgcaaaagggaaaagtaactttacagtagagaaacctggcagacacaacttttatcaagcgattaaagttaataacattggtgatgggacaaatcaaaattgtgtaccacctgatacagatgtattgggtagaacataacatttgtgatattcctgccaaagttggataacttcaatctaattgtgtgggaacttcaggcaaacccaaattgagagagattctacaaaacaattgacttgtaatctccaacagtattaaggtcacaaagtcaaggaaacaccgagaaactgctgtgactcaaagatctaaaaagacgtgacaactaaatgcaacaaatgactttgaaatggatccttttgctgtaaagaacattactggtgactcttcatagggatccgagcattagatggtagtaatgtattaatgttacttttgatggttttgtagttatataggaaaatatctgtaggaaatacacactgaagtattcagggatgatgagacatcaagaaggcaaattgctgtcaaatggttcaggaaaaacagtttgtgattgctctagtctttaaaaaaaattagtaagaagaaacaaaagatttgaaagtgacaggtatagaaggtaggtaaagaatattcaacatgcatgtaataggagtctcctaggaagaaatccaaaacaatgctagaaaatgcatagacaagaaatcttttctaaaattaaaaaagttatttcaaactacacttcaaaatgccataataaaatgattaggatttaaaggaaaaaaatatctggaattccacttccctcccccagcagaaaaagaaagaaaattccgttgttctcagtttatagaagacaatggagtgaacatactcaataaaggaagaagctgaatcaaacagactttcacatataaaaactggaatcaaatatatcaacaaatagagtgatagtgttcgtataaacacttcctggggtgagagaacaacctgcagacatccaaaatgataggaggagagatactgacataaggactggtgttagcattaatgaagaagattataaggaagagagtatataacatgaaaaagctatatgctctgacaattttgataaggtacaattattagaaaatggggacagaatttgaggataatatgaaaacagaataagcctcctaattgctttaaagtttttaactggatataaaaggatagtatttccaatccaatctgggaagattgcttgtaggaggagaccaaaagacaaaagccaaacaaaagtttgccattagaacaaaaggacaagcgtgtctgaattgttacacacacacttaaaagaacaaaccatatagtgagactgtgctccagttactgttgcttcatgagatactaccccaagcttaataggttaaaacagccttttaataggttttgtaggttaggaattcaggcaggattctggccagatggttcttgttttccttctggcatcaactgaggtcacttagtgggacttaggtggcaaatgagctgctttggagggcccagtttggctttgctctccttgtcttatgtgttggtggtactggctagaagtttgggctcagagcaccatcatgtgacctctgcagtatggtggttttagaacagtcttgttacatggtatctggcttccactgaacaagcattacagaagaaccaggcaaaagcttcatggcctcttctaatctgaccttgaaagtcatacgggattactttcacattttttggcatacaaatgacccaaagcactagcccagattccaggagaggggaattagattccacctgtcgatggggaaattgcaaggtcacagtgtacaagagcatgtgggatgcaggcatctttggaaaatataatctgccactggtttatttatgttaaaagcttgaataaataagacaggatggtaagaacagaactgagaacaatttcagttatatcaaaagttaattcataaaagcagacaattttcaggcttgctaatgaagcagaatttaaccctgtgcagtacataagagtcatacctaccacaaagaagtaaaggttaaaaataaaggactgcatattgctgtaaaaaaaaaaaaaagcgtggatgacatctttctatattgtgcagtgatcttctggatatacttactattaagtgaaaaaagcaaagcagggaaatgtgtattctactgtttaagaaagaagagaaatgttggctgggcacagtgggtaatcccagcactttgggaggccgaggcaggcggattacgaggtcaagagattgagaccatcctggccaacatggtgaaaccccgtctctattaaaaatgcaaaaattagctgggcatgttagcgcatgtctatagtcccagctccttgggaggctgaagcaggagaatcgcttgaagccagaaggcggaggttgcagtgagccaagatcgcgccactgcactccagcctggtgacagagtgaaactccgtctgaaaaaacaaaaagaaaagaaatgtattatgcttgtgatgtttgtgtgtatatatacacacatatatacagatataaaaatatggaataaatgtaaatgtatttgcgtgtttgtgggtatctttatattgtttaaatgttgacatataaggatcaggacagaataggatgagaaaaagggatagaagctggacttttaaatacctgtgttttatagatttgactgtggagttattttacctacttataaaatcaatgaaaaattttaaaggcaaattgaagttgaaaataaagtacaaatgaatctaaatgtgtatccacttggcaacagtaatactcaggaaggaactattccaagtgattttaaaatggtaattggccaggtacagtggctcacacttgtgatcccagagctgtgagaggccaaagcgagaggactgcttgaggccaggagttcaagaacagcctgggcaacacagcaagatgccatctctaccaaaaataattttttaaaaattagccaagcatgttggtgcacacgatggtctcacctactcggaaggctgaggcaggattgcttgagcccaggagctcaagcctgcagtgaactatgcttgtgccactgtagtccagcctgggcaacagggcaggaccctgtctctaaaaataaaaaaagaaaacaataattcaaccatacatctctagctatagcctaaggattaaaagctacaggaaatagttaactgtttacagtaatcatatcatggtagtagtgttggtggtctaattcactgttgtaatattggataaaacaagtaagtcattatgccggtacttttattctgctatctccactatcttgagaaccagaattactcatatccaagaaagcagatacaacgctaaaataggagagcttaagtaaaaacccagtggtcctaatttttcattagaaaaaccagtataaactcatgatatatttttatgatctccattcatcagtctatagtttagctgtttctacacataccaaagacaacttgccatggattgatatttatttaattatgatggatacattctactattaaggctatttatgtttttattttaagtgttttgttgtaattttgaaaggatagtaaaatattttattattaatgtggaattttaaatgtttctaagctttttgatgaattgttgcttcagttgagcttattatccgtaaaacaaagttgatgattatggtgaaagaaagagtaactcaacaataatcatgcttactcttactctgtcatcttaacctacacaaaatcccagagaagttatttgctgtaagacaggctttataagaaactcagatttgaaatgacctagttgtctgcaatttgttataaatagaggggaaaaaagatatgtgtttataaccatgtaactgcaatatttttgaaaaggtgcttaaacttttgtcattaatagatttagtagtttttaatatgtagctttaaattgtccattttcaaaatcatatttttgtataaaaaatattttaaataaaaatattcacaaatattacttcagattgcttttgtgtcttgaattttgataatttataaattataaaatcagttaaaataaattttgtttatcacttgtttaaggcatatttttccctttaatgttgaccctgcacaagttccatattgaagtatgtaaaatgaactgattgtctcaaggggaaaaagtcaataatcaaagcatctagtgtattaattattattataggtttcttccttaatataaaaattagaataaatcctgatttttaaaatttacacttaaattcaacagtaatataagattactgctgtctgatgcatggaaattgtcatttaattgactaaatgtggtataaactttaaaagagcatgtagaaaaattctaactcagccaattctaatttatggtacatttaggttattaataatttttttttgaaatttatgtgttgggcaaaatctttcgcatattactattttaaggttctaaccacatttaatcaattataggacagtttacatatttaatacgttatcttcaaataacttattttttgaaaatatatcaatttatttctctttttcttccatcagaatacagtcgttttgaagctaaaatacatgatttacgggagcagatgatgaatagtagtattagttcagggtcaggttctcttcgaactagccagaagcgatccctctatgtcaggtaaatttttttacttctaattatggcaaatcttaattagttatgcatgtaaattattttgtatttttcactataacttacttagttttaccgtaagaaaatatattgccaatcagtgttgttttttattattgattctctctgacagtgtgcctttcaagaattggaatattattgtattaataattttattaatgaaagttatgtaatccttgaataatgatgatataataaaggaagaaatttctgtggaccagaaattgttttcagattgatgtgttagtagtgactacaagcttgatgatatcatgtctaacacttagatttaacctctgtccttttctaatatattttccattcaagtaacatttaattacctggcaatttccatagtagcaaaggaggcatatgtaaataataatttaaaatgtgaatagcctcggtaaataatgcatatttggaaaatttctacatgcattttttaaacacttgggagaaggcaaatatgttattttcctataatatataaaggttaagtggcaacataggtctaataaataggtgatattagtatataaactggggtgtttctttttttttttttcatttcgttggcttataagacttaaaacagaaatccgaatgtatttgtattctgtatacttttagtagaactttaactgataactttattatactgttactgtaacattagcactgtaagtaatctgaaccattctttataaattatcatctcagtcgtcctgattctgttgggggacctgttcctaatacgtttcatttatccttctgatgagagagatatgttacatatataaacatgtatcctatacacgtgtatctatacacacaaacaggtactctgtacttgtttacatatgatatgacttactgtcttcacataatcttactctgatacatcatgaaagcaaacctttctcactttcttctttctgttccttttgtcttttgctgtacttggtacttataaccctaccagtgatgtgggaatcttaaatgcatcagatttttttttcccttcgccaattctagcagtactcattaaactcttgtgttccaaagtcattaaaagtattttatatatacaaatatatcgaagaaggaagaacatggatttttctactctcttttttacactttctttttttttgcttatctacatttcctaattttagtataattaataggtgttgccttttatttgtacttgattaaatatttacaaaggcataaaaatcagaacataataggttatatttattttcggtacatttagtgaatcttcacttgttatttttagagaagtaatgctctattttctttctgttttttttttttttttaaagacagggtctcactttgtcacccaggctgaagtgcagtggcgcgatctcagctcactgtagcctcaacctcccgggttcaagggatccttccgcctcagccccccaagtagctgggactgtaggcacatgccaccatgcctggctaatttttgtgtttttagtagagatggggtttcaccatgtttgccaggctggtctcgatctcctgacttcatgggcctcacccaccttggcctcccaagtgctggcattacaggcatgagccactgtgcccagcttctattttttaaaaccatatattatctaaagacttataatgaaaaacaactgtcaccggcaccagcccctagtttcattctccagaaacaagcatcctccattttcctagcaaacttccttcacctccttatttctaaatatgaagccttcgcctctatatttctaaataacatgcatatactgctatcttctactttaccagttttgcgcattagtcttacaaccatggtagatgagaacgtttctgtgtagaaccaaaccactcattcagtctcatcaccatcacccaaacatagcctatctctgttaataaaactaatagcatttacagtcatgtgactatgcaatagctgtcatgactcagtcgagtggtaccctatgagctgcctcctttcttctgcagcccttcatttttcctggacttaataattgtcttgcattttatttgatttttcatattcttactactaaatatctttctgtatcttccagtaaccactgtagagtttttcacatgatgaaaacatatggtcacacatacggtctgatagttcaggttttttctatctttatgctccagtctagactagttcctctgtaaacgtgctgtatagctctcagctgggacttcccttttgccattattctatttcctttggctgtctactatgtcacatgtttcctagatgccacattttcttctttctcaattaatcttcctagagcacatcctccagtaaattcctgcgaaaaggtgtgtgggaggcaccctttgaggcttagcatgtctgaaatgactttgttttgccttctccccagtagagaatttggaatgtgggggagggaatgataccctgttttattttgcaggagctccctcatcttccatttcttttgtggacatgatctggtgtgtctctgagattttcttctgcttttttgtattctttgctttctctgtattccttttttctagctatcctattttcttggaggttttttctttagtgttttatataaggcattctttaaatatccagtgttcctttcattgttttccactcttaggaatagagaaatgaagataatggatttaactagaagacagtggggtaaagggggggataaattggctcttaaattttctctcctgtcccacgtcattctgttcttttctataattaaatatccttagagaagaatccctgtctcctgccaatagtataaaccaagttgctagaattttattttcatccatttcagtccaaccaccttccccttctccaccaagtttcagagtatacagctcctcaaattcaatttctctggagactaaaccactggtcttctgtgggtttggggactgggaaaaggaactttggtggggttggtctaagtgctacatacagtgtttctaccttctgtttttagtacagtaacttatccctgcctaccttggtactactgtacacttctaatttatgaccatctccaggattcttatggaataaaacttgtttctataaccctctctgctgccactccatttatagcttctttcattctgctaaatttaattagcatcatccagaaatgtgttaaaatctctcttcccctgttgtcttctctcttttgtatttttcgtattttattgtcattttaatgagtcagggtggagaagaaatagacacagtgtgctatagttaatcagaagcctcatggttctttttgagatggggtcttgccctgttggctaagcttgtcttggactcctgggctcaagggatcctcacaccttaacatcccaagtagctgggactacaggcacacaccaccaccaccaccacacctgagtcttgtggggttttttttagtcaatgtatttctaatttcaaaagccaaaaaaaaaaaaggctgcaaaaaactacctacagaatacctctttataaagctctgaaacaagcaaaaacatacattatatcttttagtcactcacatattatatgataaaaccaaaccaaccaaaaaagaatgagtcaaagaaataaacattaagaatgatagttacattctaatagtggttaactcttgatccaagggaatcaggatcagagggaatatacgcaggtgaatgtgaattactgatgaaggttttgtgtgtagtcttgggttgggtagtaggtgaacagatgttcattgcactcttacgattaataactcacatgtattccatgggtttctttttttatgaatcaaatatattaaaagagaatgttaaaatgctaacgtaagtagagattgtgggtgatttcctttgttgttcaataatactgttacattttgtgattcaaaagatgaatttttataataatgtaagaagttagtattttccttttctgaatgtcttgacatttgtactacctcttaaggtactttattttctattttatattatgcttatttgtgccctcatcttctctatgtttgaatgtatgtttaagtgagccctcctgcttaacgatcccccctgcttccctagcacctttagccccacgaaaagacttgaaagaactcatttgaaaaaccattaactactagtttatttatttagccatcaagtaattccacccctcttgagttttacttgaagagctaggttcttaaatgttgggtagtgtgaaaaagattacgattttcatcctaatttccagttgccaaattagaacaaaagaatgaataaattatattataaatgtaattgctgtgatcctttcttacactcttgagagagcttatttggacttaagaatttgatttattttaatgttgtacattaattaatcaagtggtagcacacaatattttctttttatcaaattttaaaatattcttaacactttgcaattaccgtattaaattattactttctccaaaatatttggcagctgttaaagtcatctgtaattagtgtccatcattgttactgactctgaaaactctatcaactctagtattgtgaacaaatggaaggaataattaatggacagaatagtcactatgttgatctagtcgtacagtccacaactaataaatcaaatatatcagggaatttgttttcctacatgtatctaatcaaagtaaagagaagaatgtatcttaatactttttgtttattaatttcaaactctctggatttgtctattttagaattcaatataacttaccattggattacaatccaagagcgtttttaaaatttgtcttgtgatattgaaagaaacaaataatacaatacagtattttcatagcaagttgattttgctatttcttttttgtcttatcttgtatgcagtgcagaattgaactgggcattatttggcctactatgatatatttaattacccaaattacatatactttcagaaccctatgatatgttgattaatattataacaagtgattatggactttttttcttctgactctagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcaggtatgcctgtttcttaccacttgaatgtgaggcaacataaataattgatgttcttttaaattttttttaatttgtgacaacatggatggacctggagtgcattattctaattgaaaaaagccagacacagaaagacaaaaatcgtatgatcacatttttatgtgaaatctaaagtagtcgaagtcatacagagaagaatggtggttaccaggggttaggaggatggggaaatgagatacaaagtttccgtgacacaagatgagtgagttctgcacctccaacatgtaagcatggcaactacaggtaatagtactgtacttgaaatttgttaagagggtcggtcctaagtgttcttaccccccaaaaaaaggcaaccaggtgaggtaatggatatgttaattaggttgactgtagtaattatttcacagtatgtatatatataatatatatatataaaatcattaagttgtacaacttaaatatatacaattaggctgggcacggtggctcattcctgtaatcccagcacttttgggaggctgaggcgggtggatcacttgaggtcaggagttcaagacgagcctggccaacgtggtgaaagcctgtctctactaaaaatacaaaaattacctgggcatggaggcacacgcctgtagtcccagctgctcgggaggcttaggcaggagaattgcttgaactcaggaggccgaaattgcagtgacctgagtttgcaccactgcactccagcctgggagacagagcaaaactctgtctaaatatctatatctatatctatatctatctatatatataaaatatacacataaaaaaattaaaaataatcaccagaactgaaaaaataaatttattttactaaaatgattttatgctcagttttttatattgtgtttcacagccatttgattttattcaaatggaattgtaaccagtgacataactagaaaatatgggccaggtgcagtggctcacacctgtaatcccagcactttaggaggccgaggtgggcggatcacgaggtcaggagtttgagaccagcctggccagtatggtgaaaccccgtctctactaaaaatacaaacattagctgggtgtggtggcgggcgcctgtaatcgcagctacttgggaggctgaggcaggagaattgcttgaacccaggaggtggaggttgcagtgagctgaaattgcaccactgcactccagcctcggcgacagagcaagactctgactcaaaaaaaaaaaaacaacaaaaagtgatgcctccaagcagaaattgatctaaagctactagttactgaaaacaaagtaagtatatattaaatcagtgtgccatttagctataccagtgaagagaaaactgaaagtgtctgtggttggtgtaggtaagtaagaggacttaaattttgtatttttggtggcatgaatttcttccttcatgccaaaatgtttggaaatatctggtaatacgcttcacttctctttttccttgcttaaattacatgtattggtgcagttcactggtcttttctctttgcttttaatgattatatataggtagataggtaggtaggtagattgatttttttaagagacaaggtcttgctctgtcgcccacgctggagtgcagtgacatgatcatagcccactgaacctcagactcctgggctcaagctatccccccacctcagctagtagctgggactccaggcgcgtgtcactgcacccggctaagttttttgtttttgtttttgtttttgtttttgtttgtggagatgggttctagctatgttgcccaggcaagtcttaaactcttggcttcaagcgattttctcaccccagcctcccacagctctgggatgacagctgtgagccactgcagccagccctaatgattcattttagtgattcatgggtgtatacttagcacatagcaaaagtagttaaggacaggccctctttgcaaaggatggtcccagcttagaggacctcttctaaggcctgtgaagtgctgttgagtgtctctgcttttgtggggaaggtgttaaaatgtcatttcagaattcccctgagatagcttatttatgagatctgcttcatccaaatcattgtctggaagttcttctttaagagctttttaaagtagtagtagtaagatagccagcaaaaatagttaatgagatcataaagaaatgtttattataactagttaattcattttaagtcgattatgctgtaataaacatctttttcttattagttgaatttatacctatttcgtaactatttctagacctttatttatttacctgtttgtagaagttgaaaagtaatattattaaattataatcaagatttataattatgattttcgggcttataactgctgttggctgtatccatatatttagcatgatccaactatttggctagatctttcagttgatgacaaatcctcttttagcaatgcagcaatcagcataacttttttccagaaatagaacatagtctgctttaaattcggaaatgcttcctctatgccttgttgagtcagtagaaaccttacatcttaaatatcaaggtcagagctcctaaaaattgtcttggttcttggagtctcataccttacaaaggctttctgtgcctacacccaataataaacactgttggcttcactggagagatttttttttcattttgtacaaaaattctataagattgtgttttaaagcaagcaataatgtaagaaagatatcttgagacctctgccaatttccacattcatgagtagcattgcagaatataatcttactcccgtaaaatacagtaagaaaccacaactaattatgccatttcgttcttgaatgtattcaaaacttaccttttcttaaatagaactatctctttcttagacctcttctaaaataacataggaattgtaattcctacaattcttggctttcaggaataatatttacaaatatagacaatttaagttgctgaattatgtactaaacaaaataatgattagaaaacaaagttgagttgtaaatgctcacccactaaatgctagttttgtggtgctgttgataagtacctaggcaagattataaattattcaggtcatggagcctcagaattgttcttgaatcgtaaaaatcatgagttttaatttttttttttgtttggggtgggggacggagtcttgctctttcacccaggatagagtgcagtggcatgatcttggttcactgcaacctccacttcctggattcaagcgattctcctgcctcagcctcccaagtagctgggattacaggcacccgccactgcgcccagctaatttttatatttttagtagagacagggtttcaccatgttggccagactggtcttgaactcctgaccttgtgatccacccgcctcggcctcccaaagtgctgggattacaggcgtgagccactgcgccaagacttaaatttaaaatttaaattcatgaatgctaaggtcctgctgtacccatagtaaaactaaatagataataaggaaaaaataaaattcatttattcatagtcttgttttggtaggcttttctgttatatgctaacataattgctatgtcgaaattggagaatttatgaaagcttaatttacatgacattttgcaagatttacattagtgttacaatctacataaaaacttgtttcattgtagttttatttgcttgcttattttgagtaggtaaagttcagaatttaaaagatgtgaaggctttacaggctgtctctcacaacacccatttcacctccataggggtaaagattaacagttcttatgtatccttccaaaaatactttaaaactcttacttcaataactgtaactggttatttatatatttacacacacacacacatatatcattaaaattaggcttaatttttaaatattccacctttttgttaaaagtttcagagctatagaaaagtaagtacaaaaacggcaatatacagtgaacgtccacatatccttctcccactttcaccagtttttaacattttgccacatttgctttctctagcttaatttttagcatatgtgcttcatgctaagctaatacttaaaaacaaacaaaacttggaaaactgttaaactcagaaatggtgcctcatactttcatataattttgtaactaaatatacatataaaaatatacacatatatactgtgtgttgataacttcatagcatcaggttttgtttcataataaaatgagccctttatttcatttttcagcaattctaatttggggatgcaaacctagatgactcttaaaggttttagagtataaaaatgcccattataaagataacaattctggttatttctagtaagaccccagatatgtttggtttacttaaaaaataacattctatactttgacagagttgagaagaaagaacgagcccgattaaaaacagtgaaattcaattctaaaacgagagataaaggggtgagtatttgaaatctctacatttttgtaattcctgtttgagctacattgttaaaatgaaaaggattttgctatcagaattattcatgatcagttcttgccatggtgctttacaatggtagatacttaagcatttgttaaattcaagcacccatttcacagacccttccaaattatcaaaactatcatttgatatattattagcaacatacttttgggtcaagcttatttttataaatgaaatgtatttgaccttcattcgatttccaattagaaatttgtgttactaggccgggcatggtggctcacgcctgtaatcccagcactttgggaggccaagtcaggcagatcacctgaggttaggagttagagaccggcctggccaacatggcgaaaccccgtctctaccaaaaatataaaagttagccaggcatggtggcgggcatttgtaatcccagctactcgggaggctgaggcacaagaatcacttgaacctggtaggcggaggttgcattgagcccagatcgcacctctgtgctccagactgggcaacagagcgagacccaatctcttaaaaaaaaaaaaaaaaaaaaaaaggtaaaaaattagccaggcgtgatggcttgcacctgtagtcccagctgctccagtggctaaagtgaaaggattgcttaagcccaggaggtccaggcagtagtgagccatgatcatgccactgctctccagcctgggtgacagagtgagaccctgtctcaaaaaaaaaaaaaaaaaaaaaaaaaaaaaggaaatatatcaattctttcatcatatattttagaagtgtatttatttttccttcactttaagtccttctgcttgcatctaaatacttgggctgtcgatagatgagaaagatggtacaggcttcatcccgtattggtggatgtaattcttaataatcctgaactcactgcagtggaatattctagcagtaagcctggagaacaaactgaatacatgttatgttaaataccatttatagcaatgttttatgtttggggttttttttaatactaaacaaaatttttataagtcttctgataatatttgaaatgaatgtggaatgttaactcagcaaataaatttactctgtacatctctggtatcactaagcactcagacttaaagctttaaaatttaaaagatgagaaatatctttggttcaagaagttaaatctgagaaaattatgtgttacattccattttttagaaatgataaattcctttaaaattgtagctttcagaaaaattccaaattatatagtgtgatctgaagcaatattaaaatagaaatttgtattagaggaaaaatcccaggtaaatgctcaggatttgaaaaatgtgaattttttaatgcttgttttatgtatatctttaaaaatgatttagtacaatataccatcaataaattgaaaaagaggttgcatgttgtaactttcctttcatactgtaagaagttaactgaattaacgacgtgtttaaatcttagtcttgtttgttgactgtaaccaactttatacagagtcactgtgttctaacacagcaccaaaactatgcatgatactgagtggggtgaaaatacgcttgccattgatcagaactgcatttctttctatagtaccatttcctacttctcctcctttccttacatagtgattatggactttatttttactacagacttacaacattttagtttctcattaacatgtctaacattcatttggctattttgaaatacatgtggaaattatgtatttagatatttaatatatgtatcatgaatttatgatattttatcaattcttacactgtctctcttgcgatatagcattaatgacagtaagtattaaatgtagtacttctgattgaaaatacagagaaactggaggtagcaagtcttcagttttgtgttttccctacacatttttgtcttggttgcttgtgctatttttttcacttttaataagttcttcacctggaggatattaaatgtgatacaactaatactttcttaactaacaagcatttctctctgtcctatattatgatatctttatgatatctcattttggctaactgcaaagataataagaatcagacattttaaacttcatgtttcttttggttgtttgctgtgaaactgactctgaccactatagatgcagtaagagggatgaataaacttttataaaaaacacatcagttgtatcagatataaaaattattgctaaattcaaaaccattgattcttatgaacgaaaagatttagtttttccctaaattagattaccataatttttttcactaaaacactttctcgtctatctcctttctaaaatttggatttgaacaaagatttttattcaaataatgctacttgacagtttataaaatagttataagcccagatttctccataatactttttctgtccattgaatttttaacttctacttagagttctcttttatctagttcctcagagccttcaaactttaagattgaaatcaagacagtctgcttggctaatgaactgtgaacttattaatcctgaattaattatatgaaaaggtaaaaatgaaagtttaaccttgtttttataaagatctttatcaaaataagtcttctcaagtcatagaatttgagctaaaagtcactttaatctacttcacttttttttttttttaatttaaagaaaaggtctcactctatcacccaggttggaatgcaatggtatgatcatagctaatcattgcagcctcaaactcctgggttcaagtgattctcctgcctcagcctcccaagtagctgagactacagtcgcacaccactgctcccagctaatttttttttttttttttttgagatggggtttcgccatgttgcctaggctgattttgaactcctggcctcaagcgatcctcctgcctcagcctaccaaagggctggggttacagatgtgagccaccacacctggctgcttcaccttaattacctggcatcacatgcttaaaataagggcatgccaaaaacacactgttcttgtcaatatacttcaaaataatgaataatacagcatcttaagatgtgtataaactcataaaaatcagaacaaaaaaatctattctttatatttttcccttccccctccaaaaaataataattcttagtgtcactggtaggtaagcccgtttccttcaaaacatgaatgcctatgacagagaaatgacaaaagaagctatttctgtttaatagcctcatcgttcttgtgctacatgctcttaaatctatgaatgcacaaatgagacattcaaggaaaaacttgtttccaacatgtgcaataagagacatcaaatcaactgctcaactccacgttacaattatgtataaactgttagaatcttaattgccttgtggctttggtggacaccaaactttttattccctatgaaggacgtggtgccaatgattggatgtggttctacattatttatgtgtacttttttttaataagtagagtagaacttaagaataaataagtcagtactgatagcattcacgttggtcaggagacttcagtactgaagcattcacgttggtcaggagacttctgactcttcttgcttggctaagagatggcattgataagtctcttgctggactctgtgtgcttgatggaccttttagttttcttcccattttctggctcataagcatttagttaccttttatcctcttccaagaatatgtatatgtgtatatataaatatatatatatttgttttttaaatattcagcattagcaactttctcataatcattttggtttactttttaaataatgacttttctgttagctcatcgtagccacaaaaaaagagataaaggaataactgtggtcaggccaaaataaaatgaagataatgaataaaatgtaattgagcagcaaagtaacattaaataacttttgctgtagagcacttaatacttgaaaatttttctggaaaaacatggattagtataaacaaatgttagcttggtttgtactgtagtagtaactgatttgcctttttttgtcaagtagcatttttatttttaggtataaatgaactatgctgtctgaaattcttaagtattttcagttgcaaaatgttagaatttatacaaaagtagaaattcactttatatgagattaaagtaaaaatcatatacaaactgcacactgtggtcataggagtcagcttccacagagctgctaggctgggcctttgtacacacagacagtagacatccctttgttttgcccctccttctcttcttcagcagtcattcaatgacaagcgtaaaaagaacctcttttcccgaaaattccccttctacaagaacaaggaccagagtgagcaggaaacaagtgatgctgaccgtaagtatgtggatccagtggtcaactgaaaataaaatggagagggacctactgccctgcagttggttgttaccatggagacagtttcaagagctgcagcaggttgctaattgtcttcaagggcaacttaacagttataaattaatttgtatgccgatcttaactttttctggcaccttaggaattcttaatttaaagcaaacattatttttcagttatatgtttataacttgaacatataaatatgtataaatgcagttatttgaaggaaagatttttatgaaaaacacattcatacattcaaagaatattttagaggaagaacatgaatacatgagaagctacctgttgatttctaggtataacatggcgagtctgataactggattctctggaatcattacattttaccctatttcttcattatatgtagacaatctggattttacttttaaaatagcaagaaatggtctaaaattttgcttctgtacctgaatcagccttcatgctagaactttcattcttttggtagattacagttagcagctagctcatttcaaagttctagaaatatgtaaaaatgctctgtaagatatatgtacctgtaatggtcttggaactgtctcttactgtagcaccaattttatgcattactgacaactattttctttgattatctttttattgcttgctctctggggactaccctctacaggagatccctgacgacatgggatcaaaaggcctgagtaagtgatcaaaatactcccaagttattttttaacctccatctgcagacctaccttattcagatacattttgagattcatggtagtgcctttctggcataaggaggtgtatgatttagattgcttttagaattttcatgtttatcacatgcttgggactttatttctgtaatacataactttttgtttttatttttcacatgtcatttgaaaaattctcttgctcgtaactatattttcctttttgtaatttttacgacagttacttttgctaggaacttttaaaatataaaaacttttaagatttttttaaatgtaccctcattattagaatgtagaaatatgcttccttggagttttatgttccccttttttttgttaaaataatttaaaataattttgattatgtgttagaaaagcattactataaaagtataaagcacaatagaatactacgcaagtagcagtttattgaggggataggttgtgtatctcttttttttttttttttttttttttgagaaagttataagttaccacaagagtataagaactattttgtttttcctttagctaagatgttgcctttgtttttggtttttgttgctgctgttcttgtttaattttctagctagttacttaatcttcatgtaaagcttcacacagggtctagtatgtagaagacattcaataaatgttggcatgaatgaatgaagcaagaagccattttagcaaataaaatttttaatttgcatgttttcaaattgcttaactgaaaatttaccaaacattactgagtaactttaggtgacagtgagtgatagaagtaatcttttaatctaatattttctaaatggttctttctatttagattattaaatattttgaaaacttctttgtcattcattgatcattaagcctatagccagtatcttttaactttctaagacctacattaataaacattaaattttacataagacatttttctgatttatgcttttatgctgaaattttaatctaaactgcaggtacttttatttcaaccatagtgatttaagtttgtattagattgaagacagtatgtttatttacaactctttctgttagacacactttgttatttttgcatgtgcctttataggatttagtaagggccacagatttcctatcactagtgacacccttacatttggggaaaattatcaatgaaaacctctaaaattggaccatactaccacagtttatgtatgctatagaatttattttgagattgataacatactttagaggtggtatggatcaacaaatggacccacagatttttcttatatgttaagtgaacagagacataggaaactcatagaaaaagaaactaaatgaagaatttggttcccatattgatgttataatagatgatcattataccttgaccctctttctctggttctgattgaagattgagactttggaagagaaataatatgaaaaatggtaactgattatcagacgacgttattcagaaaaagattttattttctggagagtgacctaagatctcttgaataatagatttctgtgcttcatctcacaggaattaaaagaatttattcacctggtaacttgatcatcagatcaagattttattcacaaaatgttggagaagacagaaaaatatcagtaaaattctaaaactggatatgatggaggttatcacataaaatagatgatataaggcagttgacaaggtgcccatgattatgtagtagtaaatactgggaagaaggatgtgttcaaggacgttacttgtggcctcagttacttacattctgaagttaagaatgtagggaataaactaagcaaaatcttgagagactttaatataagaaaataagtgcaacttaatgtaggtagtcatcaggccttattggaacaaaactcaaaaagaacccaaaaaagaaggttaagttattccagagaaccgaacctattgaagagaaatggaataacactgaatatcaagaaaaaaaaaatgtatatctgctgtaaattcacacaacctatgaaaaatggggtatttaattgaagagcagacagagaaacagaagtgataccatagaacgctttgtgtagacctgaattcatttgttctttattctgagaagaagagagtcaaataaattattgatttccctgttaacagtagagaaaacagtgagagaaatcgtcttatcaaacctaattttgctaaacagaactaatgagagtacaatggaagtttgggagaatgcagctaagtcatcatttgcgaaaagctagaaataaaaacccgtgccgctttcatgctttaagggaggtaattttgaaaaagctcaagggactaaaactaggtaagattcctttaacagagactgaaaggaaacataactcaataaaagatacataaggtgctcagaagtaaaattatgacataagatttgagacaaggtttgttcttattacatgtaggctttccatttttacaactttccatgttgtacaacacctcaaaaatttcctcaggcacgtaggtttcctgttacatatgtcttttctttcttctcactttaaagacgtacgcatagttgtgcagagcttctaaatgccaaaaacagacttattttcatttgcattacgaataagatgtaagagtagtttcattgcttcagattgatgatgtagtattagaggagagcagaagagaaacatgatgtactgtatcaggaagaagcatttgagtacaatgataaaacttggttagagagatttgagatagatctgttcatcaaacatcataaacaggctgggcgcggtgactcacgcctgtaatcccagcactttgggaggctgaggccagcagatcacctcaggtcaggaattcgagaccagcctggccaacatggcaaaaccccgtctctactaaaagtacaaaaattagcaaggcatggtggtgcacacctgtaatccaagctactcgggagggaggctgaggcaggagaatcacttgaacccgggaggtgaaggttgcagtaagccgagatcacgccactgctctccagcctgggtgacagagcaagactcaggttttttttttgtttttttgttttttttttttttaagacaatcataaacaaaaataaaaacttgaagaatttatttgtaccatgtatgtcacaaggataatatctttataagtttttaacaggtaataagaaataagctaactctccattagaaaactgggcaagagtgctcagaagataagcaaatgaaataagcatataaaaaatgtttaatttccctagtagtgataagcaaaatgttttacctgtcactttggcagacttttgtttaaaaagaaaacccatgacggagagagtgctgctaaatgcctgcttttaatgtattacaagtaaataatgtattacaagtaaatgtatgggagtgtaaattggcacagccttcctgaaaaagcacatcttttgacccactaaatcctcttcaaagaatttatcctaaggatgtaattagagatggagacaaagccttatatatcagaatgcttattataatattattgagtaataacagcaaaaataaaaaaaaccgtggtaaaatgtcttacagttgggaagtgcctaatgaagtatgatttatccatactatgtaatattacataaccatcaaaaatcatatttaaagataatgacatggggaaatgcttactatctatgaaaaaagtaaaatatgaaactgcatatattgtctcagtcttatatgtttggagctattttaaatagtgttgctttgaacattcttatacatgtcttgtggtaagcatatatatgcctttctgttggggaaatatctaggaaaggaattgctgggtcgtatagatacacatttgtccagccttagtagctattgccaattagttttctagttttaccagtttgcccattcctagcgcatgaactcccattgctgcatatcattatcgatgcttgacatgtctgttttgtgttttcattttagccattctggtggatggcagagacactctttgtggttataatttgcatttccctgacaagtaattaacttgaacacttttctatatgtttattggttatttgactgtcttctttggtaaaatgctttgaagaggaacattttcaattatcagaagaaaaacattttatttttctaataacattccaaacaattatgatgacgctattctaaggaccatactttgagtagtgaggctttattgtagaagagctaagtgaaatgatatttgaaagaacctgcagaatttgattgtggcgtagcttttggcagtcttagagggtttgaggtgagtaggagaaatctcaaaaaaaaaaaaaaaagacagtgaagagattttggtaacttaaactttttattatataaatatcagatatattcaatagtagaaaagtagtaaaaataaaccctgcaggtatttgtttatccagctttcataattgtcaactgaacatttgccaattctgtttcttctgtactcccacttacactcccctcccttcaccccattgcaataactaatttttctttagtttacaaactagagattgcagagggtaataccaatactaatgtaaacagaataactctttttttaatgtggcgtgtttctgggtatgaaatttaaggaaataggacagaaagttaaaaggtatatataaatgaagacattcataattgttgatacttgtgaaaaacagtttaaagcaaataaaaatatctaataaatagcgaggtaaataatgtatcaatctaatagaatattatacaccaattttaaattattgctgtcaagcccatgtggtgacatggaaagaaatattttaatatgagcttttaaaaaacctaccatttggccaggtgcggtggctcacacctgtaatcccagcactttgggaggccaaggcagacagatcacgtgagctcagaggttcaatatcagcctggccaacatggtgaaaccagtctctactaaaaatagaaaaattagttgggcatggtgctatatacctgcagtgccaggtagtcaggtgtctgagacacaagaatagaatcgcttaaacctaggaggcagaggttgcagtgagctgagatcgtgccactgcactccagcctgggcaacaaagggagactatctcaaaaaaaaaaaaaaaaaaaaaatgaaatttccagctgggtgtggtgattcacacctgtaatcccagcactttgggaagctgagatgggaggatcccttgaggccaggagtttgagaccagtgtgggcaacatagttgagacttgtctcttttattaaaaaaaaaaaacaaaattttagcagggcatggtggtacatacctgtagtcccagccactctgggctaagatgggaggatcacagaagcccaggagaggagggcgaggctgcagtgagctatagtcataccacctcactcccacctgagcaacagagtgaggccctgtccctttaattaaaaaaaaaaaaaaaagttaaaataaaaattcagatttccctgtctcattgaaagttttatttttattttttaaaaataaaagtattagtctttgtttaattgaagggagatatttattgagagaaaacttgagatgacatttacatggatgagaagagtgcctatggttttaccaaacaataaagtcgtgaaatggagtcacttttaaggagggccaggcagtttctggctgggtgtgtttgttctcattgtcttttttatgttttgcaaaagccagccagtgccagtcttatcaaagcagagtttctaagaaatattagttggttttaaaatgcaattgccaccatcggtgccttcccttccagctgagacatctgaatttatgacttctaatattagttggttttaaaatgcaattgccaccatcagtgccttcccttccagctgagacatctgaatttatgacctttacaatcctttatctatatgatctcagaaacatggattttcatcttcagaaacaggagcaaagctggattgaaaataagatcatctatttatttttaattacaaagacatcccgtcattaaaatgggcatctatttgtttaaatatagtttgtcccctttgccagttaacgctgtttcaaaaactgaaatagtgccaacagtattttctcctttgagttttatgtctacatttggactaattcagggtcacttagccctttttgtcatattctacttgctatttataatagatttgttcataaactgtgttgtacaaaaataaggcattgtccttaattacaggagttttcctttgctaatatatatttattatttgaaaaacttaaacgtttcaaagaaaaagaaaatgcttttaaaaaattattttgttatatatggcttatatctcaacatttcattttgattatttgctttttaaactcatgacactgttttattttttttcattgtcctgcaatttcagagcatgtaacttctaatgccagcgatagtgaaagtagttaccgtaagtgttttaagttacttgttcttttgtaatctcgagtaatacatcctctgcaggggtggagggattctgagtgatatgttataaaaacctgaagttatatgatcgttattttaaaatcagggagagacaagtaaaattctgtacttgaaaaataaaatcatactatatatgtagaggttaatttataaaattttaataaaataaaaatattatttgtgtacatgatacatatgtatatgtatatgtattttttgtaagaagtaaatatctagttaaatgggggaaaacttgtattttgaccttctgtttagtaattggttttaacatgagcactaaaataatatttttcagtaatgctaaattatcattagctttatttccatttttattctttgtcaccaatactgatctgggtcatgtcattgtttatcaccagcacttggtgaacggaagaaataaggaaacattttcaatgatcacctgaaaaataatactaatttttcttttgctgttttatattacattcttggttttattaagtgaactgcacaagcatgtgatgttttaaaacagacttgggcatgggagaaggggagggtacataatatcagttgtagcaccttaaaaattaaaattacttttctaactttctttttttactgctgtctaatatgaaagtaatcttgattacagatgagtatggctgctcaaaaggtccatcctgttaatatcagtccctaatactttttcatgttgacagtatatacttttaaccgtcattcatttggttgattatttttctacacaatagttacttaatgattttttttttggtgtggaaatgatttcctgtatttcagcattttattaattataaccagaacccactatagggtagttgagtggctttctaggctaaaaagaggtaatgaaagtatatactgtctctcaccatttgcatgaattattaaggtgtgaaatattcaaattgcatgtgtttgctagtatgtaagccatgtttcacatccagtactttaaaaaacagcttataaaatattggtcttatgtactttgataataaaattgaaaacaaagaaatacttctaaaacagaaaagaatgtttatgccaatgtatggatttaaaagacctacagctacatacatataatataaaccaattgcaaaattcatggtaaaattgttataggatcttgataattaaagagaaagtcttcaaatacattatccaatattgattgctttcattgaaccacttgggttaacacagtcttttctaattttaggcgtgggggtgaggggggatgtgtgtgtgttagtttaaaactcctagagtttttggccgggcgcggcggctcacgcctgtaatcccagcactttgggaggccgaggcgggcagatcacctgaggtcaggagttcgagaccagcctgaccaacgtggagaaaccctatctttactaaaaatacaaaattagctgggcatgatggcacatgcctgtaatcccagctacttgggaggctgaggcaggagaaccgcttgaacccgggagttggaggctgcagtgagctgagatcatgccattgcactccagactaggcaacaagagcgaaactccgtctcaaaaaaaaaaaaaaaaaaaaaaactctcagagtttttaactatttatttcttttcactggattcagatattcagatataatttgtagactcttttatttagagtatttcctaagctccgaacctttaatttaacctttagaagctttaacttcttgtgtttttaaggtcaaagcaaatatatttatctcctttactatcactgttgtttattttcttggaaggatttagttttatctaaagctctttttgactcacattaaatttattatttttttacaaagttgagttagtgaatttttcatcagtgaaatagtaacagtagttttacctttgcatttataatttttaattttaagatgtaattattttaaaaataaaatatactgtattcagtattgtagttggtggaacaaaaaaagtagcatgtttttaatagtaacaaattacctaatacgtagatagatgatagacagatctgctcattaaagcattaatctttaacagatttaataattcttagattctaaataaaggagtagcacatagcatcacaaatgaagatttttagatttgattatctataaaatataatattgattatatagcccatttgtattttgttttacatttagcaaactcacttttaagactttataatttgacacttttttttaactaaatcttgccataaagtacctctttccatatctttgccattttctcaggaaagttctagtaatgtatatgttgtttatgaagaattagattagcatcaattatctttacacatttttcatctgtgccttcactttctaataggtggtcaagaagaatacgtcttatcttatgaaccagtgaatcaacaagaaggtttgtgaagcctattgatgttttataaccttctagaagaatatactttttaatttgggggaaaaaaattctcataccccaaaaaatgttgtattaaaatttttttttactacatatacatgtagaaatttactacatgtgttttatgaaacatagtttactccacagaatattagaatctagtcatttcatactgacttttatatttgtgttttatttcccaagcaactttgttccagtgttcttgttagcatcactatcttccaaataacccttttttgaaaatcttggaagtatctttgagccttctctgttcctcctcctcctcctcatccagttaggttccaggcactgtttatcccacttctttcttatttatgaccttcttttcatcccttctatcacaatgttagttctcagtctcactaccaatctccattattccagcatgatcccagaccacccagagtttacacttctgttagatcatctttctagaatgctactactgggattatatcacttcctacatccagtttctgttctgcccttctttgctctgcttccttacaatttctacttcaaagccatctgtaaaacactagactttattctgtcatttgcaatgtaaagaaacattatctgcgaaaacaccaaatttaacttgattgaattatcaatatgacttctagcagaagactaagtaaagtttaagatctgagtcaagattataaaagagcaagttacgcatctttggttgatggtagagtgagatggagagggaagaaaaaaattagtcataacagttaaggatatttttgttcgctggtgaaataaaatacattgatatttgttgaatgtttattccttttaacatgcagtttatctttatagttaattatactcgaccagtgatcatattgggacctatgaaagacaggataaatgatgacttgatctcagaatttcctgacaaatttggatcctgtgttcctcgtaagtaaaccaaacaaaaacatttaattgttactcttaacatttcctgtcactgtgtgtgggaaaaatagatataaccattttttaatggtttgtacttattttatcagttactcttccatcctccatattattgtcctttctcagatttaaattaatctgttctgttgaactttacaaaacgatgtaagtagaaaatggatttattgtggttttttttttaatattaaacactttcccaagtttttttctgttaaagatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaaggtaagcatcagactaatcccagaatatagcttctaatcagatatgcctttgacagtatgcaagactggtaggatagatacagcactaattagttttgttaatgtgatgaatttgcttacctaaataattaattttccatggcttaggaaagtgcatacaagataaaacaggtaaataaggtaaacaaagaaagtgaaaatagaaatgataacatgaatgtaagagaagttattttcaggtcatttgctagagatagaccttttgtttaggcctagctctccagcatatattaaaaggagataagggccgggtgtggcagtgcacccttacagtcctagctactgagaaggctgagttgagagaatcactgaagcctgggagtttgaggctgcagtgagctatgagcatgccactgaactccagcctgggcaacagaacaagaccctggctcttaaaaaaagaaaaaaaaagaaagatcaataaatctaaccacttaaaatttttaaaaaactttttttatggccaaagactttttccaaaaactattggaaaacaccattaacaatgtcaaaagacaactgacagaaaaaatttgcaagaaaagggctaatattcccaatatataaagaactcataaaaacagggaacagagaccagaaacccaatagaaaaaaacagtggacaaaagatcagaatatatagttcacacaaaaataagatataaaatggcctttgtacataggaaatgacgttcaactgtagtcattattaaagaaatgtaaaggccgggtgcggtggctcacgcctgtaatcccagcgctttgggaggccaaggcaggcggatcacctgaggttaggagttcaagaccagcctggccaacatggtgaaaccccgtctctactaaacatacaaaaattagccaggcttggcagtgcatgccttaatcccagcttctcaggaggctgaggcaggagaattgcttgtacctgggaggtggaggttgcagtgagccgaggtcgtgccgttgcactccaacctgggtgacaagagtgaaactctgcctcaaaaaaaaaaaaaaataaggccaggcacagtggaaggctgaggtgggtagatcacctgaggtcaggagttcaagaccagcctggccaacatggcaaaaccccatctctaccaaaaatacaaaaattaacttggcgtggtggtgcatgcctgtaatcctggctaaggaggctgaggcaggagaatcgcttgaacccaggagattgcagtgagccaaaaccatgccactgcactccagcctgagcaacagagcaagactccatctcaaaaaaaaaaaaaaaaaatgtaaattaagaagactactctaaattcaatttctcccctatcagattcagggagaaatatgaagacattttcttggtgagactgagagaaaacagttgtgcattgctggtggaaatgcaaactggtactgccttttggaagggtatttggcaatatctagcagctttccttcaacccagcatcccacttctaggaatttattccaaagatataccccaacagtatgaaaatacatgggcaaaagggtatttattcattgtagcattgtttataattgtgaaatactgaaaatcatctaaatgcccagataaaagtgattgaattaattttacattcacaaaatgaagttctctaaaactgttaataaggtatttgaactgatacacaacatgcaaaagaatatctacggtataaaataagagaaaatgggaaaatacaaatctctgctcagttgtgtgaaaataagcacaggaaaggtaaatcagaacttaatgaggttggttacctacagagggagtgatgtagagagggaatttggaatgggatggaaaggatgaggggtatgacatttctctgagtatacatttttgtattattttaacttttagaaagtatgttagtattttacatatttaaaaaaatcaaaaataaaagcaacaaagaaagatgggggaaaagcaaaatgatacataagtagaaactaaataaacctgactgtatttctttttttttttttatactttaagttttagggtacaataaacctgcctgtatttcaaatgaataacttaactacattgaagaggggagaagtcttaatcccagagattctttaacacaagctgaagacagatctgtaaacaaaataaaactctaattagtaggtttgttgggtggagtgtatgggcttacagttctgaaactaatatatattctagggttgagcaaataaactaatacaatggcagtagtgggagtgaggtttgactgtcagaaaaagggagagggtaaaatgaactctgtgataattggattggagatattagataattagagcgatgaatatgaacccatggattgttaagagtagatatagaaatagatgtgtatttatgtatacacacacgtatgtttatttgctttatccactaagaagacctaaaaataacactgaataagccatgagaatatctggggcccggatctgggcttctaaatataattcgttaattaaaagatccaggactccttagagaaatggctgattctggggccaggactggaaaagtgtgagataagcctgtaacattttgctgccagaaaaataaggaagcactcaaagaatgatgaagatgtgtaaaaaggcaaaggaaccaagctgtagggtcccccactggccaagtctgagataatttgaatatcaagataaatgataataacatattataatacatagagtaaaataaaaatcgtagagtccataatgatataaacaaacacagatggccctcaacttagaatggttcaacttttcagaggcgcaaaagtgatgcatattcagtcgcagccatacttcaagtacccatacagctattctgtttttcacttgtagaacagtattcaatgaattacatgaaaaattcaacacttaattataaaacaggcatgttggatgattttgtccgactgtagagtaagtgttctgagcacatttaaggtaatctgggctaaggtatgatgttcagtagggtaggtatattaaatgcattttcaatttacagtattttcaacttgtgatgggtttattgggacgtaactcccatcataaggagcatctgtatgtgagtaagtaagtggatagaagggaacgctttggactgtctactaatcaaggtagaagaaatgattaaattagaaaatcttttgaaaaccgcatggtggtaattgtttccggcagaaaccatcagtgtattctaaaattagtgaacatttgatgaaaaaagggatatttatatagtctcaaagtgtcctcccccaaaatacttatcagttacaaaggtaaaaatgataattttacagtggagaaacctagcagataaaaccttaaacaagtgatcaaaattaggatcactaataatgggacaaatagatataatatcgcctcccagatatgatggactaagaaggacacacattatgtctgtagtattcctgccaaaaatgtgtaacctgccatccgagagtgagtaaacacacaaacccataaacccatagaatgaggcatattctatgatataaatattttatactcttcaaaaacatcaagaaagacaaaagactgaggaactgtgtcagattgacggagactaaggagactttacaactaaatacaatgtgtgatcctatgatcctgaattcgatccttgaccaggacatttttttactcttttccaataaggaacattagatggccacttggaatcatattgtgattatgtaagagatgccattgtttttaagaaatacgaggtgaaggagcattatgcagtttattctcaaactattatgtacatatatagaaagagttaaagcaaacctagaatattaatatttcagtatcaagttattaaaatgtttaagcgatcatgtaaaatatttatgtctgatgaaagtagataatgggtacatggtgtctattatttacttttctatatgtttggagtattttacagtattaaattttttattttaaatgtgcccaccaaattgaaattatcatgtattgacttggactcaagtccttgggttagaagttgcattatggggctgagcatggtggctcacgcctataatcccagcactttgggaggccaaggtgggtggatcacttgaggtcaggaatttgagaccagcctcaccaacatggtgaaaccccatctgtacaaaaaacacaaaaatcagctgggtgtggtggcgcacacctgttgtcctagctactggggaggctgaagcaggcggaagttgcagtaagccgagatcatgccactgcactcaagtctgggtgacagagcaagtcttcgtctcaaaaacaaacaaacaaaaaactgaagttgcattatcggggagggcctgatttcaaatgtattagaagaaaatctgtcataaataataaatactatgcttaacatggaaatgctcatctgtattaaaaacctaagtatcctttgtcagtgagtttaagcttgtcagaaaagttgtcatttaaatccagaactggggtcccatatgctagtttatgagtttttgtcagtccctaataaaatgagaaatagaaggattgagtagtggcaatgaggtttcacaaatttgtttatttaaaaggtttgcccttactctagggttttttatcttttatgaaatgatagctatggggagatggtagtttggagtcttaatgaataacttttcttggcagaatgaaaaataggaacctgggcctggcacagtggctcatgcctatcatcccagcacttcgggaggctaaggtgggaggatcacttgagccccaggagttcaagaccagcctggtcaacagaacaagaccccgtcccttaaattttaaaaaaagggaacggcgggggagctctatttttcaccattttgagaaataactgatccgtgaaaactaggaactgtattttcattcctttttaaatataacatttgtttgaaaatggcaaattaattatgcatattcagccatttcatttcctatctaaagtttgctgagagaaatgacaagtttactaaaagtgaacaaggatcgaaacagatcatgatttagactgtggacctgtaggaaaagtacctttgatattattgagaatatttggctcacttgttttttttctttgttccctttattttagggcaaacactgtatccttgatgtgtctggaaatgccataaagagattacagattgcacagctttaccctatctccatttttattaaacccaaatccatggaaaatatcatgtaagtgtaaatgcctaaggcatagcctctgtgtacaaattcagtcactgtagggtaatttatttactctccctgcatctcagtttatctataaaattgagataatagtagtatgtttattcacctcagattatgtggtgaggattaaataagcactatgggttataaattgtcattgtaatcatcatcattaatattactaaagtataaggtaacatgtgttagaactttaaatagccccacgtgtgactagtggctactgaagtacgcagcacagctctcaggtaaccattaagagaataaaagaatgtataaccattacctaatactttcaggggacaaaaaaatagaatctaagtaaaaattaagaaagaacaaatagaaacacagaatgtgaggcagaaccatataaatagtgagatggtataaactaaagcaaataatagactactagactaaatgttccaattaaaagacaaggggtgaagaaaaaagtaaattatatgtggctttcatcagacacaccttaaaaattaggctatgggaaggttgaaagtaagagaataggaaaagatataccatgctaaactaggctgatttttatatggctgacgaatatactttaaggcaagaagtattacttagcttcagagtgacatttcatggctgggcacagtggctcacgtctgtaatcccaccactttgggaggctgaggcgggcagatcacgaggtcaggagatcgagaccatcctggccaacacggtgaaaccccgtctctactaaaaatacagaaaattagccgggcgtggtcgcgggcacctgtagtcccagctactcgggatgctgaggcaggagaatggcgtgaacccaggaggcggagcttgcagtgagccgagatctcgccactgcactccagcctgggcggcagagcgagatccatctcaaaaaactaaaaagagtgacatttcataaaagtaaaatattcactccaacaggaagatctgttcgtacatttgtttgcacttcatagcattctcaaaacaaaaaataaaaattgacagctgcataggggcgaaaagtaattccaacatcatcgagagggacagaagcaattaaataagaaaacaaatataaaaatcagtgaaggtatggaataacacaaatttaaaactttacctatttgacatctgttaaacactgcactcatcatctgcaagagacacatggatttccagtgtacatgaaacagttactaaaactgatcatttgctagattacaaatttcaaaggatagaaaacaaatactctccgaccataatgcaatttaaatggaaaccaataattaaaagataactagaaaatcctcatgtatttggaaattaagcattatgcttctgagtgagtcaaagaagaaatcacagaataaattgatgttttgaactaaatagtagtgaattgccaagtagagtttggaggctttcatagctttgttgaaggaatacacacagctttgaaggaatacacacagctttaaatgttaggaaagaatgttgaaaatcaaatattaggaaagttgaaaatctaagattttgagaaactgaaaaagaaggcggggcacaacggccggcccctataatcccaacacttcaggaggcctaggtgggcggattgtttgagttcaggagttcaagaccagcctgggcaacatggtgagactctgtctctactaaaaatacaaagaaatagccaggcatggtggtgtgcgcctgtggtctcagctacttgggatgctgagatggggggattgcttgagcacagggagcagaggttgcagtgagccaagatcttgccactgcactccagcctggtgacagagcgagaccctgtcccaaggaaaaaaaaaagaaaacaatatttaaaaatttaaaaataaaaaatatggcagagcagaaattaatgaaatagaaaaaacaaacatatgataaagaggatcaacaaagccaaaagtgttctctttgaaaataaaatacaataaaccattaggagtgatcaagaaaagaaagaaggcatatcaatgtgaatatcaggcaagacaaagaggatatgactacacatgcagcagacaccaaagagatcaacagaggcagcctgacaggaaaagggacaaagggcttggacacatcacaaaagagaatctccaaagaataagcctgtgagatagtgcccaactaatcatggaaatacaggttaaaaaaatgaaaaagacaaaatatttaatgctggcaaagatgtggaacaactgaaactcgtaacagtgttaggggtgcagattggtgcatcttcattggtaaactgttgatagtatcatagtgtctcctaaagctgaacatgcacgagttatgacccagaagtcatattcttagacgcacactccacagaaacgcttacctgtgtttacaaagacaggtacaagcgtgatgacagtactgttcaaatagtcaacgactgtcaggtgcggcggctcacacctgtagtcctgacactttgggagcccaagacagaaggattgcttgaggtcaggagttgggagaccagcctgagcaacatggcacaatcctgtctctacagaaaactttaaaaggtagctggatgtggtggtgcattcctgtaatcccagctacttaggaggccgaagcaggaggatcccttgagcccaggagttctgtccaagctgtagtgagctatgcttgcaccactgcactccagccttggtgacagagtgaggccgtgtctctaaaaaaaaacaaagagtcagtaactaaaaactagaaactacccaaatactatcaggagtagaatatgtaaataaattatgacatgttcacaatgaaacattctgtgataatgtgagcaatctccagccacatacagaagtatagaagaatctcacaagtacaatttgagttaaaaacaaaaacccagacctaaagatatacatactctgtgactccaaatttaataattgctcatagaagtcaaatagaggttaccctgtaagaatgggttggtgactagagtgagcacacccagattctggggtcctagtcatgctctgtgtcttgacctaagtatacaggtacatgtaagtttgtgaaaatgtaacaagctgtatgatacgatttttctaatattgctcatctgtgtttgaaacatatacttcagaaaatgttaaggaaaaaatagaaaaggaaaagaaaaatagaaaacctaaataatctagtacttattaaagacttgaacccgtcataaaaagcctttccacaaattaaatactaagccaagcagacttactaaattctaccaaaagctaagaagctatgtcaattttatacaaacttttcaactaatttatgagcattaatttgatacccaaacctggaagggactatataggaaaggaaaatgataaagtcagtcttaattatgactatagattgcaagaacccttaccaaaataggagcaaattgaatcaaacaatttttttaataaggcaaaatgtaacaaccaagttgggtatattcctggtatgcaacactgctgcagcatttaaaaactaatcagttatggagctagagggaagatggcagagtaggaagctctgggaatctgtctccccacccagacgacaactgcactggcagaatctgtctgatgttactatttcggatctctgttcaccatttttatcaggttgggaactctgaagtctattgaaggcttatgacttccaggggaaggtttgaaaggttaatttcagctcttaacatggtagcaactacctgttcgtctaccctcagtcccatagcatgtagccatgtacacattttcaagcagctttgcatagggtttgtgggagccagtgtggacaataaggattctgtcctccaaatagcaggaatctttgctctgatagctaattactgcttctgatcatggaggtgcagccatacagtgagccattgttgcaaaccccactgccactgttacaagcccctccacttgaggctgaagtgacttaaagatttaaagggccattgccttcagtggtgattagtgaggagaaagaaaaaatattaagtaaaaacaaagggctagtgcttccctcttccccccacaccacagacacacacacacaccttttttccccctccccttttgggggccagaccaggacattcaaaagtatatgaggggaggttttcatatccatggaaaatcacaggcttagaaaatacctgaaaagaccctaagtttacacctcaggctgattcctggtacagaaacaccttgcaacagtaaacaataaaattaaattttaaataaaacagcaaaccctgggaaaggaagagaattcgttctccagagttacttacattgtaagatttaaatgtgtagtttcccacaaaaaaatcacaagacatacgaagaaacaggaaaatatagcccattcaaaggaaaaataaacaaactatccctgagaaagactatacttgagaaagagttagacttaataaagactgtaaaacaagatactaaatgagctaaaagacatggacaaagtctcaagaaagtgataggcccagcgcagtggctcatgcctataatcctggcacttagaaggctgagacgagaggatcacttgaactccgtggttcaagactagcctgggcaacatagtgagaccttgcctctataaaaggtaagcaaaaattggccagacgcagtggctcacgcctgtaaccccagcactttgggaggccgaggcaggcagaacacctgagttcggtagttcgagaccagcctgggcaacatagcaaaaccccatctctactaaaaatacaaaattagctgggcgtggtggcgggcatctgtaatcccagctacttgggaggctgaggcacgagaatcgcttgaacccaggaggcggaggttgcagtgagtagagaccataccattgcaccccagcctaggcaacaagagcaaaactccgtctcaaaaaaaaaaataaacaaaaattagctggccatggtggcacgagcctgtggtcccagctacatgcaaagctgaggtgggaggatctcttgagcctgggaggtcaaggctgcagtgagccgagatcacaccactgcactccagcctgagcaacagagggagaccttgtctccaaaaagataaaggaaaaaaaagatgaaaaagatacatgaacaaaatggaaatatcaacaaagaaataaaaaacctaaaaataaaccaaaaggaaattctggaggtaaaaataactgaaatggaaaattcactacagggattcagggagatttgagcagacagaagaaagaatcaacaagttttaacttaaagatacaacaatggaaattatttagtctgcgaaacagagaaatgactgaagaaaagtgaacagagcctaagggacctataagacaccatcaagcagtcaacgtacacattgtggaggtccttgaaggagaatagagagaaggcagagagattgtttgaagaaataatggccaaaaacatcccaaatgtgatgaaagacgtgaatataatccaagaaagtcaatgaactcaaagcaggataaacttagatacccacactgcggcacattataatcaaagtgtcagaatacagagagaatcttgaaagcagcaacttaccacacacaagggatttcccaataagattatcagtcactgtttttgtttgtttgttttttgagacaaggtctcgctttgtcacccaggctggagtgcagtggctcgctgcttacccaggttactgctgtcttaacttcctgggctcaagcagcctctcacctcggcctcccaagcagctagggctacagacatgcaccgccacgcctggctaatttttgtattttttagagagacaggattttgccatgtttcccaggctggtctcgaactctgagctcaagtgatccacccacctcagccttccaaagtgctgggattccaggtgtaaataaatacccaccttgcccagcaatcagcagattttttttttttttttttttatgagacagggtctactctgtctcccaggctggagtgcagtggctcattctcagctcactgcaacctctctgcctcccgggttcaagtgattctcttgcctcagcctccctagtagctgggattacagggactcaccactgtgccctgctaatttttgtattcttagtggagacgggatttcaccatgttggccaggctggtcccgaagtcctgacctcaggtgatccgcctgcctcggcctcccaaagtgctgggattacaggcttgagccaccatgccctgccagcagatattttatcagaaactctggaggccagaaaacagtgggttcaaaacactgaaggaaaaaaaaaaaatttaactgtcaacaaagaatcctatatctggcaaatctattcttcaaaaatgagggagaaattaacacatgcccagataaattaaaactgaaagagtttattacctgtagtcctcccttacgagaaatgctgcagagaattttgtagggtgggatgaaagagtactagacagtaactctacaaaatatcaaagcaaacgtcataattaatggcaaaatattgaaggctttcctttaagttgggaacgaactctatactcatcatccagctgcagcaataattatccacttatgaccaatcttgtttctctccactcacacccacctccttacaccttcattccagattattttgaaacaagtctcagacattcctatcattttgtctgtgtacatcactgtgtatttgaaagataatttcttacaaaaagtcactgattatcatacttaaaataataattatttgataaagttcaaatgttgctggttatttcataagttttgtttgtgtttcttcagtttgttggaataaaatttttagtaagatctattcatggcagttggttaagttgtttaacctatagattctctctccacatctctcttttatgcccccaccccgccacacctcccatttatttgtgatagaaaccaggtcatttcttctgcagatgtttccccagactgtattttctgattaccttctcatggtgttatttatatggttgtttgtccccttattttctgtaaactgataggtagatctctaagtcactttaatatgaaattttcatcaaagtcaaaagtatcataaattaatgaataggttttttggctacactgagctgatgcagaatttgttaaaaccctctgtcattccaagtatacagcaacatattcagtgactaaatctagtttttatttttttatttttgtttatttatttatttattttgttgttgtggagacagagtctcgctctgtcacccagactggagtgcagtggcacgatctcggctcactgcaacctctgcctcctgggttcaagcgattctcctgccttagcctcccaggtagctaggattacaggcatgcgccaccacacccagctaatttttatatttttagtagagtcggggtttcgtcttgttggccaggctggccctgaactccttacctcaagtgatccacctgccttggcctcccaaaatgctgggattacaggtattagccaccatgtccagcctattatttttatttttaaaaatcccagaaacaggctgggctcggtggctcacatctgtaatcccagcactttgggaggccaaggcgagcagattacctggggtcaggagttcgggaccagcctgcccaacttggtgaaaccccatctctactaaaaatataaaaattagccaggcgtggtggcgcatgcctgtaatccagctacttgagagatgggggcaggagaatcacttgaacccaggaggcggaggttgcagtgagctgagatcgtgccactgcactccagcctgggtgacagtgtcagacactgtctcaaaaaaaaaaaaaaaaaaaaaaaaaattcccagaaatgaccagaatgactcaagtttttaatgacattcatattttcagcagagttcaacttttcatgattttctattttatgtgtcatctctcctttgccatcttttttttaaaagtattataatttggtaattatcaatttctacatttattttcgtagggaaatgaataagcgtctaacagaagaacaagccagaaaaacatttgagagagccatgaaactggaacaggagtttactgaacatttcacaggttggaaccgtgttgtaacagtcctctttaagatagaattttgctttgaagccatgtgaaccgacccgttcaggtggattttgaactatgcctacatctacccgtagtaactagtatcatccagcctaggcagtggtgctggggaaccttttttttgagacggagtttcgctctgtcacccaagcggagtgcaatggtatgactcggctcaccgcaacctccgcctccctggctcaagcgattctcctgcctcagcctcccgagtagctggggcctccctggctcaagcgattctcctgcctcagcctcccgagtggctgggattacaggcacctgccaccacgcccagctaattttgtatttttagtagagatggggtttcgccgtgttggtcaggctggtctcgaactcctgacctcaggtgatccacctgcctcagcctgtcaaaatgctaggattacagcggtgagccaccctgcccagccaggaatcttgaaatttaatgtttcttaggttattgattagaacaacaaaaacaggaataattcatacttgaccagagaaaaatagatttagatttcatttcttctatgaaactctgatttttctcttatcctttataaattttgatccattttctctagccatgttgaggtataattgacaaaattcgtatatattcaaggcatataatgtgatttgataaatgtgtacattgtaagttgattaacacaatcaaattaacatgtctttaaccacacagttaccattttgtgtgtgtagggaagactcttaagatctactctttattaacaatagtcactactgctgtatattagatccccagaatttactcatgttaaaactgaaagtttgtgccctttcactaacatctccccatctcttctactctgcagtccctggaaaccacctctctgtttctatgagttctacttttttagattccacgtataaatgaaatacagtatttgcttttctgtgtctggcttatttcatatagcataaggtcctccacattcactcatgttggttgttgcagatgataggattttcatttttatggcctaataaaatattccattgttgtatatataccatatgcatgcatacatacatacatatatatatatatttgttgttgtttgttgttgggtttttttgggggttttttttgttgttgtttttttttgaaatggagtctggctctgtcgcccaggctggagtgcagtggcgcaatctcggctcactgcaacctccgccttccgtgttcacgccattctcctgcctcagcctcccgagtagctgggactacaggcagctgccaccacgcccagctaattttttgtatttttagtagagatggggtttcaccatgttagccaggacggtcttgatctcctgacctcgtgatccacccgactcggcctcccaaattgctgggattacaggcgtgagccaccgtgcccggcctgtttttggttttgtttgtttgtttttgaggcagggttttgttcttgcccaggctggagtacagtgtcatgatcatggctcactgcagcctcaacctcctgggctcaagcaattctctctcttcagcttccttagtagctgggactacaggcgtgcaacaccacacctggctaattttttatttttgtagagacagggtctcgctatgttgcctaggctggtctcaaactcctaggctcaagcaatcgttcttcctcggcctcccagagtgcttggattataggtgcactgcacctggcctacaatattctctttattcattcatcttttttgtttttggagatggagttttgctcttgctgcccaggctggagtgcaatggcatgatctcagctcaccacaacctcccgggttcaagcgattctcctgcctcagcctcctgagtagctgggattacaggcatgtgccaccatgcccagctaattttgtatttttagtagagatggggtttccccatgttggtcaggctagtcgaactcttgacctcaggtgatccgcccgccttggcctcccaaagtgccgggactacaggcgtgagccatcgggcccggctcattcatcttttgacagactcttaggtgattttcatatctgggctattgttgattatgttgcagtgaacataggagtgcagatttcaacatactgatttattttcctttggttttctttttgttgttgttggctttttgttttttattgttttgttttgagacagagtctcactctgttgtccaggctggaatgcgggtgtgatctcagcttgctgcaaccatcgcctcctgggttctgttgattctcctgccttagcctcccaagtagcagggactagaggcacatgccaccacacccagctaatttttgtatttttagtagagacagggttacagggttggccgtgctggtctcaaactcctgacctcaagtgatccgcctgcttcagcctcccagagtgctggaattacaggtgtgagccaccacgcctggcccaatttcctttcctttgtatatatatcgagtagtgggattgctagatcatataataactcagtttttaattttttgaggtggctgggcacagtggttcatgcctgtaatcccagcatttttggaggcccaggtgggcaggtcccctgaggtcaggagtccgagaccagcctgaccaacatggcgaaaccccttttctctactaaaaatacaaaattagccgggcgtggtggtgcatgcctgtaatcccaactacttggaaggttgaggcaggagaattgcttgaacctgggaagcggaggttgcagtgagccaagatcgcacaattgcactccagcctgggcaacaagagtgaaactctgtctcaaaaataataatagtaataataatttcttgaggaatgtccacactattttctgtgatggctttactcatttacattcccaccaacagtgtacagggttcccttttcttcataccattgcctacttgttatctcttatctttttgataacagccatccacacaggtctaaggtgatatttcattatggtttgcgtgtgtgtttgtgacagagtcttgctctgtcacccaggctggagtacagtggcatgatctcagctcactgcaacctctgcctcctgggttcaagcgattctcatgcctcagcctcctgaatagctgggattacaggcacatgccaccacacccggctaatttttgtatttttagtagagacagggttttgccatgttggtcagactggtctcaaactcctggcctcaagtgatctgcccgtctcagcctcccaaagtgttaggatggcaggcgtgagccactgcacccagcctcattatggttttggtttctgttgctctgattaatgaggttgagcacttttactgatacctgctggccatctgtatgtcttctttggaaaaatgtcgattccagtcctttgcccattttttaaatggattatttggtattttgctaatgattttcttatatattttggatattaaccccttaccaattgcatgtttggaaatattttctcctcttccataggttgccttttcattttgttgattgttcctttgctgtgtagattttttatttaatatcccacttgatgattttttattttgctgcctgtgctttccaaaaaatcatccaagaccagtgtgaaggcgcttttttccctgtgttttcttctaggagttttatggttctggttttacatttaagtctttagtctatttcaagttaattttgtataagataagggtttagtttcgttctcttgcatgtggatatccagattttccagcaccatttatttaagacactagcctttccctattgtgtagtcttggcccctttttaatgattagttgccctttgatccgttttgaaatactatttgtttaaaaaaaaaaaaagtaggtagcaactccccaatattcttattttactcgccttgtcctttaacttcctcctcaagtctttggacatttttgttgttgttacttgtttgtttgaaataatatcagcctaaatttgacattcacactgagtatcagtaagggtcatggtttttaaaccttgtgctttcttatttttttcaaactaatttcagacttaaatagaagttacaagaatagtacagggagtttcatgtacccttcacccaaattcctcaagtgttaacattttaccacatttataggtttttttctgatacacttgagagtaagtttcaggtagatgtccctttacttctaaatatttcagtgtgtattttctaaaaaacagggatattcccttatagaatcatagttttattatcaaaatcaggaaatttaataattatatgtctcatctaactatagatcttattagtatttcactattcttctaatctctttagagcaaaatggaaaaaaatggtttttctgttctggtgcaggatccagcggaggctcacgtgctgtattggattatcacatccttaatgttctttaatctgaaatcgttcccaagtcttgttattcatgaccctgactgacattttttaagagtaaaaacactaggggggattttttgttgttttttgtttcgttttgttttttgtttcgttttgttttttgtcttttgtttttttttgagccagggtctcactctgtcacccaggctggagtgcaatggtgcgatctcagttcactggaacctccacctcccaggctcaagtgatcctcccacctcagcctcccaaggagctgggactacaggctacagccaacatgcccagctaatttttgtattttttgtagagacaggatttcgccatgttgcccaggctggtctcaaactcatccaatccgcccaccttcaccttgacctcccaaagtggtgggactacaggcgtgagccactgcacccggccaaagacccattcttttataaaatgtccctccctcaatttggatttatctgatgttttctcataattcgatttaggttctgcatttggggcaggaatagcaatgaagtaatgatgtgtcctctgtgtatcatgcaaggaggtttacaaagtctacttgtgccgttacttatgatgctaattttaatcacatggttaaggtgtctgcagccttatgctttcccagtttccctggtttactaaccattccattaatgaatttacaaagtaagcaaaatgtatatttcccaagtcagttcctgactgttttctcctaaaataaatccttgcgtgctgttgtcaacctaaactatgaaatgctctaaaataaatccttgcgtgctgttgtcaacctaaactatgaaatgctctgggattctgtcctgtgctgttggggtgcatcaagatgccaaacccacgaaccaagtattttgtcaaatgaactgagtcttcagggacattgaggcatgtctgcatttagctcaaaaggtagaagtctcacaaaactgatactagcgaatatcatgttactgaaaattcttggttattcaggcgttcctagctatgtataagtgcttcctacctacatacaacgtctttcttctatgcacatcatctcaggtaccaaatagacagtattatttaaaatccccctttgacattttatgctcagtttttcagaccatggaaatctacacctatgatgctcttccaagatcactgggcatttttttgtagtttagtaagtgacttatttaatttgcaattctcaattatttcatttatatgtaaacttttttacgagacacaaggttccactctgtcacccaggcaaatggtacaatccaatggtacgatcatagctcactgcagttgtgaactcctgggctcaagagatcatcctcctgtctcagcctcccaagtagccaggattacagacacacaccaccatgcccagctatttttttttttttttaaatacacagggtctcactatgttccccaggctgatctcaaactcctagcctcaagcaaccctcccacttcagcctcccaaagtgctaggattgcaggcatgagccaccatgcccaaccataaacattttctttctttcttaaaaagttagttactcatgcttagtgctgtctagcgatactttgtttttgtttgtttgtttgctttattaactaatccctcacagacctcaggggcttcagctattcccaaagaattagttgttagtaattgttactctttttttcacacattatttcagacagcaaataaacattgattgttaagtctctaaccactaacaagctagcttaggtatctctcaattcacctacactacagtacctgacatgctagcttaactgaaaaaagtagtatcaatctgtaatcagctcttttcccccaagatcctaccccaaaaaaaaaaaaaattatccttacatcatcctgtctatgggattgtacccagtttccttttttctacatatgtttatggagaaatcaggaaagttaagaaaataatttgttttaaaataataaagctaatatatgctcagatggtaaaagaacaaaagaaaagatctccaagtcttactttttgatccatttttaagataaaaattttatactatataaataggaaaattaatgaagtgagccttttttcctaagtgaacagtgtgtaaatggtgattcttcctggatgagtaactttttcaaagatactagcttctactatttcatcaataattgtaatggcaaaaatagacaattaatggagatttctgattttgtttctatcattacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttccttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatccatatgttaagtgtgtcttgaattttgaaagaaaaaatatattttgcaagctaacattttcttgaaacaatttgaggcatcatgtaacttataaccgaatccaagagccgttaggcagcagagtgtgttaccacattgaaatacacagtgctgctgttagactaaatgtcgtaggttgttaaccacatagaaacacactagtatgaagaaaactgttgtaaaatctcaagagcttcagaaactgccttacaagaccgcagcataagctattttgaagtatttaccaaatagtcacatgttgtaaaatatcaagtggttataaaaggatgccatttatatattaaaatttacataacattgttttctgga

SEQ ID NO: 391 - DNA, 175267 bp, Homo sapiens
aaagcgcggggccagactcatcggttcattcaacaaccagtatttagtgcctgctgtgttctgcaggccctgccataggcgcttgatacagcggtgcatagcgtatgagaaagatctgtcctggtaagcttacattcttacagcagacgataagtattttaagtgttaagtaaataaggttatttcacgtataaggtgttaaatgctatgaaaagaaaaataaaacagggtaacgtggtgtgtcctgtgttgagcccctgggggacgcaagagggagattagcttgcctacaaggttattggtggaggtagggagaacttaaagatcagcacctgtaagaaagtgaaggaagcaggaatttgtaggcagaggaagaagttggcctgcaaaacagttgcagcagaggccttgaccaatcccaaggcatgcttggagcctaggatgacccttcagagtagttccacattaaagcaagggggccagaaactcttatccttgcattgaccagtcatggatacaggctacacctggggaggagctgtgattttttttttttttttttttttggcaagactgcttccctcggtggagggcggcccccagagaaggactcagttgtgtatcatcagtaaccaactccagaagctgagggaatgactgtctaggccctgagggggtgtctggaccacaacatcagctatgttgcagttagagtatcatttaaacaagtctgaattcaatgaatttttactgaggacttttcagacaccataggtgtctgaaaaacatttcataaacatagacataaagatcctaagcaaatattagcaaatcaaatccagcaatttataaaaggattaatacatcatgatgaagtagggtttatcccgggaatgcaaggttggttttgcattctgaaatcaaacaatgtaatttaccttaaaagagaaaagccttcattggaagaaataataaaaattttttttaaagaaaagctatgattatgttaaaaaatacagataaatctattggcaaaaataaacacctcttctgaccaaaatacttagcaatctaggaatagaagagaaattttccagtctgatgaagggttcaaattatcaatcagggtttggacaagagaaatcacatatgtactattttaattaaatgttttatttgagaaaattggacactcatatgcagttgtaaggaataatatggacagattatatgtaccctttacccagcttcccccaatggaaacaccttgcaaaactgtagtacaatatcacaaccaggatactgacattgataaagtcaagatgcagaacattttcatcaccacaaggatccctcatgttgctctttgtagttacactgcttcttaattcctggcaaacgtctgtgttgtatagatggaatcatacagagtgcaaccttttagaatttttttttcactcagcataattatctggagactcatccaagttgttgcatgtatcaatagcgcgtttctttttattgatgagtagtagtccatagtatgaatgtaccacagtttgtttagccattcactcactgaagaacacctgggttgtttccagttttcagatattctgagtaaaggtactgtaaacatttgtgtacaggtttttgtgtgaactaagttttcatctctccggaataaatgcccaggagtgcagttgctgggttgcatggtagttacatgtttcgttttttaagaaactgccaaaatgctttccagagcggctgtaccattttacatacccaccaccagtgtatgaatgatcaagtttgtctgcatcctcatgagcattagcttttattttagccattctaataggtgtgtggtggtgtcttattgtgattttaatttgtatttccctattgactaatgatgtaagacatcttttcatgtgcttatcttccatgtgtatattcccttcagtgaaatgtctgttcatgtcttttgcccattttctaattaattgtttttcgtactgttgagttttgagatatctttatatattctagatattagccctttgtcaaatatgtgctttgtaaacagtttctcacagtgtatggcttgtattttcatcctcttaaccgtatcttttgcagagcaaaagtttgtcattgtgataaggtccaatttatccacttttccttttattgatgcttttggtttaataactctttgcccagccctagatcctgaagacattctactgcctatttttttaaagattttttattttacatttaagtctatgatacattttgagttaattttttatttattattattatactttaagttttagggtacatgtgcacaatgtgcaggttagttacatatgtatacatgtgccatgctggtgtgctgcacccattaactcgtcatttagcattaggtatatctcctaatgctatccctccccccccccacaaaattgacaaatgggatctagttaaactaaagagcttctgcacagcaaaagaaactaccatcagagtgaacaggcaacctacaaaatgggagttaatttttaaaataggtgtaaaactttggttgttgttgcggttgttcttttttgtttgtttgcatatacatgttacattacgccaacaccatttgttcaaaaggctatgtttcctccattgaattgcttttatgcctttgtcaaaaccagttggacatattcgtgtgatcctatttccagtttctgtattctgttccattgatctatgtgtttattcctctaccaatacaggctgagcatccgtaatataaaaatctgaaatctgaaatgctccaaaatcctaaactttttgagtgctgacattatgccacaaatggaaaatttcatacctgaccttatgtgagttgcagtcaaaacacaggtgcacaacacccagttcatgcaacatccccagtgggaaaaaagacccccccagctctcttctgctgcagtttttctgctcacacctggatttccccatgcattcccacaaaaagtaattaaatggcatgcgtgcaggctggacacgccaacaacaggtttcccacaatgccccacatggggccaagacctgtgtgcattactcactgcatttttttgcttattctctgctgtgtggtataaatatattgttgaaaatgtcaaaaagacctaaagatacccctgtgaatatcagtgataagaaaaagaggaagcatttatgtttatctatagcacagaaagtcaagttgttggagaaactggacagtggtgtaagtgtgaaacatcttacggaagagtatggtgttggaatgaccaccatatatgacctgaagaaacagaaggataaactgttgaagttttatgctgaaagtgatgagcagatattaatgaaaaatagaaaaacacttcataaagctaaaaatgaagatcttgatcgtgtattgaaagagtggatccgtcagcgtcgcagtgaacacatgccacttaatggtatgctgatcatgaaacaagcaaagatatatcacaatgaactaaaaattgaggggaactgtgaatattcaacaggctggttgcagaaatttaagaaaagacatggcattaaatttttaaagacttgtggcaataaagcatctgctggtcatgaagcaacagagaagtttactggcaagttcagtaatgatgatgaacaagatggtaactttgaaggattcagtatgtcaagtgagaaaaaaataatgtctgacctccttacatatacaaaaaatatacatccagagactgtcagtaagctggaagaagaggatatcaaagatgtttttaacagtaataatgaggctccagttgttcattcattgtccaatggtgaagtaacaaaaatggttctgaatcaagatgatcatgatgataatgataatgaagatgatgttaacactgcagaaaaagtgcctatagacgacatggtaaaaatgtgtgatgggcttattaaaggactagagcagcatgcattcataacagagcaagaaatcatgtcagtttataaaatcaaagagagacttctaagacaaaaagcatcattaatgaggcagatgactctgaaagaaacatttaaaaaagccatccagaggaatgcttcttcctctctacaggacccacttcttggtccctcaactgcttctgatgcttcttctcacctaaaaataaaataaaatacagtgtacagtaaccttttagtcaaaacagcatcatacttggaaactgaaagcctactgttatttgttattgttgcttaacagctgatacaggtattctggtgacactactgtgctggcttacttaacctgaatacactatttttttcgttgtattactggtatgtcattttttttactgttaagtacttatgtgtgaataagtgtaaaaaaatgattgcttatcggtaacatataaattcagaatcaggaatgatggtgatgccaaacaatcacagatcgtccacatgggtggcggagatgttaacacctttgctttctgatggttcagtgtatccacactttgtttcatgccaaaattatttaaaatattgtatgaaattaccttcaggctatgtgtataaagtatatatgaaacataaatgaactttatgtttaaactgggatcttatcctcaagctatctcattgtgtatgtgtaaatatttcaaactaaaaaaaaaaaaaatctgaaacacttctggtcccaagcatttcagacaagggatattcaacctgccctgcagtcttgattactataactgtataataaatcttgaaatcaggtagcctgatcccactttatttttttctcaaaatggttttagttattctagttcctttgcctttccacacaaattttagaatgatatgtatgtctaaaaaatactgttggggctgggcgtggtggctcatgcttgtaatcccagcactttgggaggctgaggcaggtgaatcacaaggtcaggagatcgacaccatcctggctaacacagtggaaccccgtctctactaaaaatacaaaaacaaaattaggtgggcgcctgtagtcccagctattttggaggctgaggcgggagaatggcatgaacccgggaggtggagcttgcagtgagccaagattgcgccactgcactccagcctgggtgacagagcgagaccccatctcaaaaaaaaaagtactgttggtagatctggattggtggctacaaaaaaaatcttgttgggatttttataggaattgcattaaacttttatatcaacttggggagaattgacatatttgctacattgggtcttccagtccatgaacacaatatctctcaccatttatctagatcttctttgacttgtttcatcagcactttgtagctttcagcacacacatcatgtgtgtgttttgttagatttatacctaagtatttcactgttttttgagtgattgtaaatggtatttaaaatttctgtgtctgctacaagtatatagaaatgcagttgattttttgtgtatttatcttgggtcctactttttgctaaactcactcattagtcctatgagttttttgtagattctttaggattttctatggagaccatcatgtcatctgcaaattgggacagttctattttcttcctttctgatgtgtatgcctgtaatcccccccccttttttttttttgccttagagcactgactaaaactttagtactatgttgaataagagtggtaatagcagacatccttgccttgtttccagtcttggagggaaaacattcagtctttcaccattaaatataatgttagctataggtttttggtagatgctttttatcaagctgaggaagttctccctttactaccatttttttcagagtttttatcatgaatggtgttgaaatttgagaaaactttttttgtactgattgatagaatcatggtttttctttagcccattaatgtgtacattacattgactgatttttgaatgatgactagctttgcatagctggaataaatcccagctgtataaatcttttactactttgttgcatttgatttgcaaatattttgttaaggattttttgcatctaagtttatgagggatattgcctgtagttttctttcttttgtacttctttgcctgatttgagtagaagggaaatactagtttcattagatgaatttttaaatcttcaacttttaagttcaggggtacgtgtgcaagatgtgcaggtttgttacatgggtaaaattgtgccatggtggtttgctgcacagatcattccataacctgggtattaagcccagcatccattagctgttcttcctgatgctctccgtctccccactccacccctgataggccctggtgtgtgttgttcccccaccccatgtgtccatgtgttctcatcattcagctccctcttgtaagtgagaacatgtggtgtatggttttctgtttctgcgttagtttgctgaggataatggcttccagctccatccatgtccctgcaaaggacatgatctggttcctttttattgctgcatagtattccataatgtatatgtaccgcattttctttatccagtctatcattgatgggcatttggattgattccacgtctttgctattgtgaatagtgcaaatgaacatacatgtgcatgtatctttataatataataattcatattcctttgggtacatacccagtaatgggattgctgggtcaaatggtatttctgcctctaggtctttgaagaatcaccatactgtcttctacagtggttgacctaattaacattcccaccaacagtataaaagtgttcctttttctctgcaacctcgccagcatctgttattttttgaccttttaataatcaccattctgactggcatgagatggtgtctcattgtggttttgatttacatttctctgatgattagtgatgttgagcttcccccaccccccatttatttatttatttaagagacaggttctcactatgttgcccaggctggtcttaaacacctggcctcaagctatgggcactttaaaagaacgtgtattctgctgttcttggatgcagtgttctataaatgttaattagaatcagtggttaatgatgttggtgagttgctctatatccttgctgattttctgtctcattgttctactggttgttgagagaggggtgttgaagtctccaactgttgtggatttatgtatttcacctttggattctataagtttttgcttcacatatgcgtctctgttgtttgatacatacacatttatgattgctatgtcttcctggtgaattgacccttttattattatatagtgtccttctccatctctaataattttctttcccctcaagcttacttaatctgataatattgtagtcactctgctttcccttggttagttttgcatgatatatccctttttaccctcttactttcaacctgcctttgttgttatacagtcacataccagataatgatgttttggtcaacaacagaccacatgtatgatggtggtccaataagattataatggagctgaaaaatttatgttgcctagtgacaacctgatgattctgatgctgtgtaggcctaagctactatgtgtatgtcttagttttaactaaaaaattttaaaaatttttaaaaaataaaaaatttaaaaatagaaaaaagcttatagaataaggatataaagaaagaaaatatttttatacaagtatacagtgtgtgctttaggccattataaaagagtcaaaaagtttaaatatttaaatgtttataaaataaaaatgttacagtaagttaaggttaacttgtttttgaagaaagaaatattttaaaggtagtgtaacctaagtgtgcaatgttcacacctacagtagtgtgcaacaatgttttaggccttcacattcactcactgttcacacacagactcatccacgacaacttccagccatgttaagtgccctatataccacatttttactctccctttactatgttttgatatgtttagatacacagatacttaccattgttttacagttttgatggtagtgtaaaatgtttacattgttttgatggtagtgtaaaatggcacaaacactttcagaaatgatctggcatttcttataaaactaaatatacactgaccctataatttagttttaatcctaggaatttactcacagtaaatgaaaacacttataccacaaaaacgtttgtatgacaatgttcactgcaaatttattactaataccctaaactggaaactgctgaagtatcaataaaataatggatatacagtggtattttcatgaaatggaatattacttagcaattaaaatggacaaattatgagtttcatagtgtgtggctcacaacagtctcaagtactatgactaagctaagcacttcatgaattttatcttactgaatccttctagccttatgagataatcgctattattattgacaagtgctttgtgtttattttcttaacttttactaccttctgaggtagcatcctcacacacactggtgtacagaaatacaatttaattctgatgctgaccacccagtgttggcattggactccacaggtttaatggcacaatccccagtaaaactattttcacttcagatgccagctgcattttggggggtccctaagccacctgtgcttttgacccactggctgtaaattcaaagtttcacatgaccccctaaggtacaataattttctagaatgactcacagaactcaggaaagcactaatgatacaaatcaggaccagctaaatgaagatccacatgggtggagtctgggagggttctgaatggagagcattcatgacctctccccatggcattaccctcctagcacattgatgtgttcaccacctgggaagctctactgagctttggtgttcagagtttttattggggtctcattacataggcatgattggatcattggtcacatgactggactcaatcttcagtcctcctcctctcctaggagattgacccaaccctctaattacattgttggtctttctggtgaccatcctcaccctgtgtcatctcatcagttagcataaactcaggtgtaatctaaggagctcataaataacaaagacactcctgctacttaggaagttctaagggtttaaagtctctttaccagaaaccagggacaaaggccagtcaagttatttattacacaataggtaggcactattattattattttatttaatagagacagggggctgggcacagtggctcacatctgtaatcccagcactttgggaggccaaggtgggtggggatcacttgaggtcaggagttcgagaccagcctggccaacatggtaaaaccccatctctaccaaaaatataaaaaatcagctgggtgtggtgacgcacacctgtaatcccagctacttgggaggctgaggcaagagaatcacttgaacctgggaggtggaggttgcagtgaaccaaaattgtgccactgcactccatcctgggtgacagagcgacactccatctcaaaaaaaaaaaaaaaaaaaaaatagagacagggtctcgctatattggccaggctggcctcaaactcctgacctcaaccaattctcccactgcagcctccctaaatgttggaattacaaatgtgagccatcatgtctggccagtaggtaggtgttattattgtcctcattttagaggtaagtagggacctatattgattgctcaaagttacacagtaactaacagaattaggactggaacctaggtatgtctgaatacagtcttgctattctctactatatatatattgtctgaaagttattgccacatgctatttattgaatgaataaattgacaggaaaagatcacaggtgattctgaaatttctaccttgtgggaactgagaatgatcaaggcccttttgagaatttcattgatgctagatacatttatatttgtagatcctatcccatattaaagtctgtctgtatcccacatcaagtattattttttttgctgaaaaaaatattgaaaggatttaaaaatttttttctttagaaatcatttggctacatgcactctagtcattataggatttgatttcatggcaattgcagtgcatgggtggaatgtttccaaagtgagaaacatgaacttacaaattattttcaaatgtaataaaatgtttataaataccagtgtattacttcagtacagcctaagctgctataacaaagagacttcttagtacagtgagagtacagggctggtacacaggcttccacctcagcatccactccagctcttgccttaaggtctgcatcacagggacaaagcagccacattgacaatgacaaacagcatcctttgcacagactgcagtgctaatgtgccccctggagttgtccatagtagtagctctcacaagtgtgtagggagaaagatgaagagctcatcccctactgcacaaccagaagtggcaggtatcacttgtactcacttcccatgttcagaacttaagtcacatgaccacatctagcttcaaaagagtctggaagtatagtcttttactaagtgacccttgcacctacctaaaacctagttctacttataaaggaagaaggggatatatagtagtcactatcataattaaattgcataaacaagtaatgaaatcggtataaatttatgttggtagacatttaattgaaagtttattgcttttgactttatagttttctgtattttagttgtgtttaaaaaaaaaagtgggagggttgttcttaaacattttttttttaggcccttgaaaagtctgtcagctccaagtgctgtgtctaatggatacaaaatctctgtggatcatgaggccactaaccagagaaggaatgcagggcggctgtgattgctctctgcttggtcccctttctgggtaggaaggcagcccttatgaagcgggtaggctagattcagtatgcaatttgtggggctaagggagtgtggacactcaaacaaatattaactgatccttatgtagctggggttatagtccgtggggctgagggtgggacaggaagcagggagaggaggggagaagggaataacaactagaatgagactcagggccaagaaattggtaaggaagacaaaataacatgaacaaacatgcacaatgataggtttcagagcagattatgaaagtcattgtgagtcatcggtggtagtactgttgtttaaaaagaaacagtgtctgccaggcgcagtggctcatgcctgtaatcccagcactttgggaggctgagacgggcggatcacgagttcaggcgatcgagaccatcctggctaacacggtgaaaccctgtctctactaaaaatacaaaaaattagccagcctggtggcgggcgcctgtagtcccagctactcagaaggctgaggcaggaaaatggcgtgaacccgggaggcggagcttgcagtgagccgagatcacgccactgcactccagcctgggccacagagcaagactgtctcaaaaaaaaaaaaaaaaaaagaaagaaagaaacagtgtctagataacgctgggctctgaaggaaacagaggttggattacacaaggtcctgcctgaggacatctacagtttataaataaatatgtccaaagtggggaaagtaactcaaatgacctgtttcctatagaaaatgctccagcccgagaactgtcctgacatgaagtaggagccattagcagggaggccggaaatctaggtttatgttcggcctctatcactatttgagaatgtgagctcctttggagtaggtaatgcatagtttcatctttggatcctcacctagcctagtgcctggcacttactaagttcttagtaaattcttacagaatcaatgaacaatttgttaaataacttgctgtgtatccttgaactgagacgttttaccaggggtcttaaacctaaaaggaaacagtgggtcaaggtggcgtccaggtccctagtgacctcaaattttcaggatatgaggactgatatttggctactgtcacactaagaagtgcacctcatagcatgcaaaatccaatctgaactcaacccacacgtctcagctcaaagactgcctcctccacaatgcctcccctaccccttccctcaacaaattgtgcctctgctgacactcttctaccttggttattctcagttgaattcattacctttccttaccccctcaggcctgtgacctgagaacacagagtaaaagctaacacttaggtagaatttaccatgtgtcaggtgctctaaagggcttaaaatcgtcagtgcatttaatatcttgatgcaccagaaagtaggtgctttgattatcctcatttcagacatgagaaaactgaggtacagagtgagtaactttcttaccattaggctggtagtgagtggcagggacaagattcaaatctgggtaataagtctacagagtccttaactagttccctgtcttgttcaactttaaataccccataataaacatcccatggtcagcccatagtaggtgtgcagtaaatgtttgccaaataaatgaataagcaaatgcagtaaactaggaagcggggtatcagaagggcatggagtttccctgaatacccatgtgcctgttgggcctctcgggcctctcaaacctttccccaacatgttgagttagtttgttggtccatccatccactcacttgtccatccatccattcaatgaatagttactgtcctaacccacctccccaccatcccacattgggaccagggatacaaaactgaattggcacagacagagatggacttattcacagtcaatggcagtccagcatcacataagctacacagaagacagagccactaactctgcccaggcagggtcagagaacactttttagtctatgggacagagattcgatctgggttttaaaaaatctgtctccaggtccctggtaggccagggtcctccctgaccccagcccatatagctggagacagaacagcctgtccttccagctgctggctgcaaacttgccttggggagtccatggctctgtccatggtctgaatcctggtgctcttgttggctgccatgcccctagattgagccatatgctttggaccctggttctgagtgttgaccctgagcctttagtgccaggctcacagccaagcatagcccacttgccagatcctttcaggtctctcccttttagctgggggtgcgaggggcggggtgagggtgggaggacgtatggcatatccctaggcatgtgctaagatacagacctgggacctctcagttacatgattgccagtttcattgaccccttcctcagcctctaaggaaattcaggccagactaagaaaggactcaggctggagcaggtccctgagggctcagccacacttgtgtatactctgcctgtcagagctggcctggccacagatatcatctaggtccctgcctaccctgaagctctggaatgggcatacattgaaggaggcagacctggacttcagggctcttgatcccagtctgacgttcgttccactacaaaaagggggtctggaattcattttcagtaatgaaggctttctccatgaaatcttaaccattatataaagcagaacaggtctgcctgaagcgagttagggcatctaaaagatcaccatcttggcctctgccttcctgtctcagcctttaagtcacttctaataaacctgtcttattttttaccgttagatctcaacaggggaagttggtccagtgaggtcctaagcccatgcagaagtggcagctacttccctccagcctgtttcacccacttccttcaccttcctcactacagccagagacctttaaaaaacccaggtgtgtctttgctaccctccagtttaaaaacatccatttggcagggcttggtggctcattcctttaatcccagtgctttgagaggcttaaggtgggaggattgcttgaagctaggatttcgagaccagcctgggcagcatagtgagaccctgtctctacaaaatttttttttaaattagccaggtgtggtggtatatgcctgtagttccagctacttgggaggctgaggtgagaagatcacttaagcccaggaattcgaggctgcagtgagccatcactacatcactgcattccagcctgagtgacagagcaagaccctatctcaaataaacaccagaaataaacaaattcatttatccaacaatatttacacaaggactattatattcattgtacttctagctcctttcattgtggcaggaattgaagtaggagctagaagtgcaatgattataacagtccttgcctgtttgtggtggtaggggagccaacaaacctggtgacaataaaataaattactagacagagtctggtgatagagcctaaaacaggagcgtggtctgaggaggctgaaggacaaaccagtgccatccaggagaaaaccattcagccagagagaagagcccatgttaaggtttagggtggcagctttaggaaaacagaaggctcagtgatggtgctgtgaaatgaggccagagagatgcacagaggccaggtcatggaacaccctaaaaatcacttccaggttgttggtctgcatcttaaagagcaaagggaatgcaattgaatggttttaaataagatagtgacacaatgccatttttgttttaagatcaagctggttgttatgtggagaacaggcttgaggaaggcaagagtaaaggcagagaggcctattaagaagacattgttggctgggcatggtggcttatgtatgtataatcccagcactttgggaggtggaggcgagaggatcgcctgagcccaggagttcgagaccagcctgggcaacatagtggaaccccatctctacaaaaaataaaggtaaaaaaccagccaggtgtgatggtgcatgcctgtggtcccaactacttgggaagctgaggcaagaggatctcttgagtccaagaggttgaggctgcagtgaactgtgttcacaccacagaactatagcctggggcaacataacaagaccttgtctcaaaaaaaaaaaaaaaaaaaaaaaaagattgttatagtccaagtgagagatgacattgagaagttgtgctaagtatgggtactgtgtgttccatacacctaacactccttcttccaaccttcaggccccagggaaacactttcccacatatcttgccctacatcctcaaaacaaaaaatcatgtattttacatagagtaaaatgctcacatgtaagtgcctagtttgaggagcttgcacaagtgtatacacctctgtaaccaccacccattcaagcatgggtagagaccatttccatcatttccaccacatgactgtgtctaaagttctgtgggttgtgctgctgttcacaccagaaacagccactgctctcgagtaaggaaagcaagtgagtggcagaagctcttgggtaagaaaagcacacatcaattaatcctgtgaagtcttttctctcacataacatgaatgcctaatggggtatcattttccagaaaagcattgtccattttcttgcttctttttgtgttccgatttgtagttttggaggaattcaggaatggcttactatttgcaatagttgcatgtggcagctcattaatattaaacaatattaaacaactcatactactctaatattgtagtgtaggtaggtctagttgtagacctacatatacatgatattgattctttatggacttagctactgtgttaaggaatgatgaaaattattatatgagtggtagtgatttatatgatgaaataaaaatagaatgtattatacgtatttaccattttataaatctattttaacatataaatatagtttgtattgtgtaattatgtgttcctatatttgaccataatatataaaattcatgctacttttaaaatctaatgttactttaagatttttattgacaatccctgttgctactgccttagcagagcaaactttttccaaattgaaatcaatgccaaaaaaaaacctctaaaacttacagtgtcccaataaaggttattttgtttttgaccttattgtccaaaacttatgaaatatataattattgatgaaccatatattcccttttactcatatattcctgtccatgagccattcctttccatgacatccattaaattcagtcatctttgatattttgcttactttcaataaaaagtaccatagaagttggtgcaaggtggaagactagaaggtcccaccaattgtcctccctgcaggaacaagaaattcaacaactatctacacaaaaaaccaccttcactagaaccaaaaatcaggtgagcactcaaaatacctggttttacttcatatcatggaaagagacactgaagaggataggaaagacagtcttgagttgctgatgccaccccttccccattgccgctgcagagaaatctatgtgctttggagacagcacagcaattgtgagactttacattgaattcagtgctgccctctcacagcagaaagcaaaaccaggctgggctcagctgacatctgcctatgaagggagcattcagaccaaccctagccagtggggtatcacccatctcagcaataggaacgtgagttccaggaagcctcaccaccatgggctgaagttctctggagcctaatataaacttgaaaggcagtctaggccacaaggactacaaatcctagtgctgagctgggcttggggggcatgacatacttagacatcagcaagggcagctaagggactgttagtaccaccccgccccactgccaggcagcatatcccctggctccaaaagagacccctttctcctgcttgaggagggaagagtaaagaggaccagctcagccacagcaagatagagcattggtcagagttgtgagatccccattccaggccctagctcctggatgacatttctagacacaccctgggccagaagggaacctgctgtcttgaagagaaggacccagtcctggcaggatccatcatctgctgactaaagagcccttggtccctgaataaccagcagcagtaaccatgtagtacacactgtgggtgttgggtgaaactctgagacttgctggcttctggtgagacccagcaccttcccagctgtggtggccatggtgagagactccttctccttgataaaagaagagggagaagtaaggggatttttgtcttatagtttagataccaccttggccacagtggggtagaacaccaagcgggctcttggggtccatgattccaggccttggctcttggacagcatttctggacctgctctgggccagagggaagccaactgcctgaagggtgagtcccaggcctgaaagcattcaccataagctgattgaagagcccttgcgccttaagtgaacattggcagtagcctggcagtagtctttgctggcatgtggtggtggtggccacagggtgagacccgtctgcctgtggaaagggaagagaagaatgggaaggactttgtctcatggtttgagtaccagcttagctacaatagtgtagagcaccaggtagacttctaagatctttgactccagtccctagctcccggatggcatctctggacctgcctggggcctgggggaactcaccaccctgaaggggaggacacaagtctggctggcttcatcacctgttaattgtagagccctagggccttaagtgaacatagatggtagccaggtagtggttacagtgggccttgggcaagactcagtgctgtgctagcttcaggtctgatgcagcccagtcccagtggtaatggccacaggagtgcttatgtcacccaacccaagccccaggcagctcagcacagggagggagactccatttatttgggagaaagtaagggaagaaaacaagagtctccacttagtaatccaaagaattcttcctgatcatatctaagaccaccaaggtggtatatttatgagtctgcaaaaaccacagcattactggcttggggtgttccctaatgcagatagggtctagaacaaaacacccaaatccttttgaatacttgaaaagcctttgaatacttgaaaagaacaggtacaaaaaagcccaggtggtaaaggctataagaaatacctaacccttcaattcccagacactgatgaacattaacaagaatcaagaccatccaggaaaacatgacctcaccaaacaaactaaggcaccagggaccaatcctggaaaaacagagataagtgacctttcaggcagagaattcaaaatagctgtttggaagaaactcaaagaaattcaagataacatggagaaggaattcagaattctatcagataaatttaacagagagattgaaataattaaaaagcagaaattctggagttgaaaatgcaattggcatactgaagaatgtgtcagaatctcttaatagcagaattgatcaagcaaaagaaagaattagtgagcttgaagataggctattcaagagtacacagtcagaagagatgaaggaaaaaggaataaaaaaatgaatcatgcctacaagatttagaaaatagcttcaaaaaggcaaatctaagaattattggtcataaagagaaggtagagaaagagatggggtagaaagtttattcaaagggataataacagagaacttcccgaacctagagaaatatatcaatatccaagtacaagaaggttatagaacaccaagcagatttgacccaaaggagactacttcaaggcatttaatagtcaaactcctgaaggtcagtgataaagaaaggatccaaaaagcagcaagagaaaaataaataatatacaatagagccacaatacaactggcagcagacttttcagtggaaaccttacaggccaggagagaatggcatgacatatctaaagtgctgaagaaaaaaaagaacttttaccctagaatagtatatctggtgaaaatatcctaaaagcatgaaggagaaataaagagtttgccagacaagcaaaaactgagggaattcatcaacaccagacttatcctacaagaaatgctaaaggaagtacatcaatcagaaagaaaaggatgttaatgagcaataagaaatcatctgaaggtacaaaactcactggtagtagtaagcacacagaaaaacacagaatatcaggccgggcgcggtggctcatgcctgtaatcccagcactttgggaggccgaggtgggcagatcacgaggtcaggagatcaagaccatcctggctaacatggtgaaaccccatctctactaaaaatacaaaaaaatgagccaagcatggtggcgggcgcctgtagtcccagctacttgggaggctgaggcaggagaatggcatgaacccgggcggcggagcttgcagtgagccgagatcacaccactgcactccagcctgggcaacagagcaagactccgtctcaaaaaaaaaaaaaaagaaaacagaatatcataacactgtaattgtatgtgaactgctcttatcctaagcagaaagactaaaagatgaaccaatcaaaaataataactacaacaagacatagacaatacaataagacataaagaaaaacaacaaaaaagtttaaaagtggggagatgaagttaaagtgtagagtttttgttagtgttctttttgcctgtttgtttatgcaatcagtgttaagttgtcatcagtttaaaataatgggttataagttagtatttgaaagcctcatggtaacctcaaatcaaagaacatacagtggatacataaaaaataaaatgcaagaaattaaatcataccaccagagaaaatcaccttcactaaaaggaagacaggaaagaaggaaagaaggaagataaaactacaaacaatcagaaacaaataacaaaatggcaggagcaagtcctcacttatcaataataacattgaatgtaaatggactaagctctccaacaaaagacacagagtggctaagtggttaaaaaaaaagaaaaaaaatcatctgttgcttacagggaacacacttcacctataaaaatatacatagaccaggggtgtccaatcttttggcttccctgggccacattggaagaagaagaattgtcttgggccacacataaaatacgctaatgctaatgatagttgatgagctaaaaaaaattacaaaaaaacctcataatgttttaagaaagtttatgaatttgtgttaggccatattcaaagccattctgggccacatgtggccctcgggccgtgggttggacaagcttgatatagactgaaactaaagggatggaaaaagataacttatgcaaatggaaaccaacaaagggcaagagtagctacatttatatcagacaaaatagatttcaagacaaaaactgtaagaagagacaaggaagctctctgtacaacaataaaggggtcaattcagcaagaggatataacaattgtaattatacatgcacccaacactggagcactcagatatataaagcaaatattagtagagctaaagagagagatagaccccaatacaataatagctggagacttcaacaccatacttgcagcattggacagattttctagacagaaaatcaacaaagaaacatcagatttaacctgcactatagaccaaatggacccaatgaatatttatagaccatttcatccaatggctaaaaaatacatattctcctcctcagcacatggatcattctcaagaatagaccatatgttaggtcacaaaacaagtcttaaaacatttaaaaaaataaaattaagcatattctctgaccacaatggaataaaactagaaatcaataatgaggaattttggaaactatacaaacacatggaaattaacttgtatgctcctgaatgatcaatgggtcaatgaagaaattaagaagaaaattgaaaatttgatgaaacaaatggtaatgtaaacatgacataccaaaacctatgggatacagtaaaagcaacactaagagggaagtttatagctataaggacttacatcaaaaaagaactaaagatcagagctgaagtaattgaaattgaaattgaaatgaagaaaacaatacaaaagatcaataaaacaaaaggtggattttttgaaaagataaacaaaattgacgaacctttaaccagactaagagaaaaagagagaagacccaaataaataaaattagagataaaaaaggggacattacaactgatgctgcagaaattcaaaggatcattagtagataccatgagaaaccatatgccaataaattggaaaatctagaagaaatgaataaatttctggacacctacaacctaccaagattgaaccatagaaattcaaaacctgaacataccaataacaagtaccgagactgaagccataataaatctcccagcaaagaaaaacccacaactcattagcttcactgctgaattctaccaaacatttaaagaactaatatcaatcctactctgttctgacaaatagaggagggaatacttccaaattcattctatgaggccagtattaccctgataccaaaaccagacaaagacacatcaaaaataaaaataaataaagctacaggccaatatcactgatgaatattgatgcagaaatcctcagcaaaacactagcaaatcaaattcaatgacacatcaaaaagatcatttatcatgaccaagtgggatttaccctagggatgcaaggatggtccaatatatgcaaataaatcagtgtggtacatcatatcaacagaatgaaggacaaaaaccacatgatcatttcaattgatgctgaaaaagcatttcataaaaataaaaaaactctcaaaaaactggatatagaagaaagatacctcaacataataaaagccatatacaacagacttgctgctcatatcaaactgaatggggaaaaactgaaagtctttcctctaagatctggaacatgacaaggatgcccactttcaccactgttattcaacatagtactggacatcttggttagagcaatcagacatgagaaagaaataaagagcatgcaaattggaaaggaagaagtcaaattacccttatttgcagatgatatgatcttttacttggaaaaacataaagactccaccaaaaaactattagaactgataaacaaatacagtaaagttgcaggatacaaaatcaacatacaaaaatggatagcatttctatatgtcaacagtgaacaatctgaaaaagaaatcaagaaagtaatcccatttacaatagctacaaataaaattaaattttatttgtgccctttgaaactaaccaaagaacaaaaggaattaaccaaagaagtgaaatacggttgcaatgaacactatataacattgatgcaagaaatgggagaaaacaccaaaaaatggaaagatattccatgttcatggattggaagaatcagtattgttaaaatgtccatactacccaaagcaatttacagatgcaatgcaatcccgatcaaaataccaatgccattcttaacagaaatagaaaaaaacaattctaaaatgattatggagccacaaaagacccagaatagccaatgctatcctaagcaaaaagaacaaaacttggaggaatcacattacctgacttcaaattatactacagagctatagtaaccaaagtgggatgatactggaatgaaacagatacatagaccagtggaacagaatagagaacccagaaataaatccatacatctacagtaaactcatttttgacaaaggtgcaaagaacatacatcggggaaaggacactttgttcaataaatggtgctgggaaaactgtatatccgtttgcagaagaatgaaactagacccctatctctcatgacataaaaaatcaaatcactaagacctcaaactatgaaactattaaaagaaaatattggggaaactctccagaacattgaagtgggcaaagatttcttgagtaataccccacaagcacaggcaaccaaagcaaaaatgaacaaatgggatcacatcaagttaaaaagcttctccacaacaaaggaaacaatcaacaaagagacaatcccattgaatgaaccccattctgtgggttgtctctttgcaaactatctgtctgacaaaggactaataactagaatatataagaagctcaaataactctataggaaaaagtctaataatctgatttaaaatgggcaaaagatctggatagatatttataaaggaaagacatataaatggcaaacaggtttatgaagaggtgctcaacataattgatcatcagataaatgcagatcaaaactacaatgagatattatctcaccccagttaaagtggattttatccaaaagacaggcaataacaaatgcttttgaggatgtgaagaaaagggaacccttgtacactgttggtaggaatgtaaattagtacaactactatggagaacagtttggcgtttcctcagaaaactaaaaatagagctattatacaatccagcaatcacgctcctaagtatgttatctaaaagaaaggaaatatataatgaagcgatatctgcactctcatgtttatcgaagcactacccactatagccaagatttggaagcaacccaggtgtccgtcaacacataaatggataaagaaaacgtggtacatatacacaatggagtactattcagccataaaaaagaatgagatcctgtcatttgcaacaacatggatggaacttaaggtcattatgttaggtgaaataagccaggcacagaaagacaaatatcacatgttctcacttatatgtggaatctaaaaattcaaacaattgaacttacggagatagcaaatagaagggtggttactagaggctaggaagggtagttgggggtagaggggagggaactggggatggttaatgggtataaaaaacagaaagaatgagtaaggcctagtatttgctagcacaacaggtgacaatagtaaaaaataatgtaattgtacattttaaaatagctaaaagaatataattggattgtttgtaacaaaaaggataatgcttgaggtgatggataccccatttaccctgatgtaattattacacattgcatgtctgtatcaaaatatctcatatacccaataaatatatatacttacatgtatttcatatatacttatatatattcataaatatatgcttatatttatatacatataaatatacatataagtatatataaatacaaatatataaaaatgtataatatataaaataagtatatataaatatatatatctactatgtacccacaaaatttaaaaattaaaattaaatttaaaaaatctgtaggtatctttcttttctgagacagggtctcactttgtcacccagtctggagtgtaatggcaccgtcttggcccactgcagccttgaactcccaggctcaaatgatcctcctgcctcaggctcccaagtagtgaggactacaggcacgtcacaccacacccagctaataaaaaatctatagttgttggtgaaagaagtcagacacaagagtacatactgtataattctattgatatgaacttttagaacattgatatgaataggcaaaactaacctatagtgacagaaattagatgggtggttgcctggggtgaaagggaggggaaattgattgcaagtaggcatgaggaaactttctagggtaatggaaatattctgtatcaataactgattggggcagtgattacacagatatatacatttgttaaaactcctcaaagtatgtacttaaagtatgtgcattttgcggtatgcaaatacacctcagtacctcagtaaagttaattaagaagactttatctttttgtgtgtgtttttaaatgtttttttctttttcttttctttttgggaagactttatctttttttttttttttttttttgagacggagtctcgctctgttgccaggctggagtgcagtggcaataacctcggctcactgcaacctctgcctcctgggttcaggcgattctcctgcctcagccacccaagtagctgggactacaggcgcatgccaccacgcccagctgatttttgtgtttttagtagtgacagggtttcaccatgttggccagtatgatctcagtctcgacctcatgatccacctgcctcagcctcccaaagtgctgggattacaggcgtgagccaccatgccaggctgactttatcttttaataaataatttatttaacttgatgcgtaacttttaaatatttagacttatcacatgtgggccctactgtatttccaccctgggccccaaggataatgccttggtttcttgcaggagtaggtaaatgacagatgctggtgccatttacagagatgaggaaagcccaggaggattaggcttcgtcggggcaaggctggtattcagctggtgcattccaggagtgcaatactgattaaaaaaaaaatacctctgctgctctgagccttcttgccaccaagctacctggccctcaccctgggatcctcagatcctcccactctccagcaactaaatggttaatacctggcacatcactggcacagtaatgggtcttcaggatgctgatccaaatccaggggaacttgctagtgcctgtaaccctcaatattttaaatgtcacctctgatagaattggggaaggaagcatgtgagtcaaaggtttatggctagaagttgaaaggggaggtctgagctggagatggagcttgttgactcttgttgcctgcggaatcaagtccaaactcccttaggttggccctgcagttcccttaggttatcattcagcttccacgtgactccctccagctccctgccaggatccctgatcactctgtgttccaggacccactattccctctacctggaatgccctttcatgtcttctccactggccaccctcctttttgtccttcagggccatctcgcatatctctgcctcctgaggcctcccaccctgttttccatggctcctccaaacagaggacagcacgctgccttgtgcatctctgtttagatccctgctttctgcactaggctgtgaactcctcccggtcagggacaggggctggtggctctctgggccaagcaaggccctggcatggagcagttctagtaaatcttaaaggactagatggtgaggcagcatcctgactggatttaccacagccccaccctcactccatgacttctgtgcatgtggaagtcacaaatttagacagactaaacttggtcttcttgaaagaataggctctttaacagcaaagaccactctttccacatcacttcttgctctttcacagcctgagaaaaagcacacaaatgcaaagcaagggtgaccctggtcaggcagaatggaatttcagcctggagtcttgtgagctgagtgacctcagagaagttgcttcacttttctgagcctcagatttctcaggtgagagaatggagataacagtacctgcttcacgaggtggatgtgaggactgaatgaaataatgtgtataaaagtgtgtcagggagaggggagagggagaatgagggttattgtttaataggtacagaggttctgttatattttatatgataaaaatattctagagatgaatagtagtgacagttcgtagcaatgtggatatacttaatcccactgaactgtacacttaaaaaggttacaatgatacattttatgttgtgtatattttaccacaataaaaataaattaatacgctgaatgaaagatcttccctcattgtcccctgcccaaaaagggttcagcatggttccaggtacacagcagatgatccatatgtctgagcttccttcctcctcccttctggatttctctccacctgggttccagggccatggccaagaggcaggatgagggagagcaggacgggtgtcaggagcggaagtgattaaatgttgaacgaggatatggtgtttgtggggtcaaagccaggactgccctctggaaagcccaggcatgaggaggcgagctgcctccccgcctgaaaggaagaaggatgtccgggggtcagggatgacactggtgtttttggccatgagagagaagtaagatatctaaattaaggaggaaaggcaggcgggagttgcaggatgtctatgttggcctacgttgcaaaaataaatgcatctagaaataaatacatacgtaaataaataagtacagatttttttaaagacctcaactccaccttcttgctctatttcaccaaggacaagggcagtataataagctgagaagggaaacaagagattgtagattccggctgctatggggaaattacaaatgaggtctgacgctatctttgtttctttttcattatgaaaaataccttgcctgacatgggcaccctgccaccattgggaaaaccgtgagaatccagtttgttcccaaaacactgccatggggagctgaggtcacaagggaacattgcttttccccaaggcaactgtgaccaaaaataaataaataaatgaataaatgataaataaacaatgtcctggaagaaacactgaagtggatatcagggcacctggcttctggcctggtgtgttcacatcctagctgggtgacctgggacacgtcaccttccctctctgcacttcagctgtttcatctgcagaatgaggggagccaccagatgacctctgagggtgcttccatctcagataatatctctaatactcatgattctaggatatactcttttcaagcccttgaaagaacaatgggagttggtgaggaaagaaaatgctgagctggatggtggaactgactgtctcagagttggaagagaatctgagagatcacccagcccgcccatccatccatccatccatccatccatccatccatccatccatccatccatctgtttatccatctacccactcagtattcctacttgagcctggctctgtgtagggaagtgaggaccaaaaatggatcagactcattccttaccttcctggagctctcaatctagggaacctgggggtgagggaggaaggtaactgagtgattatgttaccaagggctatgaactggggtctgaacatgcagggtatggtaggggtgcagcgtgggtaagacctgctcagcttgaggaggccaggagaggcttccagatgaagaatctactcaataagtagaagctcttcaggtagagaaaaggggaaacagcagaacagcacatgcacaagtgctgctgtatgatgaagtcattccaatcccagggcaccaacgtcctgccttacagcaattcaggtaaacacatcccagggttttggaaatgattagattagagtttctcagacctgggactataaacccctcaaggttaataaataaatatattgtgaggagcctgaaatgtgtctgtgaaaacttctaaatgttatgtttcattttgatggtaatccaaacaaaatcagcatgttctgaattgtctggaaggctaccacctgccatggcatttggacactgactttgtgtttctgatcactttgaagccagatagtgctttacgttcattgttatagcccaaccaaggaaaatagaggtgggcttaatgtaaatgatacttctatgccaagtaaaagtcaaatggggacttggtgcacggtcaaaatgaagactttccaggagtttgaccagagaagcacagtgggagctgcctgcagtctacagtgctctgggtgtgctgtactaaaaaagcctgtgccatagcagtctgccccatactcaggcttcaaatggcaatttaacttcagtaaaacatcttctggcatactaagttagaatgtttgtttgaattttatagggttagtaattgtgtttattttccatttgtcttggtttagagttacagaacagctactagcataaggaatttatactgagttttgtgcttgtaagtatacaagtgatattaaaataatttaagtcggctgggtgtgatggttcacgtctgtaatcccagcactttgggaggccaagctgggcggatcacctgaggtcgggagttcgagactagcctgaccaacatggagaaaccccgtctctattaaaaatacaaaaattagctgggtgtggtggcgcatgtctgtaatcccagctactcggaatgctgaggcaggagaattgcttgaacccaggaggtggaggctgcagtcagccgagatcgcgccattgcactctagcctgggcaacaagagtgaaactccatctcaaaaaaagaaaaaaaaatttaagtcaactttggggtgaatctgtaagaattttgaacaggggcacctccattacttgagtttgagaaacatgctgttagttgcttggttagcaatcctcattgtttatagagtctcttcctttagtttaatgggagtccttcttgctgccaccttaggtcaaaattacctccaaaaagaagaaccataacctattatcatatagctaaaaaaaaaaaaaaaagtgcacagggcctctaggaggtaactgcatcttccagggttaggcacagctgacgtgtactttaccactttccactgccccccaacatacaccctctgctgcagccatgtggttgataccttagcagggttcactaaacaacttgggtaaagttcttaatctctccaagctccagtttactaatctgtaaaacagtcatgctaataatactttacttctcagggttgttgtgaatatcaaatgggtaaatgctgggatacaacaataataattccaggccaggtgaggtggttcctgcctgtaatcccagcactttgggaggccagtgcaggaggctcacttgagcacaggagttcaagacaagcctgggcaacataatgagaccctgtctctacaaaaaaaaaaaaaaaaaatttttttttaattagctaagcattttgtcacatgtttgttgtcctagccactcaggaggccaaggaggaagaattgcttgaacccaggaattcgaggcttcagtgaactatgatcatcctactgcactcagcctgggtgacacagcaagaccatctcttaaaaaaaaaattagaatagtcaccattaacactagacacatttcctactttctttcatttaatcctcccagtaagtctacacagagatagtttatcccaattttgtagctcaagaaacaagtttagagaggtgaagggagtttgtcagataactgaactgagattcaaacctaactctcaaacacgcaaactgcctttgctgtgaccattgcacacacgttactcatgccctgccagcttcacctgtgaaaatattgcctgccttttaagacccttaccggaattaagctctcctcctgcgtgttcattcataccttttgcttggcctcgtggattgcaggaatttaatctagctttgcctgatacagggtcaatttacccaggacacacccttttcagggggtgaaggatgaaggcaaattatcagaggtctgggaacaatcaaatgagtccccacccagtgaagtcacccacatccagagcctcttccctgaaaacccccaccactccttttccttagccagatccccaggggctcacttgggtgtttattaaattgaatgaaatgaatggagccaagagatctggcttccaacccctgtcctgcaaatacggtgtctgatttgaacaagtcattttgcctcactgagtcctacgctctggaaaatgcagtagggggatgtgtggattgggtgcttggtgaagtcctaccaatctttaacattctatgtctcgaaagctgtagcaaaacatcagcatgagacttgtggccagattaagtttcttggaacagggtacttcctgagattattttagtatatgttcatacattgtagcaagaagggggaaaatggacattgaaatcaaaatttaccatagttatgtttgtcttccagggaatgtcatattcgtcagtaaagacaagatttttttttttctaaaaaacaccacagtcagcttttttgtatgtggaaagtgagcctgagaatcctcactcttctttcggtgtaattaaatttttttatgattccattttatctcctttgttagcttatcagctagaatgcattgttttgttttgttttgttttgttttgttttttaatgccctggactagaagtctttattttattttctttttttgtatcattgaaagtttcaatttgttataaaatcataaaaataatccagatccattaaacatcagaataatatgtcaacatgtaacatacattaagtataagtataggttaattaactttaggctgattggtacatacatccaaagctttgagttgtcttcctcagagtcatatgattaaacacagtggctctagaagccactgaagtcaagacaaggagacctaaatgggctgtgatctgaagccccacaccactgcatttcttatttctatgtgtttgcttttttaaagaacaacaacaaaaattccaaagagcataatgcactaacattcaataatgtcaattttacagatgaaaaaattgaaatttagaaaaggcaaagactcacctccttgcctaggtcatgaccagctagtggtacctacatgtgtagccatgtatgtttgctttcccctttaacctttttgcctagcccaaatgaattaccctagattcacattcattttattattgacaagtagtcacgttctgtaagagatcctgatggttgtcctctataacttttccttgaaatatagtcatgtactgcgtaatgtttctgttactgacagaccacatatgtgatgatactcctaaaatattataaaacctaccatattttaattgtaccttttctatgtgtagatgtgcttagataaataaattcttacattgtggtaaaattacctgcagtattcagtacagtaacatgctgtacaggtttgcaccctaggaacaataggctattccatctagcataagggtatagtaggccataccatgtaggtttgtgtaagtgtactttattatatttgtgtgcctaattctctcttttattttattttattttattattatcatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatgcctgcatagtattccatggtgtatatgtgccacattttcttaatccagtctatcattgttggacatttggcttggttccaactctttgctattgtgaatagtgccacaataaacatacgtgtgcatgtgtctttatagcagcatgatttatagtcctttgggtatatacccagtaatgggatggctgggtcaaatggtatttctacttctagatccctgaggtatcgccacattgacttccacaagggttgaactagtttgcagtcccaccaacagtgtaaaagtgttcctatttctccacatcctctctagcaccggttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagttttattagatcccatttttgaattttgacgtttgttgccattgcttttggtgttttagacatggaatccttgcccatgcctatgtcctgaatggtattgcttaggttttcttctagggttgttatggttttaggtctaacatttaagtctttaatccatcttgaattaatttttgtataaggtgtaaggaagggatccagtttcagctttctacatatggctagccagttttcccggcaccatttattaaacagggaatcctttccccatttcttgtttttgtcaggtttgtcaaagatcagatagttgtagatatgcggcattatttctgagggctctgttctgctccattgatctatatctctgttttggtaccagtaccatgctgttttggttactgtagccttgtagtacagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttccacattgattttgtatcctgagactttgctgaagttgcttatcagcttaaggagattttgggctgagacaatggggttttctagatatacaatcatgtcacctgcaaagagggacaatttgacttcctcttttcctaattgaataccctttatttccttctcctgcctgattgccctggccagaacttccaacactatgttgaataggagtggtgagagagggcatccctgtcttgtgccagttttcaaagggagtgcttccagtttttgcccattcagtatgatattggctgtgggtttgtcatagatagatcttattattttgagatatgtcccatcaatacctaatttattgagagtttttagcatgaagagctgttgaattttgtcaaaggccttttctgcatctattgagataatcatatggtttttgtcattggttctttttatatgttggattacatttattgatttgcatatattgaaccagccttgcatcccagggatgaagcccacttgatcatggtggataagctttttgatgtgctgctggattcggtttgccagtattttattgaggatttttgcatcagtgttcatcaaggatattgatctaaaattctctttttttgttgtgtctctgccaggctttggtatcaggatgatgctggcctcatcaaatgagttagggaggattccctctttttctattgattggaatagcttcagaaggaatggtaccagctccttccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgttgaggaatttatccattccttctagattttctagtttatttgcatagaggtgtttgtagtattctctgatggtagtttgtatttctgtgggatcggtggtgatatcccctttatcattttttattgcgtctatttgattcttctctcttttcttctttattagtcttgctagtggtctatcaattttgttgatcctttcaaaaagccagctcctggattcattaattttttgaagggttttttgtgtctctatttccttcagttctgctctgattttagttatttcttgccttctgctagcttttgaatgtgtttgctcttgcttttctaattcttttaattgtgatgttagggtgtcaattttggatctttcctgctttctcttgtgggcatttagtgctataaatttccctctacacactgcttgttttgttattttagtgattactttagggtttagagtatacatgtttaactttcacagtctaggtgacattatgccatttcacatacaatataagaattgtaaaacaggatacttccatttctcttctccagccctttgtgtttatgctttcacacattttatttttgttaaatagttaattttctgttatggaaaagtaaataataagaattctattatatttacccagatagatagcatttctggtgattttttttttttgacaggttctcactctgttgtccagactaaagtacaggctggagtgcagtggggcaatcacagctcactgcagccttgaactcctaggctcaagcaatcctcccacctcagcctccagagtgtataggactacagggatgtgccaccatgcccagctagttttttaaatttttttgtagagacagagtcttgctatgttgctcaggcttgtttcaaactcctgggctcaagtaatcctcctgcctcggcctccaaaagtgctgagattacaggtgtgggccacagcacctggcctctggtgttcttcgttcctctgtatagattcatatttctgtctggtatcattttacttcttgcagaagaactccctttagcatttcttacaaagtttgtctcctgatgatgaatactttagtttttatatgtctgaaaacaactttgttttgatttcttcaaatgatatttccatagaaacatcattttgggtatagaattctaggctcacaagtgtttttttcgttgttgttgtccaatatccttaagatgttgctgcactgtcttctcacttgcattgtttccaacaaaaaaacaatcagttgtcatcatttattcctttgtatgtaatgcctttcttctctggctgccgtcaagatggtcatttgctgcataacacactgcatatacaatggtgattccataagattataatggagctgaaaaatttctgtcaccttgtgaaaactttctatcactttatcctatcaatgatatgatgtcatggccatcataatgttgtagcacaattacttttaaaaaaatgaatttagagtaacctaagtgtacagcgtttataaagcctacagtagtatacagtaatgtcctaggccttcctatttaatcaccactcatttactgactcacctagagcaactttcatttctgcaagctccattcatggtaagtgacctatacaggtataccatttttaaatcttttttttgagacaggatcttgctatgttgcccaggtggtcttgaactcttgagctcaaacaatcctcctgcctgagcttcctgagtagctgggattataggcatgcaccactgtacctggctccattttttaatcttttacatattttatgcggtatttttactataccttttctatgtttagatatatttagatacacaaatatttacctttctattacagttggctacagtattcagtacagtaacatactgtgcagctctatagcctaggagcaatagatatactaagggaggagaccacccctcatattgtcttatgcccaatttctgcctccaaagaaagaaaaaataaaaactaaaaggcagaaatgaaatccacaagcagacagcccagcgccacaccctgggcctggtagttaaagatccacccctgatctaattggttatgttatctacaaattccagacattgtatagaaaagcactgtgaaaatccctatcctattttgttccgatctaattactggtacatgcagcccccagtcacgtaccccctgcttgctcaatcgatcgtgaccctctcacgcgcacccccttggagttgtgagcccttaaaagggacaggaattgctcacttggggagctcggctcttgagacaggagtcttgccaatgcccctggccgaataaaccccttccttctttaactcggtgtctgaggagttttgtctgcggctcgtcctgcttcaataccacgtagtagaggtgtatagtaggctataccatctgggtttgtgtaagtatgctctatatttatgcaacaaggaaatcacctgataacacatttcttagactgtatccccagatttaagtaacgcatgattgtattttctctttatcactgattttaataatttggctgtgatgtgaccggtacagttttcttcatgttccttgtacttggtgtttgttgagatttttgttccatgggtttataattttaatcacatttgaaaaaatttcagctattatttcttcaaatatctcttctgttgccctctttgggggcctcttctttggggactccaattacatgtatattagactgattgtagttgtcttttctttttttgtttttttttgagacagagtcttaccctgttgccaaggctggagcacagtggcatgatttcggctcactgcaacctctgcctcctgggttcaagtgattctcctgtctcagcctccagacgtagctaggattacaggcctgtgccaccatgcccggctaatttttgtaattttggtagagacggggttgtgacatgttggccaggctggtcttgaactcctggcctcaagcaatctacccatcccggcctcccaaagtgctgggattacagacatgagccactgcacccagcccattaataatattcttaattcatttttatttctgtatttcttttttgtatggcttatattgctaaaattttaaattaatgaatcttttcttctgctgggcttaatctgctattaatcccaccaatgtgccggcatagacattgaggttttcatttgtaaaagtttgatttgtatctcttttatgttttccatgtttctatttaacttttgaacatacggaataaagttataataactattttcagatccttctctgataattctaacatctgtgtcaattctgggtcaatttcaattggcagattattctcactttgagtcatggtttcctgcctctttgcatgtctcctaacctttaattagatgtcagacactgtgatttctgccttcttgagtgctggatattttttaatttctataaataatcttcagctttgttttgggatacagtttgatcctcttgggtcttgcctttatgatttttaaggtgggtctagagttgtgctcattctagggataattatgtgcactactgagccaataccttcctgattctccatccagtgaatcatgccctgtgaaacatgtttttccagtctggctggtgggaagagacactattcctggatagcgctgagcatcgtcacctctagtccttcaggatggttctttccctggccttggtagtttcctcacacatgcacactgatcattaatcaactgaaagactcaagtaagaccttctgaagatctctggagttctgtttgggtgaagttctctctcctctctgtatggtgccctgtgaattattgttgcatgttactactgatgaataaggaagagtatttattaacatgtattgagcagttacaatttctgaatgaggaaactaagctaagagaagttaattaatttgtcaaaggtcattacgagagaggcggtctgtctctaaacacccacatctttaatcattaaactgtactgccttatcatgtatttaatgtggcattatttccttatctttaggaaaagctgatattaaatctatggtctggtttataatcaacggcaggttagaatagagaaaatttaatgatttaaaaaactgagcacagagaataagagaatatgagatcaaatgtgtcacttaacgataagtgtcactaacatttatcaagcacttattcagaccaggtgtttttttgaatgctctgcattgcaccacatatttgtattagcctgttcttgctgtaaaggaatacctgagactgggtaatttataaagaaaattggtttatgtagggtcttggctctgcaggcagtacagaaagacggtgttagcatctgctccttgtaagggcctcaggaagccttcaatcatggcagagggtgaaggaggagtaggcatatcacatggcgagagcaggagcaacagaaaggggatgtcctagactcttttaaacaaccagatctcgcatgaactaactgagggagaacacacttatcaccaaggggatggtgctaaaccattcatgaaggatcggtccccgtgatccaatcacctcccactaggccccacctccaacattgggagtcacatttcaacatgcaatttggaagagacagacatcgaaaccacatcactactgtaatcccagaactttgggaggccgaggcaggcggatcacctgaggtcagggcggatcacctgaggtcaggagttcgagaccagcctggccaacatggagaaaccccgtctctactaataatacaaaaatttgccaggcacagtggctcacgcctgtaatcccagcactttcggaggccaaagtgggtggatcacaaggtcaagagatcgagaccatcctggcctacatgatgaaaccccgtctctactaaaaaatacaaaaattagccgggcttggtggcgtgcgcctgtaatcccagctactcgggaggctgaggcaggagaattgcttgaaccccggaggcagaggttgcagtgagcagagatcacgccactgctttccagcctggcgacaaagcgagactttgtctcaaaagaaaaaaaaaaattagctgggcatggtggcacatgcctgtaatcccagctacttgagaggctgaggcaggagaatcacttgaacccagaaggtggaggttgcagtgagccaagatcacaccactgcactccagcctgagcaacaagagtgaaagtctgtctcaaaaaaaaaaaaaaaatgcagctgtgataagtgctgtgacacaagaaacagcaggagatggtaggaatgcagagggaggcacctaatccaattggaatagtcaagacgtggcaaaatgctccaaaggaagagattcctgaactgaatgttaaaagacatgggaagttaggcactgggagaaggctagaggcaaaagagatcatggagctcaaagtgcaaagtagcgagaaagtctggagtggtataaactaagaaaagaaaaataatgtgatcacacacatgtgctgcagtgttgaaatactttatggtgcagccagcaatgaattggctgtcatagccaattgtgtttatgtcaatagtttgaaatcagccatggtaggagtatttacaccatggaaatcagcaaagctacaaatgagggactttttccctcagagatttaccagggtagcaggacgagctgcagacaaaactcctgacaccgagttaaagaaggaagtggtttattcggccaggaacattgggaaagactcctgtctcaagagccgagctccccaagtgagcaattcctgtcccttttaagggctcacaactctaaggggatccgcgtgagagggtcgtgatcgattgagcgagcagggggtacatgacaggggctgcatgcaccagtggtcagagtgaaacagaacagaccaggaagtttcacaatgtcttttctatacaatatctggaatctatagataacataaccggttaggtcaggtgtcgatctttaactaccaggcttaggtcaggcaggcccaggcctggtttcgggtctggttcctaggcgccgggctacctgccttttgtttcgcttttcttttcttttctgagtataaaacaatataaaacaatatgagagggtctgtgcctcttctttcaccagcaccgctggtcccaggctataaacacctgaagatgacttttttttgttttgttttgttttgagcccgagtcttgctctgttgcccaggctggagtgcagtggggtgatcttggctcactgcaacctccacctcccgggttcaggcaattctcctgcctcagcctcatgagtagctgggactacaggcgcacgcctccacggccggctaattttttgtattttattttttagtagagacggggtttcactgtgttgcccaggctggtgtgtagcttctgagctcaggcgatctgcctgcctctgcctcccaaaatgctggtattacgggtatgagccacggcacccagcccaagatgacgtttatatcttctcctgatgttgtctcacagaggctaaaatatctttattttaaaatttctcttgcagattgtttctggccttgaattatttttccttgaaatttcattcactccacaaacctatctacatggtgccatgtttgtggtgggtgctgcagatatgaccccaccaggaagtcatggcacctcctgtcatatactcccaggaacccggggccagctttcttgttctccatctgaactttgtagggcatttcaccaggaactttaaagtagccagatggctatcaggaaagaaacgttccttagcctgtggcattgtgttttttttttaaattgaataatgcattaacattgatggagtcacagctggctccagggtgcctcccgtccggctcccacaggaggttacaataggagttggcaaactttccaaagtactccatcaagtccatgtgtaactattctcccattcaaattttcttctccctgcagtggtaggttcagaccatcttcaaacatcaacaattgttttcaagtagccactaagctaagctaagctgactaagaagacatacttgtccgtgagggaagccaggacccattcataaataaaaataaaaacaaaaataaataagaatagtacttagaaaatcataaaagtgggaggaactatttaatgcctccattctgtgtgttgtattttcactttcttgatggtgtcctttgaggcacgtaagtttttaattttgataatgtccagtttattttttcttttgttttaactttttgtgtcatatctatgaaatacatatatatatagctttatacaattgctttttcaatcatttaatgagggagaagaaatatactatcttttataattacataattacctttattggtactctttgctttttcatttgaattttaattaccatatagggtcagttgctttcagtttgaagaactttctttagcatgtcttataaggcaggtctactagcaaaagattatctcatcttttgttcatctaggaatgtctttattccaccttcatttctgaaagacagttttgctggatataacttcctggttgacatatttttttaattttagcactttgaatatatcatccactgttttctaactttttttttttttttttttttttttgagacagggtctcactctgtgacccagactggagtgcagtggtatgatcacagctcactgcagcctcaacatcccaagctcaagcaatcctctcacctcaggctctggaatagctgggaccacaggttgcaccatcacacctggctaattttttaaaattttcataaagacaaggtctcactacgtttcccagggtgatcttgaactcctgggctcaagtgaccctcctgccaaagcctcccaaaatgctgggattacaggtgtgagccaccatgcctggcctgttatttcttgtaaggagtcatctgctcatcttactgaggttctcttatatgtgataagtcatttgttcttgctgctctcaaaattaatctgtgtctttcagcatttttgctatgatatataagtgtgcacctctttgtttttatcctacctggaattcactgagctatgtgaatatgaaaatcaatatttttcatttaatttgggaagttttcagctattatttcttcaaaccttttttctgttcctctcttctctgtttttgtttttttttgttgttgttgcttgtttgtttgtttgtttgttttgagttggagtcttgctctgttacccaggcaggagtgcagtggcacgatctcagctcactgcaacctctgcctcctgggttcaagcaattctcctgcctcagcctcctgagtagctgggactacaggcatgcgccaccatgcctggctaatttttgcatttttagtagagacagggtttcaccatgttggccaggctggccttgaactcctgatctcaagtgatccgcccacctcagcctcccaaagtgctgggattacaggtgtgagccaccgcacctggccatcttctgcttttgaaactaccatcacttaatgcacttaatgacaacccacattctctgaggctgttcattttttttaattcttctttctctctgttcttcagattgcataatctctattgatctatcttcaagtttgctgattctctcttctgccagtttagacctactgttgagctactctagtgaatttttcattttagttattatatttttcacttccagaacttccattttgttatttttttctatctccttattgacatttttcattggatgcaacattatcattgtcacgcgcatccgtgtgaagagaccaccaaacaggatttgtgtgagtaacagggctgtttatttcacctgggtgcaggtggcttgagtccaaaaacagtcagcgaagggagataggggtggggccgttttataggatttgggtgggtagtggaaaattacagtcaaagggggttgctctcttgtgggcaagggtgggggtcacaaggtgctcagtgggggagcttctgagccaggagaaggaatttcacaaggttaatcgctcagttaaggtggggcagaaacaaatcacaatggtggaatgtcatcagtttaggcaggaactagccattttcacttcttttgtgattcttcacttgcttcaggccatctggatgtatacatgcaggtcacaggggatatgatggcttagcttgggctcagaggcctgacaatcatcatatctttctttactactttaagcatgtttatttttctttgagatctttgaacactgaatgcatgaacataatggttgctttgaagtctttattaaatctgacatcagagccctctcacaggcagctcctgttgcctaaattttccctgtgggctgatcacacttttctgtttctctgcatgtctcataattttttggtgaaaactagatgctttcagttacatactgctgtaggcactgatacccttctccctctgtggggcttgtttttgttgtttgcttagtgatttggctggaatattttagtgaagtctaattcccccacagtgtgaagcctctagtgccactcctcaaagaatacagacttaggtctgtgcccagttacccttgaataacaggggttttagcaagactctgtctctttccctgacctgttaaactgtctgcctcatttggtatcacacccagcttttaggctctaccagttgctggctgattgctcacttatgccctgaagcataaatggtgctacagtctgatttaatgaaatccagatctctgcaggagtagattttgaagctagtctttgaggtttgttcaaaccccaggaagtctctttttgctgtttccctgtttctctcaaataaaatagcaggcctatggcttagcttgttgctatcaagaattaccagcctcctcttaattgcttcccccccaaatttttgttgttgtcaagagcacgctagacttgaacttctcacactttgtttcaagtaaagccagtccctttggaaagagcttcagagatttctgttcttatagactgcctcttctcctgggcaaaatctctaagccatggcttcagactcttggtggaggtgatagcctctcatcttctaggcttgctgcttcctgaatggaacctcctctctatcagcaaggtggagtgagagtgatcagggtcccagtattctcagtctgctgcatctgtggaggggcatctttttatgaatgagaactgagtggaagaagaaagcccctgacctcttagctgcacttgccaggaatttagcttctgcaactcagagctggaaatgatgaaaaatgctggtgacctgttcctcatggtaatatactgtattcctttacttggagcagagggaagtggaagccccatcttcctggccacaccttctggatggagcttctgtcactctgagttgaaggcagggcaaggagcaatgagaaatggagggggtcatggctcaagtgccacaaattcttattattattactgagatttagtagattttcttgaataagcatttcttcgtttgttgtgtgtcttgggacaattcacagagactttattttcttttccttttctttttcattgttttaaatttaaaattatagtgaaaatagagacagagtctcactatgttgcccaggctggtctcaaactcctgggctcaagtgatcctcccacctcagcttcccaaagttctgggattacaggcatgagccaccatgcctggccaatttgcggagactttaaatgattgcttaataatttttaccagttaaggttgtttcattggggaatgggtctgtgggggctccttactccactattccagaagcaggacctctttcatttaacatgtaaaatgtactttccacccttttctactctcttctttttcctaggaagctaaaatgtatgggctacatcaataaggctccatgccttcaggcttccagttgccaataaatgccccagtaggagaccggagggaggaaggaggatgagatcagagtgtttattcccttggctcccttcagttgtgcagccttctttgcatgactgtctccttctcatttccagttgctattcccttccctgtctcttctggctagaagtagttacttcactatcccttgcgactcccctacacattgcttatacctttatgtaaggggaatggctgcgctttagtcaggaataggccaaggcagccttttggcacagcatgactcaaacaggtttggagcgcaggcacacaactctgcacgttatgtagccacaccacatgaggcgctttaggtaaccactcacgtgtgctcgtgcttgactgagccactattgtttgtaaaaggtataactacccagctgacactgtacatatggcttttgcccctggcttgtgcccacagctcacaccgaggttggtgcccaagctcgcttgcatccagagagacagagaaaatgctatgtgaaaacttgctatgattccttgagtgttctttcagctggccaccacttgtccactgactcccctcagacctcagttagaacatgacaattggcatcacgaacacaatcccagagtgagtgagtctttggtccccactgagtccaggttggccatgtgaccgcaacatggatggtggtacccagtggcagctgtgctgctcaaatgggctctagtggaaacctgggcagtggtagataggccccctgcgagcatggagaaggcgctgaagcatctggaagcacagagcactgagaaggggtgagcctttccgacagagtcgaatgggtgtttttgactgcactatgagaggtacacacccagtccctgagggatgcagcagaggtaagggcctcccaggtgccagaaggcctggttacgcagctcagaagtgttagaagctgccatgaatagggacctccaggcataggcggagtgcctggaggcctggccacagagcttggaaaaggaattagaagctgctgtgaatgctatcctgggtccgtcatcttggccagagagactcccacttggtctgggtttgcaccataaagaaggagaagatgccccactcgcagggggcccccccatgggaggaaagggggtcccactgagtgacacgcttacagatgtgggtagatttgattttggctggggttgactgagagaaaattaataagcagcccaatgaagtactattaactttgtggagacagttgtctccagagcagcaattccagaaaatgtccaaggggaagaaggacactgctgcgtgacctggtcccacctgggtgcttcagctcaaagactatgtgctgcagccagacaggggtgtaaagccttttgtgtttgatgagggagctggccgaggtgcccggcttgggggaacaccggatgacaggaggccacatgtgaaattagcaattcactggtcccccaccaacgtacagcaagtgctggtgctggtagacaccagtgcagatgtattctgcgggtggatgttttacacagcttggcagctatgccatcaatcgtggatttgatggactgtttgatgatagaactggaaccgtaccactgtgtggtggacttggctaatgcattcttttccaaaaagccaggaacagcttaccttcacgggaaggcgactgtgggctttcacagtgctgccggagggctatatgcagagcctcaccatatgtcatggtcttgttaatgatattatgctaacctctgattctcttgcagatttagaagtggcaatgctccccttgcctagaattaagatgatgaggctgagacagcctttctggcagccaagcaggctattcagcaggcacaggccctactggtaattaaccaggggcacctatttaaacttgatgtgcatgtgaccacagatagttttgtctgggcctatagcagcacatggagagcttgagaacgccagtaggcttttcatcccaactatggaaaggagttgagctccagtattcattgatagagaagtagtcagtaactgcatatgctgcccgtcaggtttatgagagcatggtaggacaggctacagtcattgtgcagacaacttacccaatagcggaatgagtgtgttcatggataacaaccccctggatggggaaagcagttagtaactgcatatgctgcccttcgggctcatgagagcatggcaggatggggacgggctacagtcgttgtgtggacaacttacccgagagcgggatggatgagttcatggataacagcctcccaaacggggcggtgcagacatccactttggcaaagtggggtgcctacttggagcagtggcgtacgctgagcacaagtcccttagcagtagagttgcaagagatcttgggacctgtagtcctaatgcaagacaaggccatggggcctgaggcacctttagaccctgaaccttcaccatttaaggaagggcgtccccctattcccaatggggtatgatacacagatgggtatgatacacagatgggtccccccatacccagtggggtatgatactgctgcctggaccactcttgcggtccaacctagtactgacaccatgtgatttgaaactggatgtggacagagtagtccatgggctgaacttagagcagtatggatggtgatcaccaaggaggtgacacctgtgataatctttaccaatagctgggaggtctatcgaggcttaaccttgtggttaactacctggaaaatacagaagtggctagttggccagtgaaccatatggggctaagcaatgtggcaagacctctgggaaatgggtcatcagaaagaggtaactatcatctgtcaggccatatgcctttggccacccctggcaatgatgagacagatgctttggccaaggtctgatggttagagacagcacctacttgagatgtggccttgtggctacactggaaactggggttaaactaatgcaacaggtcaataagtgttggggtctgtccctgcccatgcaagatatttgggaggcttgtcagaaatgcccagcatgtgctcaggcataccctaaatggagaccgctacccagtgttacacagcaagtagtgatacagcgagtgcccttaaccaggtagcaagtagacaagatcaggccccgatggattttgtgccccctgggagtttatgggtctgtggtgacacagggtgtccttacctaccagtggactggactgaatattgtacctaggggtggccttatgtacctgccactgttctccccagatgcccatcccaataatggggaggcactacattctcagtttttgccagtgcaacaagccccctggtggttctaccccttggcaatgactgttcttggagcgggtgtcataactgtagaagcacaagttactgctcttgcagagcacaccgcttgggctctgaatcacacccaagtggctctcctcctgttaacagatgaggttgatcagatcagaaaggtggtgttgcaaaactgaatggccttagacttaatgactgctgtccaaggaggcacctgtgctcttttaggaacacagtgtggtacctttatccctgacaattggcagaacataacagcagccctgcaaggagtctcacgggagattaaggtagtcaggagccttactgacaaccccctgcagggtgggcatccctgggctctagcctatgctgggccctaatagtcaaaagtagcatagctgggatcctagtagtgagctattgctctccgtgtggttgttgtgggttatggattcagggctccagtctctgggcatgtgtccctgcctggaggatggccttggcctagggggtggagtataagggtccagtctctgggcacttgtcccttcctggaggatggccttggcctgggggtggagtataagggtaatggttctgctttagtcaggaataggctgaagtggccttccagcacagcatgactcagcaggtttggagcacaggtgcacaactctgcacgttatgtaaccatgccatgtgaggcacattaggtaaccaggtgtgctcttgcttggctcagagccattattgtctgtaaaaggtgtaactatccagctgatgctatacatacagcttgcgcccaccacttgtacccatggcttgtgcccaagctcacttgtgcccagagagaaaaagccatgtcgaaaatccctatatgattccttgagtgttctttcagctgcccgccactggtccaccaactcccctcagacctcagttagaacatgacactttaaaatcatccctggccaggtgtggtggctcacgcctgtgatcccaacactttgggaggctgaggcaggcagatcacgaggtcaagaggtggatcacaaggtcaagagattgagaccatcctggccaacatggtgaaaccgtgtctctactaaaaatacaaaaattagctgagcatggtggcgcacacctgtagtcccagctactcgggaggatgaggcaggaaaatcgctgaaacccaggaggcagaggttgcagtgagctgagatcgtgccactgcactccagcctagtgacagagctagactccatctcaaagaaaaaaaaatcatccctttgtgaaaaacaaagcaaaacccgaaaaaacgcatccttgaattatcctaattgtgctattttctgttgtgagcctgatcggtacattacccttttcttcttcaagcactctattagatattcttcagaaatctacattaatgtatgaaataagatggacataggttctaatacctgttctggaagctaattattggggaaagttctttagcttctttgagcttcaatttccttatctgtactatggatgtctgatagttgttgtaaggattaaatgagatgatgtgtataaaatgactggcatgttatctgcggtagacccgaatatgctgcactatatccctcttcaaggaggactagttgccctaattgatgagggtgttgccagcagacaaattctagctgtcatctcctttaggatttgccctagttgcttagcgagctgctttacccaaggccttgccgttcttggagcagctcatgtgaggtgactgagcaaggcatgggtataaaagtttggccattttggcccaccatgggaaacactgatgggttatgtatgttccagaggtccccatggattggctgaagctttgtcagacctatatagctttcaggctttccctctgttcagtgtttcttccttctaaggaattggtgccaggaatgacccaaaaatgcaggtggtaagatgggattttaaacctggatcactcaccaccttgttggccataaggaactcatcactggtgatagaaggagcagagacaacacctggcacaaggttgttaaaactcttaccagtggctgggtgcggtggttcacacttgtaatcccagcactttgggaggcctaggcaggtggttcacctgaggtcacaagtttgagaccagcctggccaacatggtgaaatcctttctctactaaaaatacaaaaactaactgggcgtgctggtggtgcatgcctgtaatcccagctactcagggggctgaggcaggagaatcgcttgaacccaggaggcagaagttgcagtgagctgagatcacgcgactgcactccagcctgggcagcagagtgacgctccgtctcaaaagaaaaaaaaccaaaaacctcttacccgtgatgaattagggtttttttagacatggaggggaattcactagctggttcaatgtattcagcatttgggaggtataggagaaactaactgtttctattatggaaatcgagtgactataatggaattgagtgactattgctaaattcatggatatgttagaaaaagacaataaaaagctgcaggcatttaacaggcaatgaaagccaaatgtgaaagcttacaaagaggctttcaattcctacagcaagaaggcagaaaaagctgaagacctgagctgggaattaatacagccatcaagctccagagaaaattaaatgaccacgataggtccaatacgctaaggttagtagaactctggcacttaggatggggacatgtgggtatattttgaactcccagactcctctaaatcctctgagcattcagaagttgtgcccttctcctcttaagagctagcacccccacctccctcgcttgtttgaaggcaatgcagagaactcagaccctcaagataaaatgtgcctccctcatgttgtgccaaacccctatcaactccagtggggatggcaccaggttcaagaggccaaaaaagagacccagagccagcaaatgagacatggggttttactgggggcttacatacaggggagagtccagcagcggcgggctggacaagagaacaggtccagtggtggtgaacaggtccagtggtggtaggctgggcgggagaattgcagccgcttgcaaaaggcctgcagtttctatagcatgttcacttagtaccctccccctaacaacctccacctgacaaccttcatttaaccctaaacccaatgctttgatcccctgtacagcccgtgttccacgggatgcgccagaggctcaaatgttcctcattgacaagaaacgagtctgtggtttggccacttcccaattccctagctcagaacacacattcaggtgtgtttgccatacagggtcattctcagggtaagcttaagttattgctgtcaggtgttcttaccatacacctctggatctgccccacctctgttgctaaccacaaggactacaactagagttaagtcatgggccgggccacagtggctcatgcccataatcccagagctttgggaggcagaggcaggagaattgcttgaggccaggggtttgagaccagcctgcacaacataatgagaccttcatctctgcaaaaaaaataataaataaataaaataaaataaaattacctgagcatggtgatgcacctctgtagccctaactacttgagaggctgaggtggaaggatcccttgagccgtggagtttgaggctgcagtgagctattattgcaccactgcactccagcctgtgtgacagagaaagacctgatctctttaaaaacaaacaaacaaaaaacccagaaatttattctcacacggttctgttggtcagaaatctgaaatcattttcactcagccaaaattaaggtgtcaggccaaggtcatatgtaatgcgtgtgattacatttagggcccacccaggataatctcctcactgcaagatccttaacttaattacacctgcaaagacactgtttccatataaaataacatttacaggtttcaaggattgggatctaacatctttagcggctactagtcaacctactacaggggcaaatctgggttttctctcttgtctcaacaaggaagtgtggtctttggaaaggagtaaggagacagagactttgtttgcacagtgacacaatgaagaagttgtgttttgggtggtaggtatttacttatttatttatttagaaatagagtttcacagcctggcgcggtggttcacgcctgtaatcccagcactttgggaggccaacgtgggtggatcaggaggtcaggaaattgagaccatcctggttaacacggtgaaaccctatctctactaaaaatgcaaaaaattagccgggtgtggtggcgggtgcctgtagtcccagctactcggaaggctgaggcaggagaatggtgtgaacctgggaggcggcgcttgcagtgagccgagatggtgccactgcactccagcctgggtgacagagcgagactccgtctcaaaacaaaacaaaaaaacgaaatggagtttcactctttcacccaggctggagtgaagtcatgccatctcagctcactgcaacttctgcctcctgggttcaagtgattcttatgcctcagcctcccaagtagctgggattacaagtatgcaccaccatgcctggctaatttttgtatttttagtagggacggggtttctctatgttggccaggctggtcttgaacttctgacctcaggtgatctgcccgcctcagcctcccaaagtgctgggattacaggcgtgagccaccacacccgaccagtagttaatattttaaaagaagatttggtttgtcatgtgatgtttcattctgcaggagctgaaggacgcaagagtctccaaatgatgtgtagcttttcaaagatctcgtgcttcctcttccatgatgagggagttctacaaggaggtagaagtttaaagagaccaagaaaatggttagggagaagagggagggagaccaaagagaggcagagagagagaaaatgcaattggtcaaatgtttcctgggactgatctgcattcacacaccctcccagttgatctaggcattgtgtttattcttcccaggtgatggagaggtgttcctgcgggtgactgtaattacaggctataggaggtggggtacagatagtcagagattgttaaaatcagctctgtccattcagcagagaggatagttcacacatgctaatatttcatgcaccagagacttcactagatgctggtgcttaagctaggctgtgtaggctgagaagtattcagacaagttatgagaagagtgttcaggcagggccagtggcagaggtaaggaaaatcagccaggcgcggtggctcacacctgtaatcacaacactttgggaggcctgaggtcaggagttcgagaccagcctggccaacatggcaaaaccgtctttactaaaaatacaaaaattagccaggcaccgtgggggggcgcctgtaatcccagctacttgggaggctgaggcaggggaattgcttgagccctggaggcagaggttgcagtgagctgagaacacaccactgcactccagcctgggctacagagtgagactccgtttcaaaaaagaagtaaggaatctcagaggtactaggactcttggagaaagacatttctagagcatagcactagtggggggcagtggattaatctaccctttcagcctgataatctagccccaagcactattagacacattacttaaggaagcagttaataacttcacacagcatttcaacttggtgggtcagtcctaagtgtgaattttgtttttcttcactgactctaacacagttattgtctttttggtccaatattatcaaatttcattaccttgttaatcgccagattttttttttcatttttaaataagtgaagcatatgtggaattctaaagaactcagctcatttatttcctttgaaaaatcttattcctgcaccaataaacatcattataatgcacccagccaatttcatttcagaacaagttggtacattactcaagtattgatcacttgctttgtcatcttatcagttaattattgttatggttacaagttcctcagacttgaggcttggtgatattttctctttcttctggatcagcacatggagtacagcacacagcccataataggccattaataagtgttaattgatatttcatacctgagttgggccaaagcatcaaattctttatgtcaaggtacagttttaacctaaatgtaataataatagtataataagccttaactttagcctcaaagtcattaaaaatctaactttttggaacactcatttttagcttattatctttttttgtaacaaatgccattgtcagaggagtgtgaaccagagcaactccatcttaaataggggctgggtaaaataaagctgaagcctactgggctgcattcccagactgttaggcattctaagtcacagaatgagataggaggtcggcacaaaatacaggtcataaagaccttgctaataaaacgggttgccagtaaagaagccagccaaaacccatgaaaaccaagatggcgacaagagtaacctctggtcgtcctcactgctacactcccaacagcgctgtcacagtttataaatgccattggcaacgtcaagaagttaccctatatggtctaaaaagggaaggtatgaataatccactccttgtttagcatataagcaaaaaataaccataaaaatggacaaccagcagcccttggggcttctctgtctataaagtagccattcgttattcctttactttcctagtaaacttgcttttactttataaactcaccctgaattatttcttgcttgagatccaagaaccctctcttggggtctggattgggaccccttccctgtaacacaatgactcattttgtttataatataggcaaaattatagaatgctggaattgtgaggaattttagggataatctagcctaaagctctcattttataccacgggaaactgaggaccaaagacataaagtaaaagttgggtgtggtgggtcagatctataatctgggcttgaggccacgagaccagcctaggcaagagaacctgtctcttgaagaattttttttttaattttaattagccagacctggtagcatgactgcagtgccagctacttgggaggctgaggtagggggatcacttgagatcagtagatcgaggctgcagtgagctgcgatcatgccactgcactccagcctgggcgacagaggagactctgactcaaaaaaaaagaagtgacgtgcccagggtcatacaatggggatctgagctggaggaaggggcaggtcagctgagcagctgaccaagaccccagtttataacagatgccaaaacatccctgggtaccaaagtattgctagaaatttaacaaggtgggcaaaattgtgtatatcagaactcttctgggacagagtactctagttgttgtaaggaatactgtgatgaataatgaaagatgagaatgaacaacaatgaatgttcactcagcagtttcctaaggagatggggttggacaaacaaacggcttttgttttgcagaatggagtatgcaagtttgagtccaggctgaattgccctggaaaataaaggtgagggttagtactgctacctctggtgctccttccagcccttccccttcatggcactcagctgtcctctaactcatggttgaacaacagttaaagaaagctgatttgatgtaagtgtgctagtgtctcttagctacaccttttatagctgagcctaaactctgagaagctggggctaggacttgtaaaccacactttgcctttgccagccttgccccgttagactctgctgtaaagggccctagagaaagctggaacactggcggagggagagggaatctgttgcttctgtttgcctcctgtcgtgtcagcaacccccagcaaaggccattcaccttgacaacagcagttggtgccagtttccagatttaggaaggctctctgagaacatgcccagatgcaaagcttctaggttttgacaaccctatcctcttccctttattcccccacccctggggggaggtagctgcttatagtaattctctctgttatctccttactctcttttttcagtcctctagtgcctatttaactaattccctatattacattctctctgttaaagtgtctggtgtgaattctgtttctgaagggactcaactgctgaaaggtgccattaacttgctcagggttcctccaagtcaatccaatcctaaatgggaataataatagctatcatttatttgaggacctactatgtgctcagcacttaaataaattctgtcatttaatcctcaaaacaactctggggtgtattacacctattttaacagatgacaaacaggctcagagaggtttaaataggttatttatagttaccaagcttgttagtgatagagtgggaattcaaacttgcatttttctgactgccaaacctatgctattttttagtttaatttttaaatatactttctgatatggtttggctgtgtccccctccaaatctcaccttgacttgtaatagtctccacatatcaaaggtggggccaggtggagataatttaatcatgggggcggtttctcccatactgttcttgtggtagtaagtgtcccaagatctggtggtttcataaatgggagttcccctgcacaagccctcttgcctgccgccatgttagacgggtctttgctcctcctttgccatccgctgtgattatgaggcctccccagccatgtgaaactgagtccgttaaacctctttttctttataaattacccagtctccagtatgtctttattagcaacatgagaacagaccaatacactttttttattagaagagtattttatattctttataataagttgaacaataaaaagttaacatataaaatacatgttaatttctcccttcttccctgtaataccttcaccactcccgtatcaccattccccagcccacgccccagttaaccagtattaacaccatattgtgtaacttgtcacactttttttcactaatacaaaaatataagcatacaaaggccttatttttccttaatttaatttaatttattttatttcttttagagaccaggtcttgctatgttcccaggctggcttcaaactcccaggctcaagggatccttctaccttagccttcccaacagcagaaactacaggcatgcaacaccacacctggctgttttctctttcgtaaaacaaaaacaagggcgtgcaatatacattactgtgcaacctgctttttcacgtaaagagtatttcattgtcattcctcctggttggtactgtaactggaaccacgttcggctgcttgctgctcaaaagccaaacaggagagacgagggttggtgggaggaaaagcaggtttaactggagagccaacaaactgagatacgaaagtgctagtttataaatttttataatttaccatagggtttttaaagagaagtttggtgtgggagacatagaggagtgcagcagagtgcagctctgggcctttgttctgatggctatcttgggtcattgtctctctggaggtctgcttggcattatcctgactttggcctgatggtggtgacctaattgttctgactccccctaagtgggaggattccttacggaggattccacaggggcttcctgcatggtttctttccagattagcctctggaattttttttttttgagacagagtctcactgtgtcacccaggctggagtgcaacggcatggtctctgctcactgcaacctccgcctcctgaattcaagcaattctcctgcctcagaagcctacaggcgcccgccaccacactcggctaatttttgtatttttagtagagacagggtttcgctatgttggccaggctggtcttgaacgcctgcccttgtgatccgcccgcctcggcctctcaaagtgctgggattacaggcgtgagccaccgcgcccagccagcttctggaatttcttaagcaacagcataattagataagcatacattgccagagagaagtgtctacacaggaaatgaatgactaggtaagaggggagggaaggaagaaaaagaaaatgtgtgatttttaaaactgaggtccttggttacagtacatatagatttaactggtttcataaatagctagatcatattccataatagaatataaatatatacaaatatattcaatcatttatctgctcttggaccttcaggttatttccttttttttttttttgccactgtaagcagtgttcccataaacataaactttctttttttttttttttttttttttgcggcagggtctctgtcacccaagctgtagtgcagtggagcgatctaggtatctaggttcactacagcctccgcctcctggactcaagagatcctcctacctcaacctcctgtgtagctggtactaccggtacacaccaccacacttggctaattttttaaaatttttattttttgtagagatgagatctcactgtgctgcccaggctggtctcgaactcctggactcagagtgatcccctggactcggcctcccaaagtgctgggattataggcatgagccaccttgcctggcctcataaacatttttgtacatatatttttaggtaatgatacttttgttccaacaaaatagtctaaaagagcgatgcatgggccaaaaagtatatacatttaaaaattttcttccagaatactttccaaacagattatggtgcagtgtaataccttcaccagcaatgtgtaatgatgtccatttccttactttgtaatgatggagctcaggacatgctacccaaaaacatcagaagcaggaaaatcactcacaccttcctcctgccctattttcctgaagcaagtcctgaaacctcggagggctattctgaccttcccctgcagcaggtcataagaccctcattcgagaagtgccctccctgcacccagaggaaaggagcctccttatctctgaagacaaagggtcatggaggagaatctgaacaagcagaccttgctaagttcccctcaatttattaccattagatcatacttttttatataaccaaacttctccacagctatccacttcttcatcaaaactagcattaaaaacacataggtttactaacttctttgatgggtacatgggtttacccatttcttcagatttttctgaatgctcctatgtcacataaaatttatattcaatgaatgtatatgcttttctcttattaatctgtctactgttttagagacctcggccatgaacctaagatgggaaggaaaaacacttcttttcccttacattgacaagagctggatgttctcaatatttcaatttgtgtcagacatattattgaaaaactgtatcctattttttaaaaattttcatttctctgataactagtgaatttgagttgcttttcatatgttcattgtccatctgcatttcctcttctgtgcattgcccgttcaaaccatttacctttttctctgtgggttgtttgtgttgtgtagattccacattgcaacttaagtggtcgatgaaagaatgagaactacaactcagtcttccaactcccagtccaggaatttctctactctggcctcttcctgaactataatgtgtttttgttgttgtgctatatgttttattgtatctatgcctactatgctataatgtaaatataactagtttgttgaacaagctagagtcatactgttgcaggcaggaaaccttaattttttcccaccagtttctctaaaattcaatttgccaaataggtcttcccttgccacttgatgaaatcttgggaagatctcataggggtgtttttgttgttggtgtttttcttttggtcctcagagaatgaaagttctctagtctcttgtaagatgtttccttcccattttaggtttatgattgaggcctctaaaacagaagacagattaacaagaaaaaagcataacacatttaggttgggcacagtggttcatgcctgtaatcccaacactctgggaggccgaggtgggcagatctcttgaggtcaggagttcgagaccagcctggccaacatggtgaaaccctgtctctactaaaaatacaaaaattagctgggcgtgatagcatgcacctgtaatcccagctacttgggaggctgaggcaggagaattgcttgagcctggcagaggcagaggttgtagtgagccgagaacacgccagtgcactccagcctgggtgacagagcaagactctgtcaggaaaggaaaggagaggagaggagaggggaggggagggggcatacagacatttattgaatataaattttatgtgacacaggagccttcataaggaactgaagacccaaagaaattggtaaaccgtgtatttttttatgctggttttgacaaagaagtggatagctgtggagaagtgttattatattaaaaagtatgatctaatggtaatcaactgagggaaacttagtttgccaggtgaagtggctcatgcctataatcctagcacttgggaggacaaggtggaaagattgctttagcccaagaatttaagaccagcctgggtaacacagggagacctggtccctaaaaaaattttaaaaattagccatgtgtggtggctcatgactgtgttccagctgctcaggaagctgaagtgggaggattgcttgagcccagaaagaaagaaaaaaaaaaaaaaaaaaaaagcaggctggccatggtggctcacgcctgtaatcgcagcactttggtaggctgaggcaggtgaatcccctgaggtcaggagttcgagaccagcctggccaacattatgaaaccctgtctctactaaaatagtacaaaaaaaaatagttgggtgtgatggcgggtgcctgtaatcccagctacttgggagactgaggcaggagaatcacttgaacccgggaggcagaggttgcattgagctgagattgcactattgcactccagcctgggcaacaggagcgaaactccacctcagattaaaaaaaaaatagcagagtataatctgtgtgatcacctagccctgatctagccctgtgtgatatcagatctccaagcacatggaagttgatttgtcccctcccgaaactgaaaggaagcctgcagcggtagagcaggtgtacaaggcttatttcttgctccttcacctcctccctattccatagcagctgtttctgacaccctccagacagggtggattcaggttttgtgggggctgaagcttccacaatttgggcagcctcctttatattgggcagaattctaagattattccccgctccctcaatgacctttgcacttgtataatctcccctttgagtgtaggtggaacctgtgaatctggtgacatcactgttgtcattctgttaagtggcaagagagattatcttgggtgggcctgacctaatcagggaagccctttaaaagaagataattttcagctgggtgcggtggctcatgcctgtaatcccagcagtttgggaggctgaggtgggcagatcatgaggtcaggagatggagaccatcctggcaaacacgtgaaaccccgtctctactaaaaatacaaaaaaaaaaaaaaaatttagccgggcgtggtggcaggtgcctgtagtcccagctactcgggaggctgaggcagcagaatggcatgaacctgggaggcggagcttgcagtgagccgagatcgcgccactgcactccagcctgggcaacagagcaagactctgtctcaaaaaaacaaaacaaacaaacaaaaaagaagataattttctccatctggctgcaaaagaggaagccagagagatgcactgtggctggtctggaagaaagcaacatctgtgctgtgaactgcatatgggggcatgtaagtctgctagggcgccataactaaataccatggactgagtggcttaagacaacagcaatttattttctcacagatctggaggcaggaagtccaagatcagggtgccagcatggtcagtttctggggaaggctcacttcttggcttgtagttggtcaccttcttgctgtgtcctcacttggtctttcctcagtgtgtgtatgcagagagagagagtgagctctggtgtctcttcttataagaacactaaacctattgggtcaggatctcgcccttgtgacatcgtttaaccttaattaccttccaaaggccccatctccaaactgtcagattgaggttagggcttcaacatgtgaattttaggggaacacaatcattcagtccataacagagggccatgcgacaaagtattttgagtggcctataggagctgagagtggtccccggctgataaccagcaggacaatggtgacctcagtcctacaaccataaggaactgcattctgccaataaccagtgagcctgaaggagaaccctgagccctatacatgaccagcactttcagtccagcctgctgagatcctgagcagagaattgagtcatgccctacgtcgacttctggtatacagaagcagaaataataaatttgtaataagtggctaagtttgtgataattgtttatgcatcagtataaaattgtttattatcaatacaaaaataatataaattttataatatatatttttaaggaaaaaatacaaaattacaaatacaaaatctgtgagactaaagaggtctgtaagtgaggaaccctgaaatttaagcttcattagtttcaaggtaagtctgtctctgcctccaagaaggagagaagatgaaggaaaaagagtgtcaactacaatacgatgttgctgttttgggcaggacaaatgcccaaaaccaattctatctctttgaaaggctttaggggaacctttaagggatcctcccttggagcccccaactatacttcccttgagaagcaaagcttctcctctggcttggctcctgaactttagcagtccatcttctctgttggggtcccagtgccctcagtgcaattcttttgaggacagacctgttttaggaagatcctaggtcagatcccttcttccaggtctacctcagttcctaggaaaaacctgcttttgccccatggccagtgggagaagggtttgctctcagcccaaccatctctctctagtcctacaaattccattcagtctctaatatttaaattcctcaagaatatgtcaaactccatatcttatgattcccaaacttcagtgcaacatgtcaagctctctgagtggttttcttgaagtccccagtttcctttggcttaaggaaggaggagaatatggctcccctcccctgtgtaccgattgtcacccagttattaacagaaagaatagggattcaggaaccctgagctctagtctgggttctgatactaactcactgtgtgtccttgggaaatgtccttttccatttcgggccttgctttcctgacagctcacttaaatgaaaatgtaggactagatccactcatttattcagtaaatgtttatagagtccctattacgtgtcaggaactgtctgggtatgaggaatcatcagaaaacaaactagctgacttctcaggccctaccagccctcacattctctgatgcttctcccccacctagttcccactcacccctcaacaatgagtggtcaagttctggctgcgatcatgactgcttttccacctcagcagtgtatagcctcttcttgcagggatatttatttatttatttatttatttctgacagggtcctgctctgttgggtgcagtaatgcgatcagggctcactacaacctggacctcctgggctcaagtgatcctcctgcttcagcctcccaaagtgctgagattataggtgtgagccgccatgcccagcccacagggacctttgatgggactaggggtaagcttcctttgaaggcagcattgctgttttggttactgcccatcaacctgggctgtctggcctggaagtactgcctggccaacgacaatggaaaggtttatttgcagaggccaggaagtccccatgacccctctccattcacctctgagacaggaagccccaggaggaaaaaacaaaagatgaaatgctggctgacttcccagcttccaagtgctcagccgcactctggactggaggatcccttctgcccagtggacagggacctctttcagcagctccttccttgtcattgatccccagggcttcagttcctgtcctgaggatccagaaggacttaggtgacgtaaaagaggtatgaaatgaagattgagtctctgggaaaggatgcatgatgtcttatcctaagctaagcctccatgtctgggaagtggggggaggctgaatgcacagagtgggaaaaatattctcagtggttaaggaagcaagtgactcacctgctctgaccttcatccatccactcccatggccagagtgacttcagggaggaggtggggtggaagagatttccaagtctcgttttttttttcttgagttttttaagacctcttacttatgatgccccttccatccatcacacttctcccaacagcttagctaacctgcctggaaaaaacagtcatcaaaaagcacacagcatgctaagtagaaaatgaaaaagcaggaggtgcctccactcttccagcagcttttccactgggttctgtgcctaaggagttgctccctccagtccgcagagtagctggaatgcattttcaaaattcaactttaaaaactgaagtggtcgggcgcggtggctcacacctgtaatcccagcactttgggagctgaggtgggtggatcatctgaggagctcaagaccagcctggccaacatggtgaaaccccgtctctacaaaaaatacaaaaattagccgggcgtggtggcaagcacctataatcctagctactcgggaggctgaagcaggagaatcgcttgaacccgggaggcggagtttgcagtgagctgagattgcgcgactgcactccaccctgggcaacaagagcgaaattccatctcaaaacaaaaaacaaaatcaaaaacaaaactgaagtataacattcatagaaaagtacataaatcatacgtgtacagttcaataaattttgagaaagtgcacctccatgtaaccaacactcaggaggagaaatagaacatgaccagcagctcagaagctcctttgtgcctccttccagccacttcaccctgcaaagctaaatgctgtcctgaattctaacgtcaaaaattagatttgcctgtttttgaactgttaagtagaatcacatagtatgtgttcttttgtgtccaacttcttttttttttttttttttttttttgagacggagtcttgctctgtcacccaggctggagtgcagtggcgctatctcggctcactgcaagctctgcctcccgggttcacgccattctcctgcctcagcctcccaagtagctgggactacaggtgcccaccaccacgcccggctaattttttgtacttttagtagagacggggtttcaccgtgttagccaggatggtctcgatctcctgacctcgtgatccgcccacctcggcctcccaaagtgctgggattacaggcctgagccatcgcgtgtccaacttctttcactcataataggtttgtgatattcaccttagttgttgcaggtagcattctcactgctgtatagtattccaatgattggttatatccaatgtctttattctatttggtgtgtttccagtttggggctattgcaagtggtgctgctataaacatttttatacatgcttgttgatgtaaataggggggaaattgctgggtcatcaggcatgtacgtgttcagttttataaaatactaccaaactgccaaactaaagtggttatgtcagtttacactcccatcagtgatgcatgagagttccagttgctccatattcttgttaacacttgatgttgtttgtgtttttcattttggttctttcagcagataagtgctggtatcttgttgaagtttcagagcagtatttttttatgagaaaggccctccctttgatagagcggtatttttaacattcagatatagccagatcacttctctggatccccacagtctacaggattaagcctgaactccatagctgtacattcaaggccccttatgatctagcaactattgacctatttactcgctggggcaaggccccttatgatctagcaactatggagcaactattgacctattcagttgttgatgaggtggatggctcttgcttcatcccactttcccccaagttctgttcaagtgggagggcctgctattaccccaaccattctctttcacgcttctgtgctgtccctctttcttgggacagatttgtttctcttctttgccttgaaaattcttattttcctattctgtcaccattcccttgggcacccacagactctgtgctttcctcagtcataatcctgaccccaagtatggtgataatttgtttccatgtttatcttctccaccagactgtgagcccttgagggcagagcctgggtctgcttcatctttgggtccctagtacccagtgcaggacctgacagagttggcatcagtaagtggtttctgattgaccacctgagtatcccagatcctgcccagaagaagaggctgtggagcaaatagaaatcacaaaaggtgtcctgaatcctgacttccatctccctgaacatcaactgtcccgggattctattatcttagtgggaaaggacctaagaaatcatcctcccgctgaggggaatttcatcacaagctgcccttgcttgtggacctctgggaatagagaacttaattctttctttttttttttttttcaaagctaaagcaagtttattaagaaagtaaaggaataaagaatggctactccatagacagagtagccctgaggtctgcttgttgtccatttttatggtcatttattgattatacactaaacaagaggtggattattcatgagatttttcagaactcaaggttcctcccctttttagaccacacagggtaacttactgacgttgccatggcatctgtaaactgccttggcactgatggagacattatttgtttccagacaagtctttccttgagactccacagccagtgacagctctacttttggggccaccagacagtccttctgagaagggaagcaggaagtgtgcttttctttaggctgtatggccccatgtctgcactttgtctgttagcccaaaaaaagtagtggctcctaggcctactaggagcttgatttgagggcactcctggaaagcgtcacccatcacagtctagcatagcctctcaccactgagcagtcatttctttggatcttgaagcttctctgttctctaagaatcccttgttaaaatagaaacaaatcaacaaaccagtccttggaagggaaggaggttaacatcgagaacacgtcacctgtgtagatgtccagggctctgtacttggaaggacctcctgcttagtttaatgttctactgttgccatctttgaatgcttggtaatttctaaacaagagacccccacattttcattttgcatggggccttgcaaattatgtagctggtcctgactgagaatgtcccatgtgttaggttctatgtcaagtattttacatactagcctcacaactgtgctgagctaggaactgttcactccaagaggaaatttaggcttaggtaaatgacttgctggaggtcacatacaaagtaaggggcagaaccaggatacaaaccccaagtctaacttcaaagttagtgcttattcctgtcctcaatgctgtctcaccaagaaaaatgcctttacttcccaccttctgggaaagctgagtctggaagagcaattcaggagagtcgggcaggggtggggatgaatgagcttccaccagagctgaaattttaagcaagccttgggaatatctttttttttttttttttttttgagacggagtttcactcttgttgcccagattggagtgcaatcaatggcgtgatctcagctcaccgccacttccacctcctgggttcaagtgatttgcctgcctcagcctcccaagtagctgagataacaggcatgcaccaccacgcctggctaattttgtatttttagtagagacagggtttctccatgttggtcaggctggtctcgaactcctgacctcaagtgatccaccctccttggcctcccaaagtgctgggattacaggcgtgagccaccgcacccggccaggaatatcttttttaatattgacctacatgcacattcatacacaaccacacacacgcactgtctctcactcaaatgctcatgcatacacactcacacccatccacatccactcacacataccacctagcctgaaacctgcctttagaagcagttcaattatgtgtgccgtatggtgtcctagagtgacaactccacaagggccccttgggaagcatctaatttaaaagcatctaatttaaaagcatctaatttaatcgtctgattcccttatctgacagatgagaaaactgaagttcagagagggaagaggcttgtctaggtcacacactaccagtgggcagagctaggggccacaggctagcctcctgaatctggattcaacagcacagcacgaaggtgcactgatgggagggaaggtgagatttgagcagaaaggaagctcgatcttgaggtcaatcaggcttttttttttttttctttcctaggcacctttcatttgcatcccacacaaaacttacccatcagtctctgagaaatgctttgcttctgatgctggctgggcacagaatccccctacctccatctaagtgtttgtaataatgctattgctcaagaccagaaacacctgctttaaggggtcaagtagtttggattcagaaggctaaattgttctttcactcataagcaaaacaaaacacaaaagcaaaatataaacaggatgaggcatgagaggcttaattaccctgtagaaacagcagagtttctatgtaaaaacacaaaagaaaacaaaacaccacaatctgccagggactgcccaggatgagcaggtgataggggctgggcccagcttttggctttctctgagcaatctcccaccaccagcactgagaccaagctgggcttgagacagagtcacgtggctaaagagcagggtttgttactcttcagccatcattctaaagcttctccgcacatatttcctccttgacagatctgggttcagattttgactctgtcccttactaagtgattcggggcatgttgcataatctctctaagcctctttttcctcatttgcaaaaggtatgacactcaaacctatgtccatgtccaggggattcccaggatgtgagactttcagtgctaaactctgggctggttaccttagggtataaggaggataatgttgagaaagcatttatcgcaacacccagcacactgcaattgctttataagtaattgttattatcctttcctcttgcctcagatatttttgtttttgtttgtttgcgttgcccaggctgaagtccagtggcaccatctcagctcactgcagccttgacctcctgggctcaagtgttcctcccacctcagcctcccgagtagcagaaactacaggtgtgcgccaccacacctagctaatttttgtatttttttgtagagacagggtttcaccatgttgcccaggcttttacctcagatattaaagagcacctttggtctgccatactttgtgttaagcactaagataaattacaaatatttattgagttcactttatagagtattttcatgtccatgatctaatatgatccttacaagagccctttgagggaggcaaaactcttaatattcctgttttatagttgagataactagagctcagtaagatgactgactttttcaaggttactcagtcaatagtttgctatggaccaaatgtttgtgccccccaaaatccatgtgttaaagctctaaccttaaattaatggtatttggaggtggggcccttgcaaggtaattaggtttaggtgacatcatgagggtagatctcccatgatgagattggtgcccttataagaaaagaagagaccagagctcactctctctctgccatgcgaggatactataagaaagtggacggccggggcacagtgcctcacgcctgtaatcccagcactttgggaggccaaggtgggaggatcacctgaggtcaggagttcaagaccagcctggctaacatggtgaaaccccatctatactcaaatacaaaacttagccaggtgtggtggtgcgcacctgtaatcccagctactcgggaggctgaggcatgagaattgcttgaacccaagaggcggaggttgcagtgagctgaggttgcaccactgcactccagcctgggcaacaaaagcgagactccatctcaaagaaaaaaaaaaaaaaagaatcctttcttaatctttgacctttgggagcttaattattaaatgccctgatgtagtctccatcctaggccacctaggctactgatagctcctgctccttttcctcattatcaggcaggatgccttcctgcaagcaacagaaacatattccagccgactgaagcagaaaaggagttattgaaaggctattaggtagctcacagaatctcctggagggccagagaacaaggctgggatctttcactgcaagagcagctcctaaattcaccacatagaactggctccgtgaatacatgccagctgctgctctggggaagtcttaccactgcaggcactgtccagatggcaaaggccaggccctggactctgctgctggtcatggctcacactgattctgcatggcctgctcctctgcctcaccagcttccaattcaaagtctatctaaggcaggtggtctgatttgtagcacttaggccatatgccatgtcttggttgcaggggattgtggagaattgagtctggcattttcagttcctgtgataggaaactggcttggtttttaatcaactagcttggttattaatcaactatgtgctagttgattaataaccaagctagttgattaaaaaccatgtattagtgctagttgattaataaccaagctagttgattaaaatgtattagtattagtgctaatgtattagcgctagttgattaatactgacatagtagttaaagtatgtctgagaagaattcagggagtagtttaattagaatttcagctttgggtgttgacggtgaagtgggaatacttcttccctgagttgtcctggggagggattctccatttctggtttacaagaccagagtattaaattatactacaaccatctcatcctgtgatgagaaactctggtgggcttgcacctgtagtcagctactcgggaggctgaggcaagagaatcacttgagcctaggaggtcaaggctgtagtgagctgtaatcatgccactgcaccccagtctgggagacagagtaaaactccatctctaaaaataaaaaaaattgtaaatttttttgaaagatgaggaattcaccaaacatgaaaaagaggtctatagctcctcagcccaaaatgtcaacaacaacgtgttatctcatcttttctccactctctctgtacctccaggccatccacctctgaatttcaattttttttgttagtttgtttatttaaaaccaggacaatactgctttcatttactttgttttaaaaatctacaacctagtgactgtattggtcataagcatgattgctgttgcaatgtgctacttataatgaatgacagcaaacaagctagggattctgtctgccacttccagcctttcctctttttacttcaataggcatcgatgataaatcaatcttatgtacaatttcttataacttttgtattttttgtagaggtggggtttctccatgttgcccaggctagtctgaaactgctgagctcaaatgatccacccatcttggcctccccccatgggattacaggcatgaaccagtgctcctagcctttgcattttaactgggtaatgtatataagtatagatgccaggtttttaaattttttgtctgttgcttggttggctggttttcttgttttagttgcccaacatctgaatcctaccccttccttatattcagagaactctcgaccatctgagccttggagagaggcagattttgtctcctattatggaagtgaaaaagtacagatatttgctttccagcacgcccttaacagctagggcatgtgcatattatataggttcaatcaatttggtatgtcctcttggaactttgattaagaaacttgtgccacaaagaagcagggacagtggagagttcattttggcagaggtggaggcagtgacagtaacatctaggtatagggcagcaatgccagcagagcaatgggtggcctctgggtccagggttcagggtagggatagaggtggcagtggtgtctttactgaattggctccatagcaggatttgggctaaggtaatacctgtcttggctcctttagtctctgccattttttaaacagctttattgaaatattaggttggtgcaaaaataattgcagtttttgctattacatgtattacaatttgcccttttaaagtgtcaaattccatgacttttagtgtatttacaaatatgggagactatcaccatagccaatttttattacctcaaaaaaaatccatatgctttaactatcatttcctacccccacccacacccccacccctccccagccctgagcaactactgatgtacaaatttccctattctggactttcacatgaatggaatcatatagcatgtagccatttgcaactgtcttattttatttagcatgatgttttcaaggtccatctatgttgtggcatgtatcagtacttcattcctttttatggctgaatcatattctattgtataccatgttttgtttatccattcatttgttgacagacatttgggttatttccatgtcttggctattacgaacaatgctgctataaacattcatacacaagcttctgtgtgggcatatgttttcattttctgcccatttgttgactctaattcttcaggctttctggtgactccatgagttacagaaaattatcttaaatttttttcttattcaaataagacaatattgatttctgttagctggattcacttgcagctaatttttgtaattttttgtacagacatggtcttgctgtgttgcccaggctggtctcaaactcctggcctcaagtgatccacccccatcagcctcccaaagtgctgggattacaggcatgagccaccacgcccagaattttcttacttttgttaaaagacatgaggacttaactattttctctggggcccagttcttagtcccagaacaaaagggctataattggctaatgtgacacacttcccagttaaccttcagtgctgaatttaatcttccttatacattgatgtagagaatgagatccagagaaggaaagtgacttgcttaaggtcacacagccagtcagtggtacagttaagactagaatctagaactccttatgccaacttaatgttcttccccctacactaggcctcctgtcatcaattcaacaactgtttgttaagctctgtggtcataggatatatggaagaagcaggggagacagagtccaaagacatgatttctgctcctggctttgccacttcctacctttgtgaccttggacaatttattctgtgtctctgggtctcagctatctcatacaaaaaagcaggagttggagattggaggctaggcagggagagcggttggattagaggggacaagctcaaatgcctacaacctccgtttcatttattcaattacattttattcacttataatttatcacctccttttttttttgagatggggtctcactctattgcccaggccagagtgtagtggtgctatcttggctcactgcagcctcaacctcctgggctcaagcaacccttctacctccttctcctgtgtagctggacctataggcatgtgccaccacttccagctaatttttgtaattttttgtacagacagggtcttgctatgttgcccaggctggtctcaaactcctggcctcaagtgatccacccccatcagcctcccaaagtgctgggattacaggcatgagccaccatgcccagaattttcttacttttgttaaagacatgatcaataaatatttcacacattaaaaaaaatgtttaggccaggtgcagttgttcacgccgataatctcagcactttgggaggccgaggcaggtggatcacttgagcccaggagttgaagaccagcctgggcaacatagggagacccctgcctctacaaaaaatatgaaccttagctggtatggtggcacgtgcctgtagtcccagctactcaggaggctgaggtgggaagatagcgtgaacccaagagatggaggttgcagtaagctgtgattgtgtcactgcacgccagcctgggtggcagagtgagaccctgtctcaaaaaaaaaaaaaagttttaagaaaaataatagtacaaccaccttgatcaatggcaaaaataacttggcctcagtgttgggagaacacagggaatgataaggaccaaggctcaccatggtagagcacaagatatttggattttttaaaagcctgaaatatgattttactaggacatcccttattctttaaatttgggcaattaattcaattaaactttttcatacagagcgttttctaattgtgtattgaggtcctatctttattgttattcttcatggaggaaggagcggcaataactcctaatgggagatagcaaaaggagaggtgactctgccatctgctgctcactgatggtatgtacctacaggccttcagtaggatttaggtgccacccttataaagggtcagctctgaaagtctttgctggggacatctccaatatcctaatttgatggttggggtgtcaggcacatggaggccttatatcccaatacctggaaaccatgaagccggctccaaggtaaagcccacaagctgaatctgacctctggtaggcatcaggcatgtgttgccacagagctaaaagtgtggctggagaaggacgagaggagaggaaagaggattgcggtgggagtcgccaagaaagctggaagccattgcacagctccaggaacaggggcaagggctgaggtaaaaaaaaaaaaaaaagagagagaaatgagtggatttgagaaacagtacaagaaaatccgacttgataagacattggattcagagaatgaagggctggaactgccagtgcctgccagtgagttgtactttgtgctaccaactaatcttcgtagaacttcagtttgattattcattacctccagcctattttggcttcctactgaaatcaggacacaaggaaatttgtcaccaggtagacaataaatgtccctccccaccccctgccagtcaccccactagtcttattaggaatcctacacttggtaggaattaagaagtcttgactgtgagtcccaagttcagtcattttctggctgactgaccttggggaaagtgaccaaacacctgggagtttagttttctcatcttcagtttactcatctgaacaatggagcaatggcaacaacagctccctttaggctgagccaagcttcatacaagctaatgtcagacatctatcatcttattgaattcttgcaaccccaggaaatgggcactaccattacccccattattcaaatgaggacactgaagctctgagaaattgagtggcttgcccaaggccatatagctagaaagtgggagaagctgtctttccaactcagactgcttagctccaaagctttactgctctggatctctgtctcagtgagcttttgctataaaatgacccaccctgaaacacagtggcttaaaacaacaatcattttgtttagttcacagttctaaggtacagtatatttatacaggtcacagttttgatcttggccaatttagctgatctatgctggattcccacatgcatgggtctgtggatagctggtaagttggctcaatcacatatttggtgactggcagttggctggagcaccctgatgctcctccatatagcctctcatcttccagcaggctagcttaggctcattgacttggcgggctaaagattccaagtttaacaagagaagacaggccagatgcagtggctcacacctgtaatcccagcactttgggaggctgaggtgggaggatcatgagatcaggagttcaagaccagcctggccaatatgatgaaaccccgtctctactaaaaatacaaaaattagctgggtgtggtggtgcatgcctgtaatcccagctactcaggagactgagacagaagaatcgcatgaacccgggaggcagaggttgcagtgagctgagatcacgccactgcactccagcctaggtgacaaagcgagactccatctcaaaaaaaaaaaagagagagcagacaagcctccgtgctcaagcatgtttcaagtcatcgcaaagccaaaccagactcagagtgcaaaagcactttcaaaaggtgtgggtagagggaaggggataatctgtggtcatttttacaatctgccataaatgctatgctataatccctgtttcacagggttgatcacatgagataaagaatgtgaatcagctttgacgtgaatcagctttgtgaacttctataaaatattgtccagaggagtggcattgtttaatgattagtactgtatgccaatagtacctcgaactcaacacatctggtaattatctccattttccagatgaggaaactgaagcctagagagcttagggggcttgcacatgatcatacagccagaatctgaacagagatctgtgtgtgcagtgctcttcagcaacttgattctttattgcattgttctataatccgttttcctgagcaggtcttgttttcccaactaaaattccttaaggacttttttttttttttttttttgagatggactctcactctgttgcctaggctggagtgcagtggcgcgatcttggctcactgcaacctccatctcccgggttcaagcaatttttctacctcagccgcccgagtagctgggactataggcacgtgccaccaacgcctggctaatttttgtgtttttagtagagacagggttttgccatattggccaggctagtcttaaactcctgacctcatgatccgcctgccttggcctcccaaagtgctgggattacaggtgtgagccactgcacccggcccttaaggacgtattataggtcttttatttcttttgtggccacggtggtggctagcattatactaaacacatggtaggcactcactaaagacttttcaaatgactgaatcactcattcatttatttattccctttttaagcaaacatttattgaacaccaattattacataggtcctggacactgagaatacagaaataaataacacaatattccttttcttaagaaactcgcctagttaaaaaaaaaaaattcaacctgacactgtaatctagcatgatagaacctcaaagggttatgacagcaaaggaaaggagccctaaactagcctggcagagaagatacctgccttctttatggctgaggacactgaggaggatacttctgaagagagcacagcagatgcaaagacttgtgggaaataacacggtatgtacctggacttatcagcagtctgtgttgctggagcataggtaagaagcagctaggggtgagaggtgaagttgaggtggtaagaagctcaaacttgatctctttttttgggacagggtcttgctctgtcacctaggctggagtacagtggcgtggtcacagcttactgaagcctcaaattcctgggtttaagtgaacctcccacctcagcctcccctgtagctgggaccacaggcacacgctactatgcctgactcatttctttattttttgtagagatggggtatgactatgttgcccaggctggtctaaaattcctgggctcaagtgatcctgccacttcagtctctcaaagtgttggtattacaggtattagccacagcacccggcctcaaacttgatcttaaaagcactgagagggtcaggcgcggtggctcacgcctgtaattccaacactttgggaggctgaggcgggaggatcacaagatcaggagtttgagaccagcctggccaatatggtgaaaaccggtctctaataaaaacatacaaaaaaaaaattagccaggggtggtggcgggcacctgtagtcccagctacccaggtggctgaggtagaagaatcgcttgaacccaggaagcagaggttgaatgagccgagattgcaccactccactccagcctgagtgacagagtgagactccgtctcaaaacaaacaaacaaacaaacaaaaaaaaggccgggcactgtggctcacgcctgtaatcccagcactttgggaggccgaggcaggtggatcacgaggtcaagagattgagaccatcctggccaaacaacatggtgaaaccccatctctactaaaaatacaaaaattagctgggtgtagtggtgcacacctgtagtcccagctactcgggaggctgagtcaggagaatcgcttgaacctgggaggcagaggttgcagtgagccgagattgctccactgactccagcccaagcgacagagtgagactccatctcaaacaataaaatgaaataaaataaagcactgagatgcaccactaggtaataaaaacacattcagaccaagactcgtatgcaaattttttagtaccaaaactggaacttatccaacacccatcatctggtcagtaaatgaataaaatatggtacactcatacaataaaatactactcagcaataaaaagtaatcaactactgatatttgcactaacatgaaagacgatacatttgtttgcttggactgccataacaaagtaccacagactaggtgacttaatacaaattttggccaggtgtggtggctcacgtctgtaatcccagcacttttggaggctgaggcgggcagatcacttgaggtcaggagtttgagagcaggctggccaacattagcgaaaccctgtctctactaaaatacaaaaattcgccaggtataatggtgggcgcctatagtcccagctactggggaggctgaggcaggagaattgcttgaactggggaggcggaggttgcagtgagctgagtttgtgccactgcactccagcactccagcctgggcaacagagtgagactccatctcaaaaaacaaacaaacaaacaaacaaacaaatttattttctcacagttctgaaggctagaaatcaaggtgttgtcagagttgatttcttctgaagcctctctttttggcttgcagaaggccatcttctccctatgtcttcacatggttttccctctgtacatgtacaagtcctcatctgttcttataaggacacctgtcattagattaagacccactctaatgccctaattttaacttaagtaccattttaaagactgtctccaaatacagttacattctgaggtcctggaggttaggactttgaaatatgaatttgggagggacaaaattcagcccaaaacagaagtcatacacaaaaactacacgttatatggttccatctgcattgtttccgtttttactttttaaattttgttgttgttgttgttgttacaggatcttgctctgttgcccaggattgaatgcattggcacagtcacggctcactgcagcctcgacctcccaggctcaagtgatccgcccacctcagtctcctgtgtatatcagactacaggcatgcaccaccatgcccagctaatttttttttgtagagatggggtcttgccacactgtccaggctggtctcgaactcctgagctcaggctatcctcctgcctcagcctcccagaagtgctgggattacaggcatgagccatcatgcccggcttaattttttaaatttaatttttaaattttttataaagagagggtctcactatgttacgcaagctggtcttgaactccaggagctatcctcccactttggcctcccaaagcactgggattacaggtatgagccaccatgcccagcacgctgcatgaaatttttagaacagacaaaattatagagacagcaggtcagtggttgcttagggctaaggggtgaggtagggattgactgtataagtggagaatataaggcacaaggaaactttggggatgatggaagtgttctaagattggatttgggtgatggttacgcaactataaatttactaaaattcacctgactgtatacttaaaatgggtaaattttatggtatgtaaattatttatcaatcaagttattaaaataaagcagtagcggggccatggaaggaattttacctgaggttggggggtggtggtcaaggtcagtttagcatttagaaccatctttttttttgagatggagtctcgctgtgtcgcccaggctggagtgtagtgacgtgatctcggctcaccgcaatgttcgtctcccaggctcaagccattctcctgcctcagcctcccaagtagctggaattacaggcatgtgccaccatgcctagctaatttttgtatttttagtagagatggagtttcgccatgttggtgaggctggtcttgaactcttgacctcaagtgatccgcccaccttggcctcccaaagtgctagaattacaggcgtgagccaccgcgcctggcccagaaccatatttctagtggtgagtatggagaacagactggaagaggtggaaatggagacagaaagaccagtggggaggctgaaagatggccgggcctgtgctcagcgaggggcagtaaggatgggagtagacttggcacctgctgttggacaggtgatctgtgagaaatgtggttcccggggatggtcacagagggagaccagcttcctggaggaggaaatacctcgtgaaagtgcccagcagaccggacgcggtggctcatacctgtaatcctagcattttgggaggccgaggcaggtggatcacctgaggtcaggagttcgagaccagcctggccaacatggcaaaaccctgtctctactaaaaatacaaaaaattagctgggcgtggtggtggtgcacacttataatcccaactactcgggggcctgaggcaggagaattgcttgaacccaggcggcggaggttgcagtgagctgagatcacgccgcttcactccagcctgggctaaagagcgagactctgtatcaaaaaaaaaaaaaaaaagaaagaaagtgcccagcagatggacgttccctttgtctggcctaatggggttctcaaaggccaagatgtatcgacagaggcagaggatatatttctgggtatgaatcagctctgagaacaatggggggtgggggcagctcatcagaaacccaactctccaggatgaaaaatgaaggcattccttactgacctgctatcccatacttcccagcctcttctagccacaccacagtccggtggctcatttatgtcctggccatgtctgtgccaggctccagctggaacagggaccagtgatgaattagacatgggcctggccttcaggagctcacagcaaactcagtgagagagatgtgtaaggtatggatgcctctttaatttttttagcaacaggtgccaaagtatcctgagaagaaattaggataatctatgaaaaactaccctatagcctcttggaacttgggtagagaaagggtgggattgtgttgcatgagacaagggaggtttacacacacatatacacacacacacacgcacgcacacatacacatgcatgcacacacattcacacacacatgcatgcacacacgcaacacatgcatgcacacacacacgcatgcacacacatgcatgcatgcacacacacacacacacacacatatatgcatgcacacatgtgttcctaacaaggagaagggggaagactaaaataccctgggctgggaagctggctgaaacaagggaattttggagaggagagacctcaggtgggaaatcttaggtgtaaattgtgggaactgtgcagtgtaccccttcccccacactcctcacatccttagtacactgcccaaatccccaaatgcctgatgggattgcatatttcatggaaatcaggagctgaaacagaatcttgcccagccagatgagaagcagcagcaccatctggactgtgtttaatcagcaggaggccatgagacaaatgccaggaaggaggctctcaagcttccagacataaaggaatggagcagagtcaagggcagtatttcaggctgcagcagaagcaggaagcgaagacatgtggctgtgatagcaggtgtgtgctgttggatgatgctggcgctactgcagtttgacattgctgaagaggaaggtggaagaaggaccagaccctgaagagccttgaacgctcccgtcttctctactaagaaactgagacttgccggacacggtggctcacacctgtaatcccagcactttgggaggctgaagtgggcagatcatttgaggtcaggagtttgagaccagcctgacccacacgatgaaaccctatctctactaaaaatacaaaaaaaattagccaggcatggtgtcatgcacctatagtcccagctactcagaaggctgagggaggagactcccttgaacctgggaggtggaggttgcagtgagttgagatcgtgccactgcagtccagcctgggtgacagagtgagactccattaaggaaggaaggagggaaggagggagggaggcagggagggagggagggagggagggaaggaatgaaggaaggaatgaatgaaggaaggaaggaaggaaggaaggagagagagagagagagactttattctaaaatcaacagagaaccaccaaagggttttaagcagggagtaacatcatcagatctgtgtttcagaaacatcatcctggccaggtgcagtggctcacacctgtaatcccagcactttgggaggccgaggcaggtggatcatgaggtcaagagatcgaaaccatcttggcccacatggtgaaactccgtctctattaaaaatataaaaattagctgggtgtggttgtgggcacctgtagccccagctaatcgggaggcttaggcaggagaatcgcttgaacccaggaggcagaggttgcagtgagccgagatcgcaccactgcactccagcctggcgacagagcgagaatctgtctcaaaaaaaaaaaaaaaaaaagaaaagaaaagaaacatcatcctagaacttgtgttaaagatgaaccagggccagggagggcggattggaggagagatgaagctagaaaagatgaggacgagcaggcatttcctttattagtagaaaaacaacttaaaaagaaaagactgatgataggagggcctgaaatagggcaggtacagggacagcagaggggtggtggaggcatcatagagcaagggaaaatgagggaagttagttggggaagtccactatctgattttgccttaagaagaaaatattgaaaggtaagatactttaaattggtcaaccccaaacatatggaatgtttactaaagtactgtgtgtcaaggttgtacgtaggaacacgtgaagcctccctgtggggtctagcagcagggctctttgcagccctcaagcctgtttaggacctgggctcgttgcctctctgtcctcatttctgatcattgggtctttgaaggaagctggatttccccattagcttatctataatgctcacttgataacagacaatagtcattgcagtggtgcaaggaaaagtagacaacaccttccacaaacaatattctgtaactcaacaaaaaggactatagagcagaacaatatttaattcaatttcatccacccatccatctattcaccaggcattcagtttccagccaataaatatttgctaagggcctgtccattccagttttagccaagcagggtgctgggaaccagggatgaaaaggcctttgaagaattccatgtcccctcctgcagattccagccttcagttcctccagtcaggcctccctgactgacaacactctagacggagcagaccccacaatgcctggcatgccttttcctaacacaaacgtccaccaccacctcctagccctgtggcttagacagacatgctatgaagctcacgaccatcctcaactccttccacctctccatttccatgtatttaattggccagagttgtcctcaccttctatcttcagttcttctcactcttcattccttaaattactgaactctggcttttgtgcctgtcactcttctagctgacggagaccaaattcaatgcattccttttttttttttttcctgcgatggagtctcgctctttagcccaggctggagtgaagtggcatgatctcggctcactgtaacctccgcctcctgggttcaagcaattctcctgcctcagcctcccgagtagttgggattataggtgcccaccgccacactcagctaatatttgtttttttgtttgtttgtttgtttgtttttgagacggagtcttgccctgttgcccaggatgtagtgcaatggcgcaatctcggttcactgcaacctccgcctcccggttcaagcaattctcctgcctcagcctcccgaatagctgggattacaggcgcccgccaccacacccagctaatttttgtatttttactagagacgcgttttcaccatgttggccaggatggtctcgaactcctgacttcgtgatctacttgcctcagcctcccaaagtgctgagattgcaggcgtgagccactgctcccagcctaatttttgtatttttagtagagaggggtttcaccatgttgctcaggctgatcttgaactcctgacctcaggtgatccacttgcctcggcttcccaaagtgctgggattacaggcataagccaccgcatctggccaacatggtcttttaactgtttgttaacttatctgtctccaacctgggccatatgtctcttgtatactattgtatctcatatatatagtgaagtctaagaagaaactcagtgaacaagtgaggaatgaatgaatgagcacttgtccaagaggacctgtccacgggctgcttagtatcctgaaaaaattttgataatctgaaattttaaaaaaacctaaaactgaaataagttgagcaaattggactggaccatttaggaattacaaaatggggaactgttgagaaaatctgtagttagtcatgggccaaaagctggaagtggtagttgagatgagccatggcaacaatggctgtgtttacactaaaattatgaggaaacaaaaactgtggttaagcagagaagaaaacagagcagtcatacagaaagaagcaattaggtcaaaagacaatgaggcaaagagagcagctcactccatccagactgtgtctggaacagcccttgcccttctttacctgacatgaaagctgagaccatgtgacagctcctcaggaagcctccctgaccagcagtgtttgggggcagaaaccaatgttctctgaaaaaatgatcatatgcttctttctagccctgaatgccaaccccacctgacacacattgtaagaattcagaggccaggtgcggtggctcacgcctataatcctagcactttgggaggccaaggtgggcgatcaccaggtcaggagttcgagaccagcctggccaatatggtgaaacaccagctctactaaaaatacaaaaattagcccggcatagtggcgggcgcctgtaatcccagctactcgggaggctgaggcaggataattgcttgaacccaggaggcggaggttgcagtgagccaagatcacgacactgcactccagcctgggtgacagagggagactctgtttcacaacaaacaaaaaaacaaaaaattcagaaatgatgtgcttaagacaaaattgcccatagccagtttccagttatcttcacttttagcatcactactccaagcactctcccagcccccaagggaagggagaaaggaaaaaatttatacaaagcatatgcaaggtggggatggaaggtcctcctgctctttttctgaatgtctgaggcagcaaaggtagagatgtgaacctctggtgagcgagctgaggaataaacaggctgggatgtgagtgtggctgggagcatgacggggtggtataggtatagaacaggaaaaccagtatcacagtgtcctcttggctcacccacttagttttggtaactgagggactttacattgatttttatagcactgataaggtgttttagaacaagcacctgcaggcttatctcactgtccttgagctcctacgtcaccagctgtcatgagcgtgatgtgtcctggcctggcctggcctgggtagctatacattccacaagacagtctatgtaagatacacatgttctcataaaagtttatgacaactttaaaaaatgcttttatttttgagatggggtcttgctttgtcacccaagctggagtgcagtggcatgatcatagctcactgcagccttgacgtcctgggctcaagtgatcctcctgcctcagcctcccgagtagctaggactacaggcacaagccaccacacctggctatttttttctttttctttttttgtagagatggggttgccctgtgttgcctaggctggtctcaaactcctggactcatgcgatcctcccacctcagcctcccaaagtgttgggattacaggcatgagccaccatgcctggcctaaacaactttttgaaaaagaagaaatacaggcttgtgatgtattgttaaaagttgtaacaaagacagcactctggccacgtgtggtggtttacgcctgtaatcccagaactctgggaggacaaggtgggtggatcacttgaggccgggagtttgagacaagcctggccaacatggtgaaaccctgtctctaccaaaaatacaaaaattatccaggcgtggtggtacacacttgttgttccagctactcaggaggttgagttatgagaattgcttgaacccaggaggtagaggttgcagtgacccaagattgcaccactgtactccagcctggcaaaaaaaaagacagcactctgatttcatttcttatatattgcaccaaatgaaaggaaggattacgtggtatatatccctggtatccaggtccaaagtctttccctgatttcctctgatctttgggctaggtgagctgcctcctccaggttcttgtggcacactgtgatttcctcacactgtattgctctttaccctatacagactgtaaactcccagagatgaagaccatgctgtgtcccgattaatcacatagagcctggtatacaagaggcctgtagcaatgtttgttgaatgaatgaatgaatgaatgaatgagtgatctaattactaaatacatctgtgtcaacaagaaatatgttggtgttaagattacttctttttttgttttgtgtttgatacagggtctcactgtgttgcccaggctggagtgcagtggcaggatcttggctcactgcaacctccacctgctgggttcaagcgatcctccctcctcagcctcccaagtagctgggattacaagagtgagccaccacacctggctaatgtttgtattttttagtagagacagggttttgccatgttgtccaggctggtcttaaactcctggcctcaagtgatcctcctgccttggcttccccaagtgctgggattataggcataaaccaccgagcctggtcttaagattactttaatcttatactccttagttgacctgttaccctgcttggaaaacgttacccccaataaacctgtagtatccctgaaggctagccaactgatagggttcctaagttgcccccaagggcttcctttcctgtccagaggcctggcctccttccctcctctgagtttggggatcctgcctgcatataggttgattgctcatcaccctgccccaatattgagccctgtctagatttcccactccatgccctgtcagaatcattagactgtctgatgcaattatttctgggatgaagcggggatgacgaagaagacagaggagggtcagccttctacttctgacacctatcttaggttcttttttgaggcatggaggctgaggtggttcggtcctatggttcccactgctggtggcacctgacaccaacatccccaacagttttgtctgacctctcttttcgctagaaaatgctttggctgattgattattctggcttctggagaactgcttttgttctcaacatgaggcacatatggtaagcctcatccttaaggaataaggagtgagttgttgtttttttttttttttaaagtgacatttaagatgttgtaagtaggaatggtggtgctagtcctttctggagattgccttttacattttattttttttgaaatggagtcttactctgttgcccagaggggagtgcaatggcaggatttaggctcactgcagcctccgcctcccgggttcaagcgattctcctgcctcagcttcccgagtagctgggattataggcgcctgccaccacacccagctaatttttgtatttttagtagagacagggtttctccatgttggtcaggctggtctcaaactcccgacctcaggcgatccgcccacctcggcctcccaaagtgctgggattataggcatgagccacctcgctcagccgccttttacattttaaatagggaaacattacagagaactggaataaaaagagttaatttgacattgctaaatgctccatttttttcaaaatgaaaatatgttcattcttttctgattataaaaatgatacagactcttggccaggcgcgatggctcacgcctataatcccagcactttgggaggctgaggtgggcggattgcctgaggtcgggagttcgagaccagcctgaccaacatggagaaaccctgtctctactaaaaatacaaaattagctgggtgtagtggcacatgcctgtaatcccagctactcaggaggctgaggcaggagaatcacttgaacccgggaggcggaggttgcggtaagccgagatcgtgccattgcattccagcctgggcaacaagagtgaaactccatctcaaaaaaataaataaataaaaatgatatggactcttgttaaaatttccaaacacatataagaaaaaatagatataaagaagagaacaaaaatcagccaaatgctatcgtgtaaagataaccacggtgttgagaacatgggctttgggcatacctgggctggaaacacatctttaccacttactacctatgtggtttgggataagttacttaatttctctgagctccagtttcttcatctgtacaatagggataataatttaagctaagtgacatctataaaatacagataatagtaggtaagtaataatacttactttattggtcgttccaaagattaaatgaaaatattcaagtaaaaggcctagcatcgtgcctacatatgcagtgaatggtaattcatagtgaacactctgaggtctccttttttctcagtcctatatttttccccttaaatctcactgcttttagtgtaattacacgtaagtcaggacaggcgccgtggctcacgcctgtaatcccagcactttggaggccgaggcagatggatcacctgaggtcaggagttcaagaccagcctggacaacatggtgaaaccccatctctactaaaaatataaaaattagccaggcatggtggcaggtgcctgtaatcccagctactcaggaggccgaggcaggaggactgcctgagcccaggaggcggaggttgcagctagccaagatcatgccactgcactccagcctgggcaagagagtgagactctgtctcaaaacaccaaccaaccaaacaaacaaacaaaaaaactaaatcagtaaacatttattaagaagctattagacactggtggtggtgttgtcattattattattatattaggatgaggctagttgtaaagtgctacttagttatttgtttaagcaaaccttgtcttagaacttacatggaattgttttctactaactcttcccattaacaacataaaattgatctcaaatttgggtccttttttggtgaagggataattgaatctaacaggattggctgaggattaaataagccactctaggcaaggtactcaaaacacggtatgtgctcaataaatgatagttattatcatccaagcaatgtatacaacctaaaagactcttcatctgggattcatggcagtaaaagtacagaggagttctcttttctggtttacttttgaccctaaaatgaagccttcaggcattatctagataaaatactaatctcctggacacagtcctaggtttcttcactggcatttgctagctgtagttcccttctaaatctaatcaaaggtctatactcccctcaaacttcccttacctccaacacctgactcaaaaactttcaagattaacttttatttgcctggactctatgttgtcatatgatgtgatactcaacatatccaatttgttacttggtttctactgaaagtaattctcacttgactgatgtgcacaggaatcccaaaattctgcaataaaatgtgttagagttcactgtacttattattggttttatatgtacagttgtaaactaataatgagatggcaaaacacagtgtttaagatcatggatgctgtagccagattgcctgggttatacttctagctgtgttgctttgtgaccttgggcaagttatttaacctctctgtgacagagtttacttttctgaataaagggaataataacatgctttactttctagggttgttacagagattagatgggttaatatttgtaaagcacttggaatggagcctgtcatgtagtcagtggtatataagtgtttgttatataataatagttgccatttatggagcacttaattatctccaaggcacagaacatgttactttcaaccctctcaatcatgcaaggtagataaattatttacagtgatgcacgagagctggttgatgcacttgcttatgagagctgaatgttaaattttcagaaagtttgcaagtcagttaaacagagccattactgaaaattaaattatataaatgtacaatcaaattatattaaacacaagacaatattcaaatttcatcacttcctaagtgttttactactatctatgctctttttcatttgtgtttttcttttatagagagacaggtctcactatgtttcctaagctggactcgaactcctgggatcaagggatgctcctgtctttgcctcccaaagtactgagattacagatgtgagtcactgtgcctggcctatctatgctcttgaggttatttatgtttattgtgtctgtatgatggaaataatggtgtgatactgtgcatctcttcctaactctgcattctatggcatcaatatctgtagcttgaattctgctatgtggagtatttataccacagaagtgcaaccacttcaaatcagggctttttttatttagcaagttggttattacacatttatctgtacatcgctggatattattatctctcttcttttaagatgataaaagaagttaaatgatttgcctaaagccacactgctagtaagtggtaaagctggaattcaggcccagatgtttgtttgtttgtttgtttgctttcttgcttctcacaagaaacattgtttccaaagcccatatgcttttcattcaattacgctccaaattggaaaaggaaaaatcaaactggataggccttagacacagaaacagaaaagctatctcttctcttccccctccagctctcctgcccttaacccaacccccagcctacccaatcctgtgcagagctgtagtcattcctttctagtcccattatcccaacccagacttggagatacctttcattatttatcttgatttgataatccaattactgccttgctttgcaccacttttgcccattatcccttcttcccagaatctcctttctattgtccaaggttaagattaaacccattctttctaatacctctacctattttctattttcctagtttgaaaagacttgacactgtagttaagattcctcaaataatttccttaaacttttgattcacgcaaacatccatatagaaaactatacatatcaaaagtatatacctcaaatcattttcacaaactcaacacaccatgcaaccagcaccaagatcaagaatattaccttcatctcaaaagcctcctcatactcccttccagtttctaccctcccaagggtaaccactaatccagctaagtcattcaaccctaatattggcaggtccattgggttgggctgggcactctaaacagtgtggttgatataggagttaagaagaaatcacttaggcagatagtaagggtatagaagtccatggtaaggcttttctttttcatgaaaagcagccccaaatcattttctaacaaagaccagcctgtaaagttgagcttcagacatagacaagcaagctgggagcttgcacgggtgaatgtgggcaggaactagggactagacatgttcaagatggcgactccatcatcccttctctgccagccacatgtacagtaaggagcagacaagatggtgccagccaaggagagttcatttgcatcataagatcagggtggggataccagccttcacccctgggctatgtaaatgtcacacctgatcgaaacaatctgtgagccctacataaatcagacaccgcctcctcaagctggactataaagtccagcgcatctgccaccatgatcactaggagacccctctctctatatataaagagaactgtttctctttctcttctgcctattaaacctccgctcctaaactcttcgtgtgtgttagtgtcctaaattttcctggtgccagactaccaaccccagggtatatagcccagacaatgtagccacctcattgtcatctgctccatttggcatagggataagtatcaagactcttccctagctaattatcttgacttacttcccactcctgtggagcactgacaagaggcctgagttctgatcccacagcaaccacctaataatcctggaaaaatctatttctctctgagccgcaacaatccagtctctaaaatatggacaatggccaggcacagtgggtcacacctgtaatcccagcagtttgggaggccgaagtgggcggatcacttgaggtcagaaatttaagaccagcctgaccaacaaggcgaaaccccctctctactaaaaatacagttgggtgtggtggtgcatacctgtgatcccagctactcaggaggtggaggcatgagaatcgcatgaacctgggaggcagaggttgcagtgagtggagatcatgccactgcactccaccctgggcgacagatcaagactccatctcaaaaaataaaacaaaataaataaacaggctgggcacggtggctcacacctataatcccagcactttgggaggctgaggtgggcggattgcctgaggtcgggagttcgaggccagcctgaccaacatggagaaaccctgtctctactaaaaatacaaaattagctgggcatggtggtgcatgcctgtaatcccagctactcgagaagctgaggcaggagaatcgcttgaacccgggaggcagaggttgcagtgagcagagattgcgccattgcactccagcctgggcaacaggagcaaaactccgtctcaaaataaataaataaataataaaataaaatatggacaatataatacatttgcagcattgctatgaggactaaatgaaatattgctcttaaagtacctggtatagtaggtctggtatataataacgtaatagtcaacgatcatagattttattgtgtgcaggtactgcatgagagttttatgtatattatctcatttgtaactggccaaatagaattatttgattttctcatctgcttccagtctttcacgtctcagtcaagggcatcaccatttacctaaagatttatgttccatatctaggtattttccttgattcctgttttttccacactccactcgtgtaattcatcagcaggttttgccgactctaaaacaaaactcaagtcactcagttctctcaatttccactaccactactctattttaaaaaatgtattggtttggcgttgtggcttacgcctgtaatcccagcactttgggaggccaaggcaggtggatcacctgaggtcaggagttcgagaccagcctggccaacatggcgaaaccccctctctactagaactacaacaaaattagccgggtgtggtggcgcatgccagtaatcccagcaacttgggaggcagaggcaggagaatcacttgaacccgggaggcagaggttacagtgagccgagatcgcgccattgcactccaacctggggaacaagagcaaaactctgtctcaaaaaaaaaaaaaattattattttttgagacagggtctcactctgtcacccaggctgtatgcagtggcatgatcaagtgctcactgcaacctctacctcctgggctcaatccatcctcccacttcagaactgggaccacagaccacagaccacaggctcgtgccaccatggctttttttttttttttttttagtagggacggagtttcagtatgttgctcaggctggtctcgaactcctggggctcaagtgatccacttgccttggcctcccaaagtgctgggattataggtgtgagctactgtgcctggcactgctaccctattttattttatttatttattttgaggggggtctcactctgtttcccaggctggagtgcagtggcaccatctcagctcaccgcaacctcggtctcccaggttcaagtgattctgctgcctcagcctcccgagtagctgggattacaggcgtgtaccaccacacctggttaatttttgtatttttagtagagacggggtttcgccatgtttgccaggctggtctcgaactcctgacctcaggtgatctgcctgcctcggcctcccaaagtgtgggattacaggtgtgagccactgcgccgagccattttattttatttttagacggagtctctctctgtttcccaagctgaagtgcagtggcatgatctcggctcactgcaacctccacctcctggattcaagacattctcatgcctcagccctgggagtaactgggactataggcacgtgccaccacgcccggctaatttttatatttttagtagagacagggtttcaccatgtgggcctggcaggcctcgaactcctgacctcaggtgattcatccccctaggcctcccaaagtgctgggattacaggcgttagccaccgcgcccggtctgctaccctattttaaaccaccactatctttcacttaaaaatctcagaatgtaagttacatgtgaacaggctcggtttattattgctcatagctgcagccccagcacctcaacactcagaatagtatctggcctttctcaggattttgctatgctttgaatgaatgcatgtcgcgacaagcctttgaagtaggtactgttattattcccattttatagataaggaaataggctcctagtggctaaagaattacctaagtttacacaacaaacagcaaaaccaggattcaaacccagtaagtctgactctagagcccactctcttacgcactacacctgcgatactgaactgcaccggcttatgctgaagtcaattattaaagatttttgcgggggtgatactaggagaaatttgagttgaaattccccaacctgataacttttctccaagttttcctgagaacacagctcaagcgcctcttcacagtctcctaggcacaacgatttggtttctcccaagtctctctcatccgcctcttctcctaacaatccagagataatgaactcttttccagcaaattctcctgcttctatccgaaacactcagcctctcctcaacccctctggaaaaaccttccctaatttctcaactctgagggattataacaggcagtacttttccccagttggcagcactactaaaattacttgttttcaatagtctcccctttatcctggctttcccgggtttcatcacgcgcagccaacctcggtagggaaatattatacccaatgacatctgttgagagaccatattcactaatgtttattacagtataataataattgttctattttatcgttagttatttttgttaatctcttactgtgcctaatttataaattaaactttatcataggtacgtaggtataggaaaaaaccagccaggaggccccgcacttcggtgttttctactagctctgcctacctccgtctgcgccgtctccctgactagtttgacccttcgagggccgccgtagtgcgtcgcctccgttgccggggaaacgacccgggacctgggagggagcaaagacgtttcccgccggcgggagctgtggctgtgattgagagaggggttagaggcgggtcccagcgctgccgcaccatggcggaccagctttatctggaaaatatagacgagttcgtcacggaccaaaacaagatcgtgagcagctactactggggaacgcgggcgtgcgaccggggtcctgggcccggctagggcggcgggagccttgaccctctgtctgcttgtggcttcgtggggaccaggggagacaggtccccacgaggggacctgggcgagctctgtgccccagagcgagcgaggactcgtcgggaaggtcctccagcacacacggaagtccgcgtcccttgggtgggcgtgctgggaacagagcctggggctggagccgcggagaccgggcgcggagggagggccgttggctgagagttctaaggcgtccctacacctttcttttaaggtggttggcgtttaaagttttaagtttacagttgaggaaatcgtgtcttaactgtgttaagttacaagttgcgtaacctccagatactgtttcctcttcctggaaatttaagcattgatagaggtttgatccgcttcacacgggtgaggaaaagatcgagcgaattgatggatgtgagtgcactttgcaaaccgtgatgattgagtgcctgctgtgtgccaaggcactttaatctttacagtgacctccccgcaccccatcccaggtcggtggtggtatcccgagatgaggaaattgaagctgaggggccaaataacttgtttatttgcgtttggtaagggataggcagtttttcaacctaggtctgtcctcttactaatgctttcttctacatcacactgcctttgcctaacctgtgcaagtcttctaactattggaagcttgacatttggaattggaagagactttgagagaagagagtgcaggcatcctgggtctaggagggatgaaggcttgatgctggtagttcccaatctaatctcttataaaaatatttacccacttttttcgtttcctgacccctgcaccacctgtgccctttaatgtttgcatgggtgcaactttctttagaagtttctgagacatcacacttcaaagtcatctagcttctgaatgagttttaggatggctttggctggtggcccccaaaaaaaacatcatgaggaaagggcctgagtaaaacaaggaatgtgaggaaaatgagagttttttctgttaggtatgttcagcttgtctttttagattacttttcattagttcatgaaacaaacttcttagcatttttaagataaataggtcctgcctacccagatagatagttcttgggaaaactgcagtggcatttattgtaatttgtaaggcataatcatctaagaataggaatctttagcaacagaccttcgggactgatgtgcactctggagtcatctaataaaacatttgaaaaattttttcttgttacaggtgacatacaaatggctgagctatacactaggggttcatgttaaccaggccaaacagtaagtccaatttactaccaattttaatcatattggaatttttttttgttttgttatgctttgcttttaactctacagatagcctacatagattagagctaatttggtttgctggcaatcattggtatttcttggcttgtagctgcgtaattccaatctctgccttcattgtcatggcattctccctgtatatctgtatctttgcacgtccatcttatatgaacaccagtcatactgaattacgaatccaccctactccaatatgaccttgtcttaactaattacatgtgctataattctatttctaaataaggtcacattttaaggtattgggggttagggctttaacattacctttttggagacatgattcagtctgtaatatggatacaacaagttttgtttattcatcattaatggacatttgggttatttccatattttgactgctatgaatgatgctgttatgaacattcatgtataaaacattcatctataagtgtttatatgaacatatattttcagttatcttgggtatttgtgttagtccattctcatgctgctatgaagacacacctgagattgaatttataaagacgaggtttaattgactcacagttccgcatggctggggaggcctcaggagacttggcggaaggcatctcttcacagggtggcaggagagagaatgagtgtcgagcgaagggggaagccccttgtaaaaccgtcagatttcgtgagaactcactatcatgagaagagcatgggggaactgcccccataattcagttatctccacctggtccgtctttgacatgtggggattattacaattcaagttgagatttgggtggggacacagccaaactaggattggaattgctgggtcatgagataattctgtatttaacattttgaggaactgacaaactatttttcaaaatggctgcgcttcttacagtcctaacagtatatgagtatttcagtttctccacattctggttaacactaacactgttttttccctcagacttctcatggatgaactcttttttttttttttttttttttttgagatggggtttcactatgttgcccaggctggatttgaactcaaggatcctcccgcctcagcctaccaactagctctacaggtgtacatcaccacacctggcaaaaactttttattatgtcttattttaaccatcctagtggatgtgaagtggtatctcataaattatgttgattggcattttcctaatgactaatgttgctgaatatcttttcatatgctgcttggccatatctttggagaaatagatattcaaaattatgcccatttttgtcattgggtatttttggttgttgttgagttttaagagttctttatatattctgaatacaagaccctgattgaaaaattatttgcaaaaattttctcccattctgtggattgtctttgtactttcttgatggtgtgctttgaagcacagacattttttgttgttgttgttgtttgagacaggatgtcactctgttgcccaagctggagtgcagtggtgtgatctcagcccactgcagccttgacttccctgggctcaggtgattttcccacctcagcctcccgagtagccgggactacaggtgcgtgccaccacactcagctaatttttaaattttttgtagagatggagtcccgccatgtttcccatgctggtcccaggctggtcttgaattcccaggctcaagcccctgccttggcctcccaaagtgctgggattacagacataagccaccatgcctggcccatggaagtttttattgctgatgaagtccaatttatttatttttccttttgttgcttatgcttttttaagtttaaattttaaaatgattaaattttttttaatcttattttttttttttttttagtagagatgagatcttgctatgttgcccaggctggtctcaaactcctgacctcaagtgatcctcccaccttggcctcccaaaatgctgggattacagatacaagccactgtgcccggcctaagaagatttttttttttcttttttttttttttgaggcagaagccttgctctgtcgcccaggctggagtccaacggcgtgatctcggctcactgcaacctccgcctccctggttcaagctattctactgcctcaacctccgaggtagctgggactacaggcatgtgccaccatacccggctaattttattgtatttttagtagagttggggtttcaccatgctggccaggctggtctcgaactcctgacctcaagtgatctgcccgcctcggccttctaaagtgctgggattacagatgtgagccatcgtgccaagccaagattttttaaattgagaaataaagttgtatgtatttattgtgtacaacattatgttttgaagtatatatacactgtggagtagttaaatctagctaataaatgtattacatcacacagttattttggtggtgaaaacatttaatgtctaccatcttttcatttttcaagaatatatcatcactaactgtagtcaccatgctatacagtagagctcttgaacttattcctgtctaactgtaattatgtatcctttagacccacatctccccattccccctcccctaaccacttcagcctatggaaagaaaattctgctttccacttccgtgagatcaccttttacagattccacaaatgagtgagatcatgtagtatttgtctgtgtctggcttatttcagttaacatagtctcttccaggttcatccattttgttgcaaatgataggattttattcatttttatggctgaatagtattccattgtgtatatacactatatttcctttatccattaatggacatttattgattccatatcttggctgttgtaaatagtgctgcaataaacatgtgagtgcaaatatctctgacatactgatttcatttcctttggatgtatatccgtagtgggactgctggatcatacagtagctctatttttgatattttgaggaacctccataccgttttacataatggctgtattaatttacattcccaccaacaatgtataagcattctgttttctccatacccttgttgtgttttctttttgatgtgttgcttgtgcttctgacataatatctaagaaggctttgcctaacccagggttatgaagatttactcctgtgcttttttctaagattttttagtttttgcacttatatttaattctgtaatccacttagagtttaaaaaaatcatggttatcactatgtttaagttttctacagatcgtgtgcttgttagcatcattattattattgttttgagacagggtttcaccctgttgcccagatggaaatgcagtggcgcaattttggctcactgcaacttcagcctcccaggctcaagtgattctccctcctcagcctcccgactagctggaactacaggcgcatgccaccacacttggttactttttgtattttttgtagagacggggttttgctgtgttgtgcaggctggtctcgaactcccaggctgaagccatcctcctgccttgtcctccaaagtgctgggattgcaggcataagccactgcacctggccatgtacttgttaacattagaaatgcttcagtcgggtggctgtggtggctcagttgtattagtcccaacacttgaggaggctgaggtaggaggattgcttgagcccaggagttcaagacaagcctgggcaacatagtgagacccacatctttataaaaagtttttttaaaacatgagcctggtgtggtggcatgcacctgcagtcttagctactcagaaggctgaggcaggagaattgtctgagcccgggagttcaaggctgcagtgagctatgatcacacctgggtgacagagcaagaacctatctctaaaagagaaagagaggagagagaaaaaagggaggaaagaaagaaaaagaaaaaaatgctttagttcctacagtaagactatactaaagctttcagattaggtgttagttcaagctaatttttaaatgaatcactgaaatgtataaatattgactatatcttctaggaatcacttggagttgattttttgtgtatggtgtaaggaaagggtccagcatcatttttttgcacatgggtatacggttatcccagcattttataattcatattattgtcttggcattttcttgctaattatatgtctttccccactagaatataaactctatgaaggcaggaaacttgtcaggttcatcactgttctgattactattgctgtgtcagaaatcaccccaaaatgtagtgcctggaaacatcattttattatgcgcatagattcttttgctttggaatttggatagggcacagtgggaatggcttatgtctgttccatgatgtctggcatccccgctggaaagtctcaataactggaacctggtcatctctaggcatctttatgcacatgtctggctgttgattctggccatctgttgggcctttagctggggcagtggactagagtgcttgcatgtggtctatctgtatggcctgggctttctcacagcctggtgtctccaggtagtcggacttcttacatagaagctcagggctccaaaagcttgtgttccagcacaatgtagagccaattgccttttctgactagcctcagaagtcaagcagtgaataactggtcataccagattcaagaagtgggctctacttctcaatgagagaatgtagaagagcatatggaatggaagatgctgtctcagccatctttggaaaatataacatgccacaattattctgtcttcagtgtcaggcacataatgaatgccaatacatactgaatgaataccaagcactatggtttatgtttgttttgagatagagtctcactgtatcacccaggctggagtgcagtagttcaaacatggcttcctttagccatgacctcctaggcttaagggatactcccacctcagtctcctgagagtagctgggaccacaggtacatgccaccatgctagctgatttttttatttcgtagagttgggatcttgctgtgttgaccaggctggtcttgaacgtctggactcaagcagtcctcctgcctcagcctcccaaagtgctgagattataggcatgagccaccatgctcggcctcactatagtattttcacaaacatttctctcaagtaatttttttttttttttttgacggagtctcgctctgttgcctaggccggagtgcagtggcggaactcagctcactgcaacctccaccttccaggttcaaacgattctcctgcttcagcctcctgaatagtggggattacagcacctgccaccacgcctggctaatttttgtatttttagtagagacagggtttcacgatcttggccaggctggtcttgaacccctgacctcgcaatctgcccacctcggcctcccaaagtgctgggagtacaggcttgagccaccgtgcctggcctcatactgtttttttttagcattatttcaggctatgtcatacaacagtaaacctgacagacagggtccctcccctggttgatttaaacaagataatttcagactgtgaaaatgctgtgaaataattaagttgggttagagaaagcggtatgggcaatacactgtactcatcctggggaacattatgggtggaactgatcaggagggaagattaatgaattaaaatgggaagctataattaatcatgtgtaggaagtgtatcttgtaagaagtcatatatgttgttattattattattttttttttttttgagacagctctgttgcccaggctggagtacaatggtgcaatctcggctcactgcaacctccgcctttagaattcaagcaattctcctgcctcagcctcccgagtagctgggactacaggcacatgccaccacgcctggctaacttcttgtatgtttagtagagatggggtttcaccatgctggccagctggtcttgaactcctgacctcgtgatccgcctgcctcggcctcctaacatgctgggattacaggcatgagccactgtgcccagcctgttgtcattcttatttaagaatattttatattttgtttattaaaaaatatttggcttaggctgggcgcggtgactaatgcctgtaatcctagcactttgggaggccgaggagggcagattgcctgagctcaggagtttgagaccaggctcaagctatcctcctgcttctgcctccctgagagctgggattacaggcgtgagccaccacacctggcgctactgaaatacaaaaatactaaaatacaaaaaattagccagcgtgtgcctgtagtcccagctacttgggaggctgaggcaggaaaatcacttgaacctaggaggcagacatggcagtgagctgagatcgcgccactgcactccagcctggcgacagagcgatactctatctccaaaaaaacagaaaagtttggcttaaattagataaaacatgttttaaagactcaaaaagtaggcaggaattctttccttttttttttttttttttttttttgagataggattttgctcttgttgtccaggctggagtgtgatggcacgatcccagctcactgcaacctctgtctcccaggttcaagcgattctcctgcttcagcctcccgagtaactgggattacgggcatgcgccaccatgtgcccggctaattttgtatttttaatagagacgaggtttctctatgttggttaggctggtctcaaactctcaacctcaggtgatctgcctgccttggcctcccaaagtgctgggattacaggtgtgagccaccgcacccagccacaagaattgttttttaaaataagagtttgctttgcattttctgttaatataagagagaagaactggggtcaatttggggagacaagtgcatagaggacaatgactgatgatatgggcaggactattagttgtggataaaagatagtgcatttggccagcaagcttgcaagcattttgggcatggtacctgcctatcatgtcttcctttagcatggtccaaactagcatcaataaaccaaaatgtttgtggatctgttagctcatttatccttctaacacaattgttgtaatggaaagaaacattagagggcaaagaggaggaatcagcaaaaatcctgactagggcacctttttgtactcaaggtgttaacagtctagaggggatgcgtcatatgtaaaataaatagttagaaggcagggtgatatgtgctgtaataatagatatgggataaaatttgttagagcttggatggcagaagctcattgtctaggcatgatggctcactcctgtaatcctagcattttgagaggccaaggcaggaggatcacttgagcgcaggggttcgaggtcaggctgggagatataacaaaagcctgtttctaccaggaagaaaaaataataaccaggcatggtagcatgcacctgtggtcctgtttacttaggaggctgaggaaggaggatggcttgagcccaggaattcaaggttatagagagctgcgccactgcacttcagcctgggcgacagagtgagactctatctcttaaaaaaaagatgtgccctggtgacctgatggtgttggggaagggttcatacttcatagaggaggtgacaactgagctgctgtcttgatgagaaattaggtagttgaggcctgagaagagccttctaggcagaaggaagggcatatacaaaggaataaagagaattgtagaatgtttcattaaggatgaagatagtgtaggtatgatggggaatggtcagagatacagagcccagaacaagaagggtcttacctgtcattgctagagatttgaagttgatccttaggggatgagaagctactgaaagctttgttacacttttttttttctcctccctttttgtggaacatggggtctcgctatattgcccagtcaggtcttgaactcctgtgctcaagctatcctcctgcttctgcctccctgagagctgggattacaggcgtgagccaccacacctggcgctactgaaagctttataacaaggaattatgtttcagacaagactctctagcaaccttttcaacatcaacagtgactaataggcattgcaaatttaatatgcccccaaacctaactcctgacttctcccctcaacacctgcttttcctgcttttcccccatctcagtgaattacagcttccttctttgggttgcctagtccagtcatttttgactcttctttctcttacacttcaacacagtatatcagcaaatcctgttgtttctcactttaaaatatacccagaattcatccactaattactacctgcactgctactgccccaaactgagctaccagtcatctctaggctgggttattgcaatagcctaactggtcttgcttcctcccttgcccctctacagtatatcatccacataaccttctcagatccttctgaaaggtgagatcacattacctctgctctcaactttctaatggcttcttaaagtcctgtggtagccacaaagccctatgtgcctggcactctgccctctctcccctactaccgtccttattccactacagcacactggcctttctgttccttggatcttgctgaccttcctgcctcagaaccttggtatttgctggactctctgcctagaacattgtttcccaagatatccaccttgctggctccctccctccctgcagggctctgctaatgaggccttccctaatcaccttatataaaatagcaaaacttctcaggcaccctctgtcctccttaacttacttaactttgtttccatagacttactgtcatctgagattatatattatatgtttattgtgtgtctcctttctagaatgtaagctctaagagtggactttgctttattcactgttctgtccctaaggcgtagaacataaagtaaccacttggtaaagttttgttgattgaatgacttgatttgcattttttaaacttcactctggcagcatcatggataatgaaggtgaggtggggaggagaagaggaattgatacttggaattgaaatagtctagtcaagagatttggagggcatggagtcaagaattacttgggaaggagagctgatgagacttggcaactcattggataggaagaagtgaagtataatgactcccagatttctggcttgcgtggtttcagcagatgatgttgttgtcagagatggatgaaataaaccgaggaaaatatgtagtagggtgactagccaccctgggtttgcccaggatggttggttttgtcactgaaagttccacatcccaagaaacccctcagacccaggcagacaggaatggtcagtcactctaatacatagagtgaaaaaatagctaaagacagaataccaacagttaaggaaagggaggaggtagagaagtctcttcagaaagtaaagcagaagcagtgagaggggtagcagaagactcagtggggcatggttttatggaagctgagagagcaggctcttcaagaagagagtgaacagcaatgtaggttgagcttctctggggatttttaaatttctagctatgcttggcagaagtatattatagacagattgtaaatgtttctcaaaataaaagacatgtctctttgttgtttttaaactagattattgaagggagccaacttctgatacttgctggatcatagagtaaaaatgaatttagagattttactaaaagcaacattatttctgcatttagtatttggctatctcaggttaatgaattattctgaatactgggcaatgtgagtaagctgttacattctgcaattctgaaccggcattaaatctgagtaatcataaaattggaatttcagagctggacatttgtgatcatatacttagtagttcttaatgttttggagtaattcactcttcagaatccattgaaaaccctcacacatctcccaaaaaagcacataaacatttgctgaaactttaggattggagggttatagatggccacctgaatcccaggttaaaagaatcactaatctaatataaccctcctgtttacgccttgggatattaagaggcctagacaaattaattaacttatccagagcttagacagttaccaaactacttcttgattcagtgttctatttattatgtatcattgccactgttttaatgcaggttcagtccctcttggtctattattaatcttatttcagttaatgtactgatcactgtgccagctccaaacacatggactctactccccatgtcctgtctgaagtccatcctttttttttttcaactgtccataggccaagcaaaaatgctactgttcagaaaatttgatggactaccagatttcatttatcttttaagtcattaattaagagttgatcatgtaaaaactcttactgatgtcttacttgtgccttcttttctttggaataggatgctgtatgattatgttgaaaggaaacgaaaagaaaattcaggagcccaactgcatgttacctacttggtgtctggcagtctcattcagaatggacattccgtaagttctcagagccttgtaatgagcttaaatgtgtttgtgttatgaagagtgttataacatagttcaggggagagaaaaaaatcaagattctgtgttatagtagttttaaagagctacttgatggtgatgattattttggatttttagattaaatctaaaactgagaagtttgggtaatatcttggctgtgatgcagagactgtatcattattatgcaataagatgttaggagactgcttctgttattccctatatctctttttttcctcttgaaggtatatggagaacaatggtgtttaattttccacctgttcaaatttcaaaccatgaatacaagtgttcaaaaattataatttttttaactgaacttcttttaattttgaacattcatttgggtaggcttacgtctaagtgcctgaagggtaagagtttttggcaggagcatagctaatgcagtgcataggctgggaacattttattctccttcctcttctttttgtagtcccacctggtatctggtcatctggcaacacaggtgactgctggatttcatcatcctgactgtaaggctttctcaggtctgcttgacttttctcttaactattttcatgtccctctcaggggcacagggatcattctattactcccatgccttggtggctaccagaagctctgctaagatatcttgttccctctcctgcaccaaactgggccttgggaactttaataattccccctctctggcgtcctcccaaaagtaaggcatacctcttctgttctcacttcctcaaacttcctatctgaaggttctttcgggcataaaaagccccatgggacttggcccaaaggtcaggtggccgcttctcagagatccgctgttttcctctttcctttgattttccctcagaatcataagttcagagccctgatttgtcaaaatattgactggatttgttttttagcgattgagtccccagcatgtgagatttaaaactgaaatgccaggctgggtacagtgccttgctgctgtgatcccagccctttgggaagctgggttgggagaatcacttgagcccaggagttcgagaccaacctgggcaacctagcgaaaccccatctctacaaaaaatacaaaaattagccaggcatggtggcatgcgcctgtagtcccagctactcaggaggctgaagtgggaaggattacttgaggccataaggtcaaggctgcagcgagctgtgattgcgccactgcactccagcttgggtgatataaaataaaactggaacgtcaatttagtaatttacaaggagcaacaaaactgctagagggatcctatccttatactctctagccaacatattcttttcttgtttccaagctatttggcaagccaaatgataaccaagatatttgcaagtgtaaaataagatgtcatttatatctctgaagcaaagttaaacagacgtaactcatttacttgcagagataaacctgcctccagagttctgccactgtagagctcttgaatggatactgtcaaagtttatggctgattgtcatattttcttctgtttccagggtcaactgaccttctgtctctttctctaattagtcagtaccctcaatctagtcatattcaagcctttacttggaaatcattatgtttctttaaagcagtgctttttattctttttttggtcattgatccccttgagaatctgaaagaaaaatgcatatgttgacattcataaaattttgagttcatggatcttctggaataggatccaaagttaagaatttacgttttgagataatgtagatttttactcaaactgacccattataacaggggctcttaatttaggattcttagatggtcttcatggttggtcttcaaagtctagagttttcttagatgacactgaaagtgttcaaattgtgttcctcagtgcatatttccgagaccatttttcaaaatgatgtataacctataatcagttaaaaactaagccatggcttgcttataaaaaggtcttctgtttctaagtataagatggcatttaaattctgcctatctttttttagcagcagagtgctttttcaaacaaaatcttaatcagagttctatatataaaatttattaagagtggggttgctgtggttgaagtggttgtgaggatttcagagccctggacctgccctcccaatagcctcactgggaagctctgtggaaccctgtagaacgaactgaccaaatgtggatgcttacctatgccttttttcccttaaagggaatcctcctaaggaaaggcagattattaagcaatatgatcaggttttgttcttttaattcttctattaataatttcctttttaagtttttagtgcttctagaaagaaaaaagacattacgcagctttgtatggaatttattattattattatatatttatttatttatttatttatttatttattttttgagaccgagtcttgctctgtcgcccaggctggagtgcagtggcgtgaactcagctcactgcaagctctgcctcctgggttcacgtcattctcctgcctcagcctcctgagtagctgggactacaggcgcccgccaccacgcccggctaatttttttttttgtatttttagtagagacgggtttcaccatattagccaggatggtctcgatctcctgaccttgtgatccacccaccgcggcctcccaaagtgctaggattacaggcgtgagccaccgcgcctggacttatttttattttttatttatttatttattttttgagacagggtctcactttgtcatccaggctatagtgcagtggcagaatctcggcttactgtagcctcaatctcttgggtttaagccatcttcctgcctcaaccccccaagtagctgggattacaggtgcttgccaccacgcccagctaatttttgtactttttgtagggatggggttttgtcctgttgcccaggctggtcttgaacttctaagttcaagtgatcttgaacttaagtgatctgcccttctcggcctttcaaagtgctaggattacagaagtgagccactgtgcctggcctggatttttttaaatgtaaataatttttatttttccaatgattattataaaaaatgtttaacaatatatagaacgtgaaagcttccttcaaatctcatcccagagattcttccagaggattatttgaaaatttcaaggaaatgtttggttggttctttttgtaatgtgaagaactgtcaacctgatctatgctttatgggttccctgttagcttttcatctaatgattttagctgagattagttttaatcattgcctaaatcattaattcactaaaggttacaaaatggtgatgttttgccttgaactcctgggtccaagcgatccccttgcctcagcttcctcagtagctgggactgcagacatgcaccaccatgcccagcttattttttatttttatttttattagagacgaggtctcactatgttgtccagactggtcttaaacttctgggctcaagtgatcctcctgcttcggcctccctaagtgctgggattacaggcatgaaccacggcacctggcctttctgtttttttagctgtaatttttctgtgaataattttctctcatcaactagccgtgttttccctgttatgctaagaacagagggcttaccccctcctaggctctgggtttgtggatgctccctaactcccgtgtccactttaataggaacccattgaatcagagctccactctggtctgcattgttttagcaccagctggcatttccattctgttgtttttatgtactttcagtatcccccagggcagtatatagccacacggacctgtctggtctattcagatcttctcatgaggtgcgaattactgtttttagggctcttactgcaaagctgcattggttttgagtggttcattcctaatggtctgtaatttttataataagctctgtaatttttagtgtgcagttttacggaacatgacttttttcttcccttgaataaaccaatgaaaatgacatttttaggagtgccagttttaagagaaaatgcattatgagaacattaataatcccagctcaaacttatggttacactttttaaaaaacttatttgatgtttagattgctgttttttttatgttgtgaattttggtggttccgaacattaacaaaaatatctatttgctttagacaaatacacgaggtttagaaaagcaaaacctgtattattaccaacaatttgattactgaaaataagatttctttgcagttctttgtctgtaggatatgtcctgctaaggatgcacagtcatcctgtattttagaatcacttgaaataattcctcactgtactgaagccaccaattcaatatctagttcaattcaattttttttttccattttgctttcaattgataggttccctcctttcccttagaggtaactgttacattgagtttgccttctccttccattgtttttgatatatatatatatatatatatatatattttttttttttttttttttttttttgagatggacttttgcctgttggccaagcattggagtgcagtggcgtgatctcagctcactgcatcctctgcctcccaggtttaagcagttctccacctcagcctcccgagtagctaggattacaggcgtccaccgccacgccctgctaattttttttgtattttagtagagacggggctttgccatctcggccaggctgatcttgaactcctgacctcgtgatccatctgcctcggcctcccaaagtgctgagattacaggcgtgagccactgcgcctggcctgttgtatatatttttaatataagaaaatatatattcattttgcctctctttgttagataaatgttttcatacgtgcaaactattttacactctgcttttttttacataacagattcagagcatcactccacagcagttatagaaatattcctcattaattattacagccacatagtgccacattgatagatataccttagcttattcagcaatcccttattggtagttgttatttatgatctttggctattacaaatattaatagtgctgtagtgaatagcttagtgtctgtgtgttttgtatatttttgctagtgtgttttagggttacattcctagagtaggattgctcggtcaaagggtgagtgcatgtgtacttttgttggatgttgccaaatatcactctgcttcttgttcccaccaacaatgtatgagagtgcctgtttccatatagcattatgttataatatgttttagggctatttatatttctttttctgtgaactgtctgttcctaccacttgcccttttttttttttttccttttttgagacgaagtcttactctgtcaccaggctggagtgcagtggcacgatctcagctcactgcaacctctgcctcccaggttcaagtgactctcctgcctcagcctcccgagtagctgggactacaggcatgcaccaccatgcccagctaatgtttgtatttttagtagagtcaggttttcaccatgttgacgagggaggtctccatctcttgacctcgtgatctgcctgcctcggcctcccaaagtactgggattacaggcatgagcagccacatctggcctttcttgcccattttctaaagagttgttagtctttgttttctttaattttagaagttgtgtattaaccctttgtgatgtaagttgcagtttttttccgctttatcatttgtttttgtacttacgtttttttttcatttaaaagttgcttttttaaaatagattatttcagttatttctggattttgaattatacttaggaaatgttccctctttcttagcttatagcaggttatagaattcacacatgttttcatgtgcatatatgtgttcttctcttttttttgagaccaagtctcactctgtcacccaggctggagtgcagtggcacaatctcagctcattgcaacctccgcctcccaggttcaagtgattgtcctacctcacccccctgagtagctgggattacaggtgcctgccaccatgcccagctaatttttgtgtttttagtagagacagggtctcaccatgttggccagggtggtctcaaactcctgacctcaggtgatccacccacttcggcctcccaaagtgttgggattacaggcgtgacccaccacacccggccttattttttacatttaaatctctaatccatttagaatttattttggtatatgatgtgaggaacagatccaatttttatctggttccatgtgattatacagtaattcttattaaatcactcactaaaaagcctttgctcacactgatttgagatgctgtatttttttaattgtagtactgaaatctgtgctagatcactttccttaaccttattgagaagttttaagataagcaaattattattttttttcctgaaagtaagcaaattaaaagtgagtctgactttattaaattataacatatgttttaaggagtgcctggtgttttcctaatttcacatccaagcacaattgaattattggagcaaggaaactaaaattgcagattcttacattaagcactaataaagtgttattttcttacagtgccacaaggttgcagtagtgagagaagataaattggaaggtaagtgttttagtgacttagcaagtttttcctcttatggcatcagtgtaggtgcaataaaaaatctgcctctaacatctgcgtataatatatttagctatttaactgaatagcccaatattcattttatgagtagtttttaaagcatgttaaaatatgatactacatctgcctgacttcccatttttagggccaatagttgctgacatttataaagcacttttatcacagaatttcaaaactcgtgacacatgcagaaactgttatgaataccatatgagctacctcatcaactgtgaaaagacagtggcagtttttttaggaaacaagttaaagaatgcttttctggaagtcagaaagacttctaaataacttctaaattaaatttgtctaactgtttcaagactatcagtgctaccgttggattgtttaaaaacccaattcaaaggaatttaataacagtcagggtcctcatgatcttggacctatatctcaagataaaacctgtactgttgtactttgtatataaaggctccttggcctgcaggccccatttcacagattgggactgaggagggtggagggcagccacgccagggacacaaaaaatatgtgtattttaaaaagaaagagttcctgtccatgggggtagggtgggggtattttaccaaatttaactctgaagtattcagagtggtgggtttgtccactttttactttctgaattcccacagtgttaagcaaagcaaaatttctttattctgtagatatgtaatgatgatctactatgtgccaagctctatactaggcactggggacatggaacaagttagctgcaatcccttccttcgcggaacctaacatttattcttgtggtgttcttttgtgtttctcttccgtagacttatctagttagtagtgtttttattacagagttgctttctctaaactaaaattgaaatatataaatgaatattctcagatagaaattacttagtactctttaattatatgctatagtgtaaggctcttttctgaccaaaagaaaaagatcatcgtagtcatcatcaatcattaatatttactaagtgtccactggatgagtgataccctctcaggtgctgtccttagaaatgactcaccaccacctaccttgtcataatgtccccattgcagacagaagagttgatgtttcactgtatatgtggctgtgtggcctttagagttttttggaccaccacagattacaaatgctttaatgcagaagggtttcttgttaaagtccccacatgctatgaagtttgtgtattaactgactgcttttcctgttgacttgtagcagtgaagtccaagctagctgtgactgccagcatccatgtgtacagcatccagaaagccatgctaaaggacagtgggcctctgttcaatactgactatgacatccttaaaagcaacttgcagaactgcagcaagtaagcgtcttaatgttccttgtgggcttctttacgaattgattttgtaagatgtttacacagtggctgcctcttaagagtgaatgccaagtctagtaaaaccccatttatcttgcagtaagaaacatgcctggttttattagtacatcataaggtgaaaaatagcagccacaacccatattgaaaaccccagtggactctccataaatctatttctcatgtatttatcctgtcactgccaccagaaatgtttgtcgtgccctctctaactcccttacccagtctctgcttgtctaaatcctacccatccttcaagaaccagttcaaacgttgtccttaaaaaaacagttcctaatttgatatccctctacttttcatccaaaagcaactttttcttgagcttccatagccaggatcaggtttttttttaaatcttttgtatccttaacagcacaaggaggtaacggactataatgcgtgtacattttggaaattggtggtcacaggcttgatttgtggctttgctgcttagtagcccagtggcattggacaaattacttaaactctttgagctttggtttctttgcctttaaattcaatgtaataatgtctcctttgtggggttgtattgataattcagatcagttccccagacatacattgagcacctactactttgacaggtactgagcaaaatcatttgaattcattcagcaaataactcatgagtacctatgacataccatacagtatagagtgaatgtgcccgcgtaccttttcatgtaactgatgggagacaggcagttatggtacagtgtaagagtactgtaataggaggaatattgggggaagatgttggcaggggcacttatctcccacttttggatggatagagtgaggggacaagactgttatgacttatgacacagaaggttatgatatctcagttgaggcctgaaggcccagtagaaatagccaggcaaaggaaaaatgagagactaaggacagagctaagagagaaaacatgcttgtgcagaaccatgatcgttttctatgggtgcaacttagagtgaaaggtaggaaataattagatagaagactaaagaggccaagcaggaattacattatgctttgactactaggataaaaatttagactctattctgagagcgctggggagccactgaaaatatttaagcagatggagtgaaattatcaaaattgcattttagaaagattgctctggttgcagtattgaagataaatcagaagagaataatctggaggcaaggccatcagggaggagaaatgtggcagtaatccaggtggatatgacagttttctaatgtgaagttgtgctgttggggatggagaagtatgaaggttaatgagtcatgaccatcaaaaaacctcagtttggccgggcacagtggctcacgcctgtaatcccagcactttgggaggccgaggcaggtggatcacgaggtcaggagattgagaccatcctggctaacacggtgaaaccccgtctctactaaaaatacaaaaaattagctgggcacggtggcaggcacctatagtcccagctgctcaggaggctgaagcaggagaatggcgtgaacacggaaggcagagcttgcagcgagcagagatcgctccactgcactccagcctgggcgacagagcaagactccagctcaaaaaaaaaaaacctcgatgtatggtagtggttggggacaaggtgtgtgggggtaggggatggtggaagacagcctttcttggtattgaaaggttgatacccatgcttctggcttgggcagctgggtactaagaaggggaatataacaggaggagcaggctttaggagagatagaaaaatgacaaattgggttttagagatgttgagtttgagaagcttgtgagaaatccaagtgaggatgtccatcgcaaaagataggtgaatctagagctaaggagagaaatctggggtaaagatagagattttgaaatcagaatagtaaatgggccatagcagtagatagagttatcagagagaatgtatagaatgaaagaagggcagaaagtaaaactctaggccaaagtactagttgtctgaccttgggcaaattatttaacctctcagtgcctccctgttcttgtcagtaaagctgacagtagtaccagccagatagggttgtagaggattaaatggactattatatgttaagcacttagaatagcacttggcacatagtaagcactatttaatgatagctgcttttcaagggaagaatagaaaaagaggggcccaaggggagccaccagagataagagtatatggggtttcagcccctaaggaaagaggttcaagtaggaggaaccagtcaacaatgtcaaacaatgctgagaagccaagtaagttaggaagtgaaaattgtccatgacatttagtgatagccttggtaagagcattttcagtggagtgaccagattctggtgagctaagtaaatggggacagaggaagtgagacagcaaatatggacagctctttccaggagattagactgcaaagcagaaaagagggtggtagctaaggagggattgagacgggaaggatatatacatttcttaagttgagaatgacttgaacttgggttgttagaaaggtgctgtaggaagaaaaggttgaaaatcctggggaggtggtatgactgataaagatgggtcctcaaggagagaaagatatagaattgccatagtttctataagttccatgagaatagggatcgtgtctaaattgttaactatatacccaaaatagtgcctggcacactaataagtagttactgagtgaattaatgatagacattagttctttttttttctttagctcaaaaccttgagtataataagcatacaaatatttattaaataaatatatggccaaagaggaataatttacaagtctcttatcttttagggaaggatttcaagaaaatattaacaccctgataagtttatttgaaatatattactagatttcaaaaaattttaaaatctagttgggtattccaggctctaaaaatcagttcccttgttatatctagcaagtaagcaaacaagaataaaagtgacgcaaaagttcaaaatgaaatctgccagggcccactaaaataaacatggcaagtagaaatgtggtaataggaagcacttcagtgaaactttacctaaatacttaaagtatcctcagtagaaaagtgaatttatctccaacaaatgagtttgtatttagtcctgagaattatgggccaactgagatctcacttatgatttcgtgtgttttaagaagtgccgtgacatgaagagagttgaaattttaggattgagcagagatctcttgtcatcagacatactcctagcctaactcggtctcttcctcattgccaattcctggtcctgaccctatggtgtagaattcagaccagaggagaaagagttgtttcaaggccaacttcagacgttgacagtgaaataaaacattactcttttccttgtatatggaagcactgcaaggtcagagaggaagagcagtgggtgaaagcaaatgatttccgtctgttcttaactctgatgcataaaagatgtgtgtaaatacagagttttctgatgaagaccataataaatcagtggaagatttttggagcttttgactctagctttggggctgcccagtctaaagttacttctgagatgaaatgatgtatcagggatttttttttttcattaggccaggtattctagcagttaatcttgaagttgtgcctggttgatcttttaagataattgccatcaccacatagtttagaaatctcccaccccaagttgaaggtgatacactaaagaagggagagaagccagaagcctcactttcattcacttagtcattctttcaacatgtcgtttccagcacttttctatgtgccaggtcttgagctgggtgcctgaaataaaaaagataaataagacttcaaggaggtcttacatatgctcaataagcaagactgggaaaaataaaatatttttctttgttagaaaaagctggggaactttgctttaagtacaatcctttgagaaggctaaatcaattacccattcacaatgtggaatgttacattatggatttgtgtgaaacggcacttctataatgattagagagagatgtatgttccctttaatatgccacacaagctgttccaccaattttcttctcttggccttgggcatacttacttgtccggtgctgttagtattattagaaattattaacaaatggctgtaaaggactataggttataggagccagtggctctgcttccagcttctcccatttttttttgtttttcattttgagacagagtattgctgtgtcgcctaggctggagcgcagtagtgtgatcttggctcactgcaacctctgcctcctgggttcaagcaattctcttgcctcagcctcctgagtagctgggactacaggcgcgtgccaccacgcccagctaatttttgtattttcagtagagacggggtttcaccatgttggccaggctggtcttgaactcctgacctcatgatccacctgccttggcctcccaaagtgctgggattacaggcgtgagccactgcacctggcctcttctttgttttaaagcatgatttatttatttattttgagacagcatctcactctgttcctaggctggagttgagtgatgagctcatggctcactgcagccttgacctcctggattcaggtgatcctcctacctcagcctcctgagtaatcagggctataggcatgcgccactacacccaactaatttttgtattttttgtagagacaaggtttcaccatgttgcccaggcccatcttaaattcctaggcttaagcgatccgcccgcctcaggttcccaaaccgctgggattacaagcgtgagccaatgcgcccaaccctacagcatgatttactctggccaagagagttgccaggaaatttgttaatatttaaagcttagttttgattcagtcaatattgcaaatctagccctatcagaggaaggtctttaaaaacaaaggctatttcatttcccaaggataatgaaattactgcatcttttattattgttggttgcattcctactcttttgaattagaatacttttatcaaaaacaagaatattcaattagtggtagaaggcacctaattccaatcctatctattactaactagatgtataacctagtaaaagtgactcacttctctctaatatttgtttctttatgtaatagagagtttcatacatttttctaaagtcgattctaaacaatattagagttaagtattgtgtggaagaagcaagagtttgaaaataaagttttatactgacattagttttttttttctttttttgttgaaccacccaagaatgcatatgctgacattaacttaatgtaacatttctgtccccagatttagtgctatacaatgtgcagctgccgtccctagagctcctgctgaatcctcttcgtcttccaaaaagtttgagcagtcacatcttcacatgtcaagtgagacacaagccaacaatgagctgaccaccaatggtcatggcccacctgcatccaagcaggtttcccagcagcccaaaggaattatgggaatgtttgcctccaaagctgctgctaaaacccaagaaaccaacaaggaaacgaaaacagaggctaaagaagtaacaaatgtaagtcttctttgaagataccccttcattgcagctcagagtgggtaactagaaaagcattaatggttgcagtggtagtagtttatttatataagattctgatattcagttctgatttttctactttagtttgaaccctttaatacttgatattgttatctgaaagagttcttttgcttttgataatgattctcaccaaaccttggatttcctttgcaaaatggtaatgcctaccttgtgcacattacaagattgttgtgaaacccagatgaaaacatgtgaaaacacctcgagaattgttgacattcaaaaaaatgtttatttgcaatatgtctttctgaggaacatcttatattctgggctttgcaacatataccttccttcctagtgtatttcccattcttatactttatgcaggtttttttgttttgtttttgccttatttgcttctcttagatttttattgttcagtcatctgaactaactcaagggcattgacttaagaaaagtatcattaagatactattttaaaaatccagaaaagcataattattgttgttactattattattatcactgtcattttccagtgtcaagtgtatttaattcagatcactgtcattttcaagcgtctgtcttgggaaagaagaaggatggaggaaaacactaacgtttattgaatttcaactgtgtgccagtgtctttgtttaaatcctcttatcagttctgtgagggagatattaactatttccctttcgcatatggtaaaactgaaacctagacttaagtaatttgcctggagcccatattgctactaaatggtgggaaccaggaattcagatctacttctgatgattaaaaatgtaatgttttaggttttcccgctttgtgtacatactgcctctgatcttttttaattctgtcaaattaaatagtttttaaatgtgctcaagaaaagtttagctatatccatggataattaattttataagatatataagaaactaagctttagagattaacaccagttactgtctggtgtggattattgttctagatttgttcttatatctaacacctacgcgttttggcatgattatatagagactataccatcgcaacagtttgctatagaagagtttgtttgagactgctacttcatgaacagcctaaatgccagcaaaaaatcatatgtgttttctgtgcttgtaggcatctgcagcaggcaacaaggcaccagggaaagggaatatgatgagcaacttttttggaaaagctgctatgagtaagcatgttcttacctcactttgactaacgaatgaatgttaatgtaatgacatattatacctgaagtgaaagccactttgtctagtttttgccaatccaagagactacctgcattctaacaaatttccagtgtactgcccaatatattgatgaaagtaactcagctagaactttatgggtgagttaggctcagttgagatctctttgagagcagtttattattcctggtttaacttcctgccttgaaaagataatgaactatttgcttcatagggcccttgaaaatgggtgattaaaataaaagggaggctgcctggctacgcagtatagtgttgaggttaataacgtggatgctagagtcagtttgcctggtgtgacctttatttcttctatctctcaagggtccacaaaagcaaatattttgcctttcttcagttattttttgcagattactcacagtaatgaattagacttccagtgtgaattagaagggcccaagtagtaatggacatttaaaaatcttttttgagaaagcaaaaatcttctttatttttaaaaagatacttaagtaagaattctttcgtatggaaagaaccagtagtcacatattttcatacttctcatatcaagtgtacatcccctgagagtatgtggtagaataccaggaagaatgcaggagccacaggataattatggcacactttcttggagcatcagttttacaaagatttttcaaggaggcattttgttacatgcctatgcaagcaaaattagttagaattctgcctttccatgatggctaaattggtggtcacgggagggattgaagtgacttttttttttttttcatattctgcttatgtaagggtgacagtttttgtgtttgctgtaaaagctatcagagaacgtttttgtgttcttgcagctcagaatgggtaactagaaaagtgaatggaaaatgtgatacttaaaggttactcggaagcattattgtattactgcaggcacagttggtgcacagggaatgcttcctacttctgttaaaacaggtctccaacccacagtccactgatgggtagcagtccgtggcctcttgggaaccgggtggcacaggaggtgagcagcaaatgagcaagcgttattatgcctgaactccacctcctgtcagatcagtggtggcattagattcttataggattgtgaaccctattgtgaacagcacatgtgagggatctagattgcgggctccttatgagaatctaatgcctgatctgaggtggaacggtttcatcctgaaaccaccgcccccgaccccccaccgccgcccaccaccacccctgtctatggaaaaattgtcttccatgaaactggtccctggtgccaaaaaggttggggactgctgtgttaaagcatcatgctgtcactgacctgcctggctgttatggttttttttaaaaaaatcaaaccatacagaagtatgcttatttaaatcatgtgtttagttagcaaatagattgagcacctgctatgtgcatggcattgttatgcagtggtgatacaatagaggaaaaagacaaacaaggtccctgccctcaagtccttatattctactgagagagatggacaaataaatatggaaaaaaagccaggcatggtggtacgtgcctgtaatcccagctactcgggagaccgaggcaggagatttgcttgagcccatgaattcaaatccagccaaaaatgtagaagacctcatttctttttatttatttatttatttattttattattattattatactttaagttttagggtacacgtgcacaatgtgcacgttagttacatatgtatacatgtgccatgctggtgtgctgcacccattaactcgtcatttagcactaggtatatctcctaaagctatccctcccacctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccgtgtccctacaaaggacatgaactcatcattttttatggctgcatagtattccatggtgtatatgtgccacattttcttaatccagtctatcattgttggacatttggcttggttccaagtctttgctattgtgaatagtgccacaataaacatacgtgtgcatgtaagaccccatttcttaaaaaaataaagggaaaggaaagaaagaaaacatttgaatagtggatgattgtaattgctaggtaggagtaatagggtgttatgatggcatgtaacacggtgagggggaaaacctggataaaataaaatactattaaatattaatctaaaaattgcttacaaagttaatttatttgacatttcttcaaggctgaatgttcagagtaaaattatgacttttttattgtattcgacacatgacaagatcattacaatgaaaatgaagcttgagaattggatgaagagagttcactgtggggacttgaaccatttaaaacttaatactggacagtaacaagtgttggcaaggatgtggagaaattgaacccttgtgctctgctgtagggaatgtaaaatgatgtgtactcactttggaaaatgatgtggcagtacttctaaaagttaaacatagagtttacccagcagttcctctcctagatatctacacaagggaattaaaactgtatgtccacacaaaaacttgtacaagatgttcatagcagcattcttcataatagccaaaaattgaaacaatccaaaagtctgtcatctgatgaatggataaacaaaggtggtatatccagacaatgaaatgttattcagctataaaaagtaatgaagtacagatggatatgtgatatgacatggatgaaccttgaaatattaagtgaaagaagccagatagaaaagatcatatattatttcatttatatgaaacgtccagaataggcaggtctatagagacagaaagtaggggccgggtgtggtggttcacgcctgtaatcccagcactttgggaggccgaggcgggcggatcacgaggtcaggagatcgagaccatcctggctaacacggtgaaaccccatctctcctaaaaaaatacaaaaaattagctgggcctgttggtgggcgcctgtagtcccagctactcaggaggctgaggcaggagaatggcgtgaacccaggaggcggagcttgcagtgagccgagatcacgccaccgcgctccagcctgggcgacagagaaagactctgtctcaaaaaatatataaataaataaataagtaaataaaggttgtcaggggctggactggggttgaggaggaatgctaatgggttcagggtttctttctggggtgatgaaaatgctctaaaattggacagtgatggtggatatacaactaaaacgctgaatgtaaagtgatgaattttattgtatgtgaattatatctcaatttttaaaagtaacgctttatatgtaataaaattcagcattgatgacaaaatttaaaggtcataattggttatctttatttgcttgaaaaggtttcgtgttttcttgagtataaaaaggaaatgcttttaatcagctagaagataggtgacttgatcattcaggtaacaaaaaaagtcattaaattttccttaataattgccttacaatgttgcattaaactacctctttaccagttaattggctattggtagctgcatatatgtttaagttggagttctcaaaattctgtgaaaccaagacagaagaaactctggatgctgaatctaatgtttgatcagtggcattttaattcagatcagttttctgtaattggtaaactcaatgcaatagcctctctttccttaatccataggtaggtaggaagtatttggaggtttttttctcctaatgatgcaatttttaaaacaattgctattaaaacaatataatttatgtgatagattgcaaaatttgcataaattttaaagctacacatgtgactccagtgaactgtattttttggattggctgttgacccctagacccctggagatgcatgtttactcttctatacaatttgggatatttgagaggcactgatacttgagaacaacagttgaaaatgcaagagtatgccatcgttgggaaggtggattccaccattcgcattttccattcaagtcttcaggaaaaagaaaagtataaatagattgcattttacactttggtccatcaactacccttcaaataatacacattatttataaattattgtactaagctatgcataatagcccagactatgataccaatttttttctacactgtagatggtttaagctattatacaacatataaccaaaactacttattgaagcacctccagctaatgacagctttctaatagtattttgtgcctttacttgtgaaaagctatcactaagtacagcgtgaaggctagatgacatgcttctatagttcctcagatggctaggcctgtttgcatttcttagttctccctgctgcactgtagtcattcttcagcttggtgtagggaaagggttaaggactttgaggagttaaactgactttggttcaaatccctactcttttctgtcagtgttacctggataaatcatttaaccaatactgatctcttttaatccttatgataatcttgtaaatattatctcaggtttagaaaagactgacttagataaaataacttgcccagagtgaagcggggtttgaaccaaacttctttgactccaaaatagtctttaaattttatcattaaggtagtagtgagatattaagggtatccaggcattaaaagatagaatatatagaaagcaaaggtcttgctgcaaatcgttgtcaccatttgtaaactgtgtattgttgggaaacatcttgtaatccttctgattcttgattttcctcatctgaaaatgagaaggatgatgcctcataaagttgtatgtgttttttctaagccttgcttttactatcatttagcctgggggctgtgatacaatgagggattagcaggaggcagaaatgaaaagttacagttagagtggtagttggaaaggaggaatgtttctgaatagtccatgagctcctttttgcccctgctcctaacatattacctggcacatggtagactgtcaaaagaatgatgtattaatattgcatgatggggtcatatgtcgtctgctatactttatttatagataaatttaaagtcaatttggactcagaacaagcagtgaaagaagaaaaaatagtggagcagcctacagtgtctgtcacggaaccaaagctggcaactcctgcaggcctgaaaaaatccagcaaaaaagcagagcctgttaaggtgctgcagaaggaaaaaaaaaggtaggaaaattttgttgcttattggggaagagtctttactgggggtgagaaggtctctttgggcttattgacagcaggcagttttcagttaagtactaaatcctacttaatgcctaagggatacaactatacaaccaaaatggaaagagaagcccagtagcttatctagtggagtaggaccgtaggatcagccagtttggatgatttaaggaccaaagtcgtgtttttggccgtattgatctaaattgattgttgatttttgttttaaatttgtggacatggcataagtgtgcctagttgtgtgtgtgtgtgtgtgtgtgtgtgtgtgtgtgtttcacttcaaattgccaaatgaacagttactgtttccagtcaaatttaagagaaaaacttctttgttttctttttatatcaatgagtttatttttcaagtggtaaaatgtaattagaaaagaaaataaaaagcacataaagctattaaaactagatccaggaattggagacactacctcatagttggtagaattagtctgctgaaagaaattctaaaggacactgtcaacactgataggcctagaaagacgacttttgtggcaagtttgggactactctcgttgaaaacatcaacaaaatggtgaaattttagagggttaaagctctgtccagtgggcctcaccacctaggaacatatgacttgtatggattaaaatgtccacaaccatgggtacgtcactcactgttgatacttattgccagcagtgcattcagtatttcactactaaatgtgatgataaatgtagatttttaatagatgccgttaaccagattgaggaagttgttttttgttccaagtctgctaagaggttttatcatgagtgggtattgattttggacagatgcttttttgaattgattggatgctcagatggtgtttttattaatgtggtgaattacactgattttaaaatgttaggccaaccttgtgttcttgggataaactccacttggttatgatgtattatccttttttatatattgctggattagatttgttaatattacactaagcatttgttgcctgtgtttatgaggtctacaggtcagttacattcttttctggtaatgtctttatcaagttgctgtgtcaaaattgtgctaacttcataagattactcatgcgctgcataacgatgtttgggtcaacaatgggctgcatatatgacagtggtctcgtaagattataatggagctgaaaaattcccattgcctagtgacatcatagctgtcatgacatggtagcgcaacacattcctcacgtgtttgtgatgatgctggtataaatatacctactgtgctgccagtcatgtgaaagtatatcatatatattaatagttatatatacataatacttgataataaaaatgactatgctactataattactgcactatactttttatcattttagagggtagtctttctacttataaaaaaagttgactgtaaaatagcctcaggcagcccttaggagatatttcaaaagaaggcattgttatcataagagatgacagcttcatgtgtgttactgcccctgaagaagaccttccagtgggacaaaatgtggaggtggaagacaatgatcattgatgatcctgaccctgtgtaggccgaggctaatgtgtgtttgggtcttagctttcaacaaaaaaagtttaaaaagtaaataaaaaatttttaaaatagaaaaaggcctatagaatagggatataaagaagaaaatatttttgtacagctgtacaattttttgtgttttaagctgtgttattacaaaagagccaaaaagttataaaattgaaaatacagttaaagtaagctgtttattattgaagaaagaaaaacattttaaaataaatttagtgttgcctgagtatccagtgttgataaagtctacagtagtgtacagtaacatcctagggccttcacatttcactcaccgctcactcactgactcagccagagcaactttcagtactgaaagccccattcgtggtaagtgccctatacatgtgtaccatttttaatcttttttatacagtatttttactgtatcttttctctttttagatgtttaaatacacaaataccgttgtgttacagttgcctacagtattgagtacagtaacaatgatgtacaggtttgtagcctaggagcatagactataccatctaggtttgtgtgagtatactctgtgatgttcacacagtgaagtcacctaacaatgcatttctcaaaatatgtccctgtcattaagtgatccatgaccgcagttgggagaagtttcctctgttttctgaaggagtttatatatacgtgtatatttttcaaatgtttaataaaatttaccagtgaatccagggctggattttatttgtgggaaaggtttttattgtgaatttgatttaactagagctgttcaaattctctagttcttcttggatcagttttgactgagttgtgtttttaaaactcagtcaaaatttgatctaaattgttgagtttattggcataaacccgttcattatataactttattcttcgagtttgtagaacctgtactcgatacagatttctttactgtttcattcctgattgataatttatatttttctgttttcaaaatgggttttataaaaggcttattaataaaattaatctcccaaaaataacaactttggctttgttaattttctcttattttttatctcactgatttctgctcttatctttattgtttccttttactttgggtttaattgttctttttctagttcaaggtagaaaggaaagttggtatttaaagttatataggacataaggtacttgatggcaaagattatgtcttgtatatatttgtttctctaacattcagtaggcctttgataaattacttgttggttgcatgaggagtgtgatggagtatccattcatccagaggagctaaataatgtcatgatggagtctaggattttttttattattattatgtcattagaatcaccttaaaaggatatctctgcctttgctcatattgttctttctctttaaaatatgtttcccctttctacatgatgaacttctacttagcttttaagttttccaaatatgaattatattccataacattttatttgtccagttaaatctaccacattgccttatagccagtggtgtttgccagagcttcttgaaaacagtattttcttctgtattgttgcattctcaatggctagcaaagagccttgtatgtatgtagtagctgcttatttaatgcttgttggataattgaaaggccaatcagggaagtaagaaggaatttggaaagattcttgataacctggttgtagcttccagcagtctctagagaactctagaacttttttattcaagtcacctcatgaagtgacttagttgtggtcagttagcagagtatccttaacaagagtccttcttggactatttggccgtccttttctaccctctggaattaagaccacgagttataaagcaaaacccataagagcatgtgaatacttacatttttgttctgtgtaacacgcttaatttatttctggatggcaacagggggaagcgagtagcattatctgatgatgagacaaaggaaactgaaaacatgaggaaaaagaggagaagaatcaaacttcctgaatctgatagcagtgaagatgaaggtgggcattaccattcattttgggttagggggatcaattttactttcaatgttcaaggagctaaaaaagtaatggattaaggatcacaatgagagtagtaattctagcattaagagacaccatagcacctctttctgtttgaaatctgcattagccttttgactagaaccatgatcttttggaaatttgtcaaaataacacagaaggaaagaggataagaattattattatacatattatctaagactttttcttttcttttcttttttttttttacttttaaggggaggatattcctttagctaccttcatgtgaatcttttaaaaattgtgacgttctaggcagccagggtattactggtggtggtccacacaggtaaaactagggttaactggaacaacctacagtgtcattgttagaagggaatgacactgtggacccttctagttttaggctgtgggcaatgttgtaagataagcaaacctcataagggcaagagttttaccgggaacattaatatgcttttaaaaaaatatcaagtattttgaagagccaagatcttgccccaaattgtataaagtatatagaaaaagaaggaggctaaaaagaaagttaaatgggttgaactgatatgctggacgactctaccttgaaaagcccactttgagacacagtggtgaaaagtttgaactgctctaatcaattgtccatgaattcatggcataatgggtataaaacattttaagtaatgaggggaaatctagtccaaaggatttcagcatcacataaagatacagagacaaacacgaacagatactaaaagggagagtaaagaagaataatgaatgcaaaaaaggaacctactgagctatcaaaggacaaacttgtaagattctgaaacttgtaagattctgctttttccagaaactactctaagaggaattgaaaatggtaagagaggcttccgaaaaaaggatattagctcaactatacaagtgagtgaaaaaaaaacaaattatatatacagttgacagtaatgcaaaagaaatgaacagacccaagaaatagtagcaggaagctgaatctgtgataaaggtgtagcatctttgacacttctgtggatttagattctaccattcatgctatgtgtttagaattacagcctgtgatatcctgtgagaggtacaatgtccttccgtgggttttagtggctctttagaatgggtaggagtaagacacgtgagcatcccagagaggcaaatgctgtattttcattccattgtcatttatcaaaatgctttggccaaggctgctgaaaggaacaactccatgtagacacatgggaaaataattaggaagtaaatgtaggaataggtgctaattggaacagtcttccctatttccaatcagtaaaagaccttgggaagattttggaaaggtctttgaagctatcaactagatactctagtattagtaaaggagtcagttctaagttaaggaatgactatggttggttgagcactcattatatccttctgaaatattccctatagttctgatctgtagcctacaaaaataatactgttgggtgattagaaatgtgagtggggttatttagttttgaaaggaatgtgaagaaatgcaatagaggtacacagcctataataacagatgatatagagcagaagctcttagatttttttcctctggcaaagataatttttggcatctgactaaatttataaacctctgacattttattcttaaatttcatctttgtatcaaagccagtgggattttattttcaacctttacacagtctttaacttattattgctttatttctgttacactgaatatgtcatattagttcaatatgctgtcttcagccagaagttagaaaaggaacagcaggagtagagaaaatacaagaactttggagtcaggcagacctgggtttaaattttaccttgaccacttattgtgtgactttaagcagattagttaacttgtttaattccttgtttttgcatctctaaaatggggatttttatcacagatggtataggctttttatgaacatgaaataagatgatgtgtcagaagtgccaagacagtgcttggtacatggttttcttttgttttgtcttgtcttttttttttttttttttttgagacggagtcttgctctgtcgcccaggctggagtgcagtggtgcgatgcgatctcggctcactgcaacctccgtctcccgggttcaagcgattctctgcctcagcctcctgagtagccaggattacaggtgcctactaccacgcccagctaatttttgtatttttagtagagatggggtttcaccatgttggccacgctggtcttgaactcctgaccccgtgatccacccgcctcggcctctcaaagtgctggaattacaggcgtgagccactgcgcccgtcctgtttttttcttttacctgtgtctggaaacaagttcagatagttttcttattactcactctactcttcctgctgaggtgcccatacttgcaagtaccttcaattttttcagaaaattcccctccacttctgtttgtaactttctacccaagggactgttcctttctcttttacccctgcggggtcataagcacctgtagtactatatactctctttttaaagcaaaaaaaaaggccagacccagaaagaaataacattaagaataacatctacattgctaggagaaatgtagttttaactgatatagttaagtctttgctaatattttcagtccttgcaagttgcttatggagaatgttaagcaaatgatccccatttttaggtaaaggtaggtatttttaaaaaatagtcctaggaagctgtgaatggtttccaggaattctaattacctgtctctgccagagaactctttgacacactggatctctgaaattagtttcattgcagtttttattctgtcccaacaaaggttgctttcctggaataagtgatatttcattacttaccttttgcttgaagagctgcagattggctacaaatctgtttaaaatacaccagtgcattggacattctttatgtctgtgtcagtaaaaatgtattgagtggggatgtttggcttggtaaagactaaggcagacagacatatattctagtacatgaatggcggcacgtttaaacaaagcagtagatatttacaattttaaaagtcagataaaaatagaagttttatgatagatgataatctctactctctggctcatctaatttgactgatgcttcttttgtcaactttctcccatctgccttccaccttccatggatttgttgaaatttcttaatcattaaggactcttgactctactattctcttccctgtttgggggagttataatgttttactcatttattatcaacagtgtttctctcagggagtgtgtggaaggaagagagagatatatgttgtcttccttgacctggatgttcctcatcccaaatttagttcagaaagtggtggttttcctttatttaagtaaatacacacacacacacacacacacacacacacacacacacacacacacacacacacacagttactctatgtttatgccagggaaatcgtggtgtctctgcctttttggagcttagagtctagagtggggatctagataaacatttgcctacagtgctgtgagagaggtcttagagggtgtcactaggattgttttctttggttaagtcaactggtttcagaactggaaatagaataagaacgcctaagtttattactgtgagtctcaaaattcctttggcttcctcattgcctaaattttcctcctcccattataacacatctaccattgtggcccagctttcttcatagctgttccttcagaacaatggaggcttgcttctggggtttgacttttctcttgcctgagctcccatcatgttctagcctcccagagctggctaatagccggaccgctttccttttatgtttctctctcttgtttcccagagcttataaagtttttggggcccattttatacttaaagtgtgtaatttattgttctttctggctcttgttctgcttcacctctttaggccatttggccttgaactcttcactgtcataatttttaacactgacctaatcagttgggagaatttcagatccaagacttgtgttaagaatttgaatacagccaggagattcagggagcaggtgaggctaagtcgctacccggtcccctgaccagcactttctttgtggtgattgagtaataggtcagttgaggatttttacttcccctctcatgggctgtttactaagaccaccaattctgcaattgttgagaaatgatgggatccctctggtggtgctcatttcttgggtgatgccacttccacagcagtatttttttcctaaaagtgttctttcctgttaacctcactgtagcagaacaaaccttatcagtgaagcagtcactagaaatatgcaaaatattaagtaggtcctagttgtcagagcttaaataatgataattgtttaaaagatgacttcacccacctccaagtttatactgttaacatcagctggaaattttcagtctaagaaacatctcaggtgattaaaagtaacccttaggtcacagtgaaagactctggcatggaacatttgttataacctgaggattatctccacatagatcttgagagataatgtcttgtcctcaatggtaaggcggcatgggatagttggaatagcaaggctgtagaattggattgacttaggcttaaaacctcctgtctcagttataagctgtgtgaccttggcaagtttaggaacccctctgaacctctatttactgtaatgtgcaaataagaaaatctgtctcttagagttgttgtaagaataaagtgaaatacatggcatatgaaaggcgataagtggatatttgtaaaccaacttcataacctgactagctataaaagaaaatatttagctaagatacttccggctgtaataattcttgattctctgattttatttgtataaaattaataaaatatgtattttaaagataactatataactacagagttcttggttgtcatgaattactgcttgctaaatcccctttgctggacatgtcaatttagagaaccaatggagaaggctttataccagatagtgcttgtagttctctgatctaagtccgtttcattatttcagtctttccagactctcctggggcttatgaagctgagtcaccatccccacctcctcctccgtctccacctcttgaaccagtgccaaagactgagcctgaacctccttctgtcaaggtaaaattatactgggattcttgcatgtccatgcatcctttgtgtcttaaggacctacaaccactatgctaaattagttcccttgctgtatacttcacaaatgccagtagatggctcttgtctcattctgctgtcctacaggttgtacagaatgggcgttccctccattcttacctgaagggagattttgctagtgggtatagtctcaggaacgttgcagaggtggaacctgggagctgttctgttttcatgaccttcagcatctctgctgtgctgtacagctcctgttagaatggtgtaaaaagagatcccccctgcatcagagcaacacgtgaaagacagaggggaacaaacaacttaacacacgtttgttgctcttcagaagcaattctggaaaagggctggatgggaaaactgtcaaccaaaggggaaatatagctttgaacgctcttcagctgcatcttatctacacctattagtgtagataatgaagagttgaaaaaatagtcgctgacaatttttttttcctttgtggctgttagtttttcttaattcattgtgttaagaccatcatttaaatcttacgctgatttcctcattagctgaagagaaaatgggacgaaagagaccagtggagataaaaggaagttgatactagtaatacctattttgagactaaattagatagctataatgttgaagtgtcaaggctggccaggcgtgttggctcacacctgtaatcccagcactttggaaggctgaggtgggcagaatgcctgagtccaggagtttgagacctgggcaacacagggagactttgtctctactttaaaaatatctgggcatggtggcacatgccttttagtttcagctacttgggaggctgaggtaggatgatcatttgagcccaggagttggactgttgcagtgagttatgattgcacttctgcattccagcctgggcaacagagccagaacttgtctctaaaaaacaaacaaacaaaaaaagaagacaagaaatgtgaaggctgacatagcaagtatctacagcaagggcatatgccacagaaatccctggtgtggtttaggggccatccctgtgtactcccataatatctgtctcagccctcactacactgtattgcagtggtctgctttccttctctctctcctccactaaggtccttatcctatatgtctttttaaccatgctgcctgcactacccaacaatagtttattgactgaatgaacagaacacagttctttcttcagcatgctactttccttcttatgaacaatgaagtatcaagcctgtgtatatagtgggcgtaacttgtctgtgtgatggggttggttctctaaaactaatgtagagtttctctttcaactttttatcataatggagtattggagagtgattagtatagatttaaaagcttttgttatttttctgtataacataattgatccagcttaacattgtatcctctgaccttttagagctcaagtggagaaaacaaaagaaaacgaaaacgcgtactaaaatctaaaacttacctggatggggaaggctgcataggtaagacaaatatttggctccaaatccagagatagaatctcttattaccacagaggcaccataatcccttttagaacaggtacatctcaaactttaatttacatgtgaatcatgcccaagtggtactgatgctgtttgtctatggcatacactttgtgtagcagagtgtaagtcagaacacctaggttcttgtttaggtcatagactataaaaataagcactgagatcttggctaaaagttatgtcgtccctggtgaagagtttcttatctatggaatatctattttgcctaaatgtgcagttatgaagattcaggtggcataaatatatccaaaaacaagatggaaaccacagtatgggcttaagatgttatcatagacattgagaagcttttttttttctagaatatttgtttttataaatttgaacagtggaaaagaagctacagatgattagactgtaatcaagagtcatctttggtatttggttccatttgttcttcagaagggtatgactcatcgagattgcttcctttatgtttcctatttgtaagccatgttaggtaaaagcatgtgcttgttatgaaggcctagggaggaattagagttcaggctttgagtcattggctagttcttcagccatgttttagcttcttctaccctttccataatcacactagacttctgtggagcttttaagatttagcacttgaggtttgatgggatgctcagatcctggtactgtatttttgtgtttgaaaagagttgtgggtttaggctcttacctttgttagttggatagcccatggttgtcattttgccttttgtggcacctgctacagcttggatcttcagagaagattattttccctgttactgatttttttttttcctagttcagacttgttttgaaaagattggctctgaagaatcaacctttccaggttcttaaaactagtgaagacattttgtcatctgtgctccctgtcccactattccccacctcccagtcctctgaaaaggcctctgccattttaattgtaacatgtgattggggagtaaaattctttacgtgtggaaattctgtcttttcagtgccaaatttcttgtgaacctgtgaattctggactttgaatgggtttttttttttctttttcttccttttttttttttttttggctttcagtcttttaatagttgccattttcaagcctcttggtttggccatgggtgataatatatgtgtttactgttgaatttcttaattcaacagtgcattttttaaatttaagaggacaaaaacattggtgccagttttttcctcctctttctgccccaaaagaaaaaagtcaaacgtctttgtgagagtgagagttcattgggaatttgtgggtaattatttattgctttgtttaaaatatagtactcgagttttggccaggtgtgtgatgtggacttttttgcactcctgtctccagacaggactgttaagagccttggatgcagcagtgaaaactgtgctcacattgcacttttttttttttttttaaaggtttttggtccaagctcaacctaatgaatcttggctttggttaccaacaaaggagttctgctttcctctctctgctcagactgttccaaatgtaccagcatagggggcttgccctgtcctgtgctggatcagatttgttctatgggtttagaaagctcatctttctctctttgtgactttgcagcagaaattgggtagttgggcccctgagataagtttggagtagacttctggacaagggaatgggtttctaagagcaaagcagttaagtggaaaagaaatctgatgttacccacgaaaaccaggtttgtttgcctttttttaatggcaacccagaaaagtggcatgttgttcagctaaaataaaggccctatatttttaatggagacctccttttttctggggtttgcggtagctacagctttgaatatagaaatattccttttagttcttacagtatactgaatatgctgctaaagaaattttgttggtgctgccctgactgttttttaactcccctgagcaatgtctcacacaaaattggcaatgagacagccattgatttcattaataagtaatgaaataatgagctaattgatgctgaagtataatgtagacatgctgccatttgagtacagaatatagcttatgaaggagcaaagtcttataccaccaactagtagaaagtaatttcctttctgtatctgtagatggctcttcagacttttctaatttaagatattgaataaataacagctcgtaattttgtcccattaattcagttacataatgcttttgaagatgcatgtgagatggaggtggtgttctggggtctaattgctgaacgaataggtatgccatgggaattctctaattatcttagagcaacatttctcaaactttgccggctatgtgcattacttgaagatcttgctaaaattgaaattctgcatcagtaggccaggagtgggaactgagagtgcattcctaataagctcatgggagattctgttgcctctggtgtgcggagcacaatttgagtagtaaggcctttcagaatacttaatatatatctaaaatttatcagtattttttagcctctaagtgaacatcaaagtgaattctgggctcttacaaaattaaagacaaactctgggaactctctgggaagggattgttgattatgcagccttaatgggattagctggataagagggacggaatgctccagtggcaattgcacttcaacatttaaaacagggaaggagagaacattaattcccagagtgtggtccccagaccagcagcatcagcattatctgggagcatgttagagaagcaaattctcaggtcccaccccagatctgctgagtctgaaacttgagaaacagaatctggcaatctatgttttaacaagccctccaggtggttctgatgcacagtaaagtttgagatgatatcttaagtagcagagtaggtattgggacacacatacatttgattccaaagcttatgcctctagaacaatttgatatattttattagaaagaattatcaataaaagctcaagactgtcattgttctttaatggaaaaaaaaaccttttactttaatcatttgagcatttattatgcatattaggttacgcttttcagctaagaacaagctcttttccttcaatgtttctctatcgcttgctgcaaccaggaaggctgagaaagaatttagatagcattggttatacagctgccacagctctctaaaattacagaaaggtggcatgctgtttcttgtggttggtatatgtgttgcagtagtgtagatcctcctcggttatgtgacgtcatggctggaagccactatctgtgcctgtgtcctttggggcttgctcataatgactgcttactgttacagttcttttccaagtttcccttgggaagggttcagtgagttttaatagcaggggaaaagcaatttatgccttcggctgatagggagtaagaaaactggtaactttgtttctcaatttatcactgtcattcctttaacacgtgtgtcatccgatagcatttgcttgagatagttaaccttcatgatacagactactactaaattttgggttaatttgcagccattaagaactaagaaccgaacagttgagtaactaatcttcaattctctgtacctaggatgtgcagagagtgggtggcatcaggttagagctagacaggagggtccatggtgaccttggttaaacagaatggaggcaggcaaataggccagcagtttaagaccagtaacgggaataggcaggcattgtaggtcagagaggtgatacttaagaagccagtcaaagcatggagttagaagtaagtgtttaagatatagacaattcggatatagagttcaggaagttagccagcataggccaggacccaaataaaggatttaggcaattcactgataaagggccatttaaaggcatgggatatagctgtgagggagaaaagtgaacgttaattctaagcatcaaatagagactgtgtgagctcaggatcccacatagttcctaccttaggctagatctgatctcccagtgggagaaagattgagtcctaagtaagcatatttgccttgatcagagtctgaaatgattggggttagcaagacatcccattttcttcatagagtaaatgattcagcccacccatgttccatttttttctcatcctaccagtgactgaaaaagtctacgagagtgaatcctgcacagatagtgaagaggagcttaacatgaagacatcctcagtacacagaccccctgccatgactgtgaaaaaagaacccagagaggaacgaaagggccccaagaaagggactgctgctctgggcaaagccaacagacaggtgtccattactggcttcttccagaggaaataaactgccatctctggtagatcagagacttggagtggtcaagggagaagaccaagaaatgtactcctcacttactatgtaagttcatctagatctccacctcacctgtatcaaaagactgttctttcatcctgtgaggtttatactatttctggtttttaaccaaaaggaaatcatctggaagcaggaggcaaaaagctgttaccttctaatgacatttaaaaagcacagtctttgacctgtccaggagaaggatttactccaaaattatactggaacagttttcagaattctcactgaagccatttagtggctaacccactgtgctccactcaccctatgccctggtccgcatatggcacaggaattattccttcttgttcctctgtattctaagaattcatgtgggtgtttcttatccttacattctgctggatacgtttacccctcttgtcttcctgcagtaccacacttctgtcccctaacctcctgaggctgttctctgtaagtcttttaagttttggttggactaaaggctgaagtgaaaatctccctgtaatcctcttcctccattatgcagtacacggacacctggctacagaccaggacgtggcttgtgttctgttcctttcacaaaagctctctgggaccttcacttgcaattagtggttagggaaaagcctcaggcagaacacaaatagaaatttaatgatgtgttcaactccaccagaaattacctcgagtcagcattgacgatattggaggagctgccgtgctgctgatacggggtgtgctttatgctgctctttgcggtttgttgatcccctcctcccccactctcaatacctagagagtgaaacccgtacaatgagataaagactaaaaagagaaatcccttcctatatacagtgtgctacatttacaaaaaatttctccttaagaaaacagaatattcaaaaacagcacttttccaggaagttagtgaggaagataaggcacacatttatttataaatggatgttgctcctttgtatttttagcttccctatttgcttaaaagtacaggctccctaagagaggatggagagggagagactgaattgttagtaggtctaaacatcaaagaaaacatttttattagttacttatggaaaatcatctattacaatgataaccttcaagtgacttccattatggctggacaggcggtgagctcagtggattgcagtggtgtgctggtgattttgcacagtgagctctgcggaaggggtcaggctcaactgctgatgtgtctcacacgtagcagacaaggggtgtctgactggcttcttttgcctcaagatggtgtatgtcgtaagtgatgcaatcagctgtctgctttttaaggttgggattgtgctgactttgggattaacatgagcttctttagcaaccaagcatgaacttgattaagaccagaagtttgggagatgagtcctggcattatgtctaggactaaagcagtggctttgtatagcaagctgagtaaaggttgacatattccaaaacccttctttttaaaaggaaaaaggatggagagaaggatggaaagcctggacttaaacctttagaaaaaacttctggagagaaatcccttttaaacagttacttttgtcattgcctctggtcatttgtctaaataggaatggaaaattaaaagaaaagcaacaatccaatcttttttctaaaaattatgctggggtctcgactaaaactgaatttgaattggaaaattctggtgttggttggagttccatcttgcaagggataatacaaatcctatgatctctatgcccaatatgctgcctcaactctgagctgtctgcaaggcttagtaagtattgagtggtgttttttttttctttttatacaataccatgttaaccacatgagttaaataaatttgagaagttgttttaaaacagtgcttcaaactgagtatctgatgagtctcttatttgatggatggtaacagtgttgcaattatttaagctctgaatgggaagaaggctggttttcagttgatattgttaaaactgcatacccacagtctgagatgaacaagttatttgctgccttcatcgtttttttcagcactggggaaatgttagtttcagccaacctcattttttagttcatctagaagaaaatctagcacattgtattagtttggcttcatcacttgctagctgtatgactgtgggcaagtttcacagcctcaagttctttatcaaaataaaactaaaatgagttaccaagggtgtcaagactaaagtcaagtgtatgtagcatgaattcggtccatgttggcggtcacatacgcgctctacaaaatggtggctttctttctgatgtcataagtgatgtaatcagctagcagcttcctgaaatgttatcagttatacgacccaggtggtatattcttcagtcattctggctgtacatgtagtaaaaaggggaagatagttgtcctatttcatgaaaggtttaaagagagtagatattttcctactgaaggaattatagatgcctatatttactgttcatttattgtgtatctactatgtgtcaagcccatgacctggggactagaggatataatagaaaccatagaatttggcacttgatcctcacaatttagtggaagggaaagccagtaaaatgaaatgacagtgccatatgtgagtgcaatgtacagggtcctccaagagttcccaggaggatgggtatcaaggcagtcttcctggagcaagcagttctttgaatgatgagcaggatttcacccagcaaagaggaatggaaatgactttccaggcagaggagcatggcttttgggagaggtgggctgtagaacttgagaatagggaggaaaatgtattcagaaatgaagttggggccttgctaagcagtttggatttgatttgtagataatgggagccaactgaagaaatttaagaagagtaacagaagttggttctcagttaagagtgacagccagtatttactttgattttgtatccatgatagtatttctacccttgcatatgcacattgtatcttaaaattctagcgggattaaagaaaaccatcttggttaaaacaaggccgcttaattctggcagtcagcatagacaattgcagtgtttcccttgtcttcccccgtcaacatagatttctgtagcagaatcaattttttaaagtgatttcaaaagctggtatttcttctttgacactctcagtgatgagcctccactcacctccctggaaaaaactgggaattcaggggcagagggggctggtaaacgagtgaaacagttctctattccttttctatctttgtttctttaagaagacattagttattatacaggagagggctgaagagaagggccatataaggaaactaaatagtttctccaggacatgagtagaatgagtgcctaataatgtatttgccagaaacgtactctgtgtcaagactcgttttggtaaacttgtctcctttcattggttccaggatctcagtatgctgtaatgcagcttttaccaccatgaaacattttggggctgcctcgttttgttgtgagaaggcagtattgctttctgagttattgccctggcagctctgtaaattagcccatgctgtcaccatgccctctctgaagggcacattgtacccaaatgactgcatttaggattgactcttaccactccctgctgcatgacacttttctccacttgtatctgtgtccagttttttgtgttcttaggtgcggaccacccacagattaccacccaggctctttagccagagaaacttggtaaggcttctgatccaatatttttccattggatcagaatccaccttaactctacaattccccttctacttcaaacccttaatgttttctgaacacccattccccttaactgttctcattttctctttccagactccatgtttcttgaggtttcaccttggctccctgtacctactttcttaatattcagagttcttcatggctggttcttcagcttcattcttttggtgttttaggctttctcaaggctcttcatggcatgtcttttaccggactgctcttgaagaatggaaaaactactttgtttagtgtctgtttgggatcagtcagatccaaagcataaagcagttattggaagctagttatgtttagtcctggataaaatactttggggattgtaagagcccgtaagttaccattttggagtgacaagacaaacatactaaatagcatttagcatttgacacaatgcttagatgagtgatagacatgggacttaataatttaggaatgaattaggataatcattatgggcaaaatattatattcctatgcaaagaacaataaaagatttaaagaaagaaacaggctgaggtaggctaaccattttattgggtgttattcagctatttgaacttcacttgccacttgtacattcacggtgtaagtaaaccatgatttagtgaatctttaattaatggagttatttctgttgtgctttaagcatgagagtattgacgagaaagcaagcagttatcaggaattacttcaaaaggcagtttatacaatataaagtctgtataggctccactcagttttgtacacactcaacaattttgacctactagggaggcaggatgccgggatggaaacaacacaggctttagagacagagggcactggatgcaaaccctgtctgaggcactgaccttaagcaagatatgcatcctctctgaacttgtttcctcatctttaaaaatgagctacccacctaccttaaagcgttgctttagggcgttaatgaaataatgcatgggcagtccccagtattttgacacctattaaactaatacaaagcagagtaactcacatttacctcttttaatcctcatagcagccctgtgagataggtacttttattcccattttgcacatgagaaaactgcggcaaaggggttaagtaacctgcccaaggtcagagccacgatataaatcatgacaatttggcttcattgccctcagtcttaaccactgtgctatattgcctcttggctatgtattagttcatacttccataccgcccagtgatgattgatgttttttttttttttttaagacagagtctcgctctgtcacccaggctggagtgcagaggcacaatctcggctcactgcaacctgtgctttctaggttcaagcgattctctgcaacctccgcttcccaggttcaagcgattctcctgcctcagcctcccgagtagctgggactacaggcgcatgccaccacacctggctaatttttgtatttttagtagagacggggtttcaccacgttggccaggctggtctcaaactcctgacctcaggtgatctgcctgcctcggcctcccaaagagctgggattacaggtgtgagccaccgcgcccggcctgattttcatttttataagtgaaagtgcagctggttgttgagatccaagattgtcagatttgaaggcaatcttaatgcttattcaaatcaacctcttatctgatgtctgcatcttctctgcagcatccctgccaagtggtctggaatctataaacaaagattcaattatgttcagtataccatacttaactaaattacaaagttagataagtaggctaataaatgttaagaatttaaagagaggctggactaaaattaagttttctgattaattttagatcaccaggaaacttccaaatagagcatactgctgtaagcagtccatttaattgctttcagtttaagtcgagaacattgttttccttgaaaaagcttgtctgattcttggccttgcctctgacttaacatttataagaaaatcaagaggacatttggcatttgtgccctgtttaagctatgctacaggttcataggttgaaaagtggtcctggggtgcttgcaagtgggttaggccagggtggtgttctccactttgaatgtcagagccttgttttcctaggatacttggtttcaagcttataaggtatgtgaagattacataaacatagcataatgacggtacagtgcagtggtccccaacctttttggcaccagggaccggtttcatggaagacaatttttccatggccagataggggagatggtttcggggtgaaactgttccacctcagatcatcaggcattagttagattcgcataaggagtacacaacctagatccttgcatgtgcagttgacaatagggtttgtgctcctgtgagcatctaatgctgcagttgatctgacaggaggcggagctcaggcagtaatgctctttgcccgcctgctgctcacctcctgctgtgcagctaggtttctagcaggccacagaccagaaccagtccgcagcccgggggttggggacccctggtatagtactttttaaagttctatcctggaatgggatttacggaaggcagaaccattttcctgcaaaccataaaacctgataggagtgttttcccttgtccctcttagttgtgttctatatgtatttatatgctttactttatcttacttcatcctcatgataacctgcaaggtctctcccacattttgcagaaaagaagcccagggagttgagctagtatggccagcatctcacagtgagaaagtgtaccagggctagaacctaggtcttgagactttgtgtcttcagatgctgcatcatgtgactttcccacagtatagcaacccctaagaagaatatattggtgcacttacaaatgtggcttgagtcattaaatgcttgcttatttgcccaacaactatggtggctactgtggattccagaaaagtacatgacaagttctctgccttcctggaactgaccatctgttgggaaggcaaaaaaacatgtacatatttgtacatttcacagatttttgactaaaagtttactgtgtacccagcactggtgcattaaatactggggatacaaagatgaatttcttgcccttgatacatttactatctagtgaggagagagacagacaaatatgctataattatattataataatatttataagagtgcttaccacgggctcaaatttttgctagatatttaatacactttctctaatcctcacaacactttatttacacatgaagacaggaaggctcggagagtttaaatgatttgcccaataagtggcaaaggtgagacatgtctctgtttaataatttataatgaaaagttagagaaactagtatatttgaacgcttgtgattagcaaacctgcatggaagtcaacttccctttgggtggatcaaaaggagcaaaatgaattatacctttacaattgtcattctcaggtaggtgtgatcttgccagtaagtctgagtctttttggctacgatctgcagcttgtatctccacttaaggaaaccacaccagtggactatatgttaggctagagatgaaggctttctcccctctggttggtgttctagctggcctggggagagggccacatttgaactctagtctttctgacttgaagtctatattctgactactgtaccatgtccttcctcctcctgtgtaaaggaggtgtgtgtccataggtcagtgtggtcccaagaaagggttgcctgtgactgcctgagggattaagggaagattcacagaggaggaagtgcttaaacaggtcttgagaaaaataggagtttgccagatggaaagcgagaagggcataccaggcagaaggaacaggacatacaaaggcatggacacacaagaaagcacagactgtttagagagttgtaagtggtttagtgagaggcagaatggttggctatgaggccatataagtaggcagaggccagctcacagaggtctttgctaagtagtttagaccttgcactataggcaataggaagccactgaattttaacatgtcagattcgtacattagaaagatcagctttagtagcctaaaggtataaagtagatcataagtaacagccaaattgaacctgtatcttgagttagaacaagcagaggaaaataatttgaagttagatctagttttgttttaggcagatgactcctttgatccccttggaaactcaggagaggagagtattaggagtgacttcaaatgtggaatgattagccttttgctaggtcgtctcatgcttggaaattctctggctcttgcctgagccatggtcctagttaaaccatggagatgggattggttccacggtttcaccaaggattcatgtaggccattctctgacgcacatacacacactgattcagacctggaactgactgcatctccctggaattctttgggtcaaaaatgacccatagtcctagactgatcaactaaattcatcccaaatcttactaacacctattctatgccagatgctttcatatactttatatcatttgatccgtaacaactttgtgaggtgtaggtatcagcccaatttgatgaattaggaaattcaatggtagaaaggctgtccagctagtacatggtagagctgggatttgagaggcagacagagtatcctattgtcatccattcttagtgtaagttttttccagtggcgtggagtgttgtaaacattcttgcatatcataagtgacattcatattagacattgaatgaccattatacttagaaatgtaccaatgatttaattcttttctagcagtaagttttgctgtgaactccaaagctcacccctaaaatacagcaacagctatcctgaagctcctgcatgaaaccccccactctatcttagaattgtgcatagttcataatacatgttatatgtcttcccagcctgtacactttagaagcagcaaagcagcaagagacagttgctttttggccacgtgcggtggttcatgcctgtaatcccagcactttgggagaccgaggcaggtagatcacttgaggccaggagttcgagaccagcctggccaacatggtgaaaccccatctttatttatttgagagagagagagagatacttacattttggaaagtactctggctgcagttggagagcagactggctcactttttgatgttgtagaaagtccttggactttagagtcaggcaaactggagttcatgcccttttactatcagcgtgactcccagaaagtcaccaaatttctctgagcctcagtctgctcatctgtaagatgaagcttgtatctacctcaaggttattgtgaggattagagataacaaatataaagtgcccagtttatagtggttgggtttttattgtttcagagtaatgctttggactttaatcttacctgtgtgagaaaaatgagttgtcgtactttgctaatttttttgccaactaacctttattggagtgcctactttgtgctgtagacagcacatcagactgtcaaaactgaggttctaacaaagtgaggagggagggctaatggacccagtgtttccttgcagttctgctcacctgtcaaattcctgactcccctttgtcccaccagcacccctacctttcaggtgggctgcgtgtcattctgtgtgctacacaacacacccttgtttcaaccatatttctacttgaagtcgtttagaggaaagccaaaggtctgagtatgcattctatttcctcaagtacagacatcagagaatgctgtttattaatgaaaaaataaacagatctttggcagcaaagaagcctctcccaatgatgtatggggtgcttgggctatagtcacgcctgcagtttgagcccatctgttttctctgttcacctcctgagcactgtccccttgtggtttgcatcattccttaagaccagccaactccaaccctcctcagtccactcattcaatagctgtcttatttaaacacacacactctctctctttgggtgccagatgtgaagtttcaaggcagcagaggctgggctggctagtgccatgacacctgctttagtaggcaagccagtcagctgccgcttctgatgatgttggctcttcttcatggacagcatgagggtttcaccccaccaagtgcacacacaggcagctgagggagcctcataaattatggttttgtttgtttacttcgggcagacagtgtggtgtagtggaaagagccctgcacttggacgcagaaagcacgggtttgagtgcttggtggttatgtgctttctgtctacagagcacctcttcatggcacttatcactatctctgctaattgtgtatctgtttatctgcttattggctatctcctccaccacaatataagttctaggaagtcacggactgtctatcattctatctccagtacctaggacagtgcctagaacatagtaggctcttagaaaatatttattgaatgaattaatgaattataaaactgcctcttctactcactggccatgtgatcctgggaaagtcattctcttctctgggcttcagttttatcaacttggttgaaagcattagttctctatccctgatgctgtaagagtttaagaattcattcatttaacaaattaccttgtgtctccatagagggtactgccaagccctaaaactacacagtcatgaacaaggcagaaacagaacgtgctctcaaggagttttgaaagagagagacaaccaaataaataattgcatgaacaattatgtaatgaccattgtgataagccttataaaaggatctgtacagggcactaggagaaaaaccacacaggagggccatgttgggggttgtcagagatttcttggtgaaagtgacatttaagtcagactttacagataagtagttgaccaggcaaagatggtacagtatttcagggagagggaagagcatttgtgaaagtccagggtgggcatgtggctgtagcctggtgaccaacagggaggtcatgccaagatcaggctagagagggaggctgggccagatggttcagaaccttgtcggctatggtaaggattctgtcatatctaaagacaaagggaagtcattgaaaacaattcctgtcattacaaaggctttactagtacatacagaggggaaagctggactcagccttacatggctgtcagaggtagatagagcagatagtacctccattttgtagctgaggaaataggccccagggatgataggtaacttaccaagaccactaggcaagtcagtggtagaacttgatctctaaaattttagtctacttttctcaatactatatcacattacaaagttgagagggttttctttcccttcacatactctagatggccaaattttagacctaaatgccttgtaataacagctctcatctgcaaattgaatgtctcgaaagcaacttttaagcaagtctgttagcaacaaatccctccagagcattatgcttgcattttgggtaactacaaccatatctttgatgcccattttagattattgttaggatagattgttaggaatagaattactgtgtcaaaggatatacattttaagaaacttttcatacatattgccaacttgtcttcccaaaggttgcgtatcatcatcagtatatgacagtgactttctcagtgcttcaagtaatagagaccaactctaatttaagcaaaactgaatagagcttactttctaatcatacatattttgttcacttagagatgggaaactcaaccaggctttggcaatttgaattgaggaagaagatgaagctatagagatagtgcccaaaggaggcagaaaactcccgaaggcattgttcactgtgaagaggcacacaacatagacattaaagataggaaagtgaaggcaaactctattgtattctactaaaggaagaatcctcagcattgtgacattctgctaaaagtaactccaacttggaaaagcccttcctctggcttgctacaaaactaattggagatcctaacttggagtttgttgccatgcttgcccttgccccacaagaggttgtcatggacccagctttggcagcacaatatatcatgatttacaggttgttcaaatgttctcccggatgagaatgatgatctgtaagaaaattaatctggagcccagcatcagaagtatagttttataagcatctgtgctgtgctgtcagtggtgtagcatgtttgccattttattgtgtagctaagcagaacatgtgctttatctttgggatgctgaaggagatgaatggacttcaaaaataccttcaatttttggacctgcatatttagctgtttttgttgtttccttctggagtttcatatatattaggttggtacaaaagtaatggcagtttttgccaaagtattgcaaaaaccacagtaacttttgcaccaacctaatacttaacatcataatattcagtggtgaggatcttattttactgccattcccattccttttcatttagaaacagaataaagttgtatttcaaatacctaagagagatacacacacacatagtgtggtccataacataagtagaaataaaatacttgacaaaactagcacaaaggatgaggagggagtatggaagtatagtatactcttcttcttatgttatacttgaggtggtatattatttttaaattaataactttttaaacaacttaactgttttaagttaaatatgcgtattgtaaacctgagagcaaccactgaaaaccacaatgtataactccaaagtatagttaataagccaataatgcagatgaaatggaatactaaaattaccaatgaatgttagaaaagaaggaaaaaaaggacaaagaatagatgggacaaatagaaagcaataaaaagacattagacttaaccatatcaacattaaatgtaaatggaatgaacacttcaattaaaaggcagaaattaccaggctagattttttttttacaaatggatacaaatatgctgtgtgctagtctgttcttgcgttgctgtaaagaaatacctaagactgggtaatttacaaggaaagaggtttaattgtctcatggttctgcaggctgtacaagcatggtgccagcatcagcttagcttctggggaggcctcagggagcttttactcatggcagaaggtaaagcaggaacaggcatgtcacatggccagagcaggagcaagagaaagaaggggaggggagatgccacacacttttgctcaaccagatctcatgaggacttactattgggaggacaacaccaaaccatgagtgatccccccagatgactcaaacacctcccctcagccctgacttccaagatgagggatcacatttcaacatgaggctttgaggggacaacatccaaactatatcatgctgtttacaggaaagcatgttaaacataaagatgcagataggttaaaagtagtaggacagaaaaagaccatgcgtacacaaatcataagaaacctggagtggctatattaatatcacatgaagtagacttcagaacaaggagtattaccagatgtaaagagacataataagagagttaatcaagaagatataatactcgtaaacgtgcacacaataacattaaataaaacagaactaaaaacaagtagataaatctgtaatttaggggaatatagaatgatgagcaggacttctggaatgacagagtaagaagctcagaaaatcctctttaaaaagaaattgtcaaaaacaaaattgattaaaggcttacaacaaattgagaagcatttattcgtgaaaaactactgaccctcaagtaaaaatagtgggagtctgtggtgttttaacctggggctgcttccaacccaccttctctcctctgctccccaccagcttggtcaccatagtaattgtgctacaaggaaagacaaatcacgaaaacctgcagctttgctgtgggaaggagctcacttgatttgaagcagaatttgaaaaactgcatgcccggggtattgaaagaaaaaatagcagtctcagtgacgaactaacaaaaagcaagacaacaattcagctagcctgaagttgaggtcctggttggagcaagcaagggaccagggagataatgggaatgagagccatagtgagcttcgataagctgccacatatccctagcaaagcacatgtgcaggagagaccaaagagtgccttggctatccacatacacctggtagaacttgaggccatgcacacaggtagaggaaatgtgagagtgcccaacagaaaggaaatgccgaggcagacttgtgaactgcctgaatttttatgcatttcccaacccacatgtagatgtgtgacattgtggaaagtagaagtcttactggctcaaggtatttgagcacaacctctgatcaatcattagctgaccactaagcaacactgacatgggcgtaagcccttgcagcaaggcttaaaaataaagacaagaatttaagaacggaaatgaaacaaacgagagagatcaatggtcccgcaccacagactctatagatttagtctaggcaagttactaacaaaagcaaaaacaacccctagaggggaaatgtcagatttcataattgctagactatattatctaaaatatccagttttcaaccaatactatgaaatattcagagaaacaggaacatgtaacacataatggggggaaataaaatgatatgcaagacttgaaaaactttatcaatcaacttgacctaattgatatttacggaacacaacactcagtaactgcagaatgcctgttcttttcaagcatgcatagaagacaaaccatggggatttttacaaaattcaacacctatatttgaccaaaaaaaaaaaaaagaacacttttcaaaaagtaggaatagaagaaaacatcctcaacctgctaaatggaatctacaaaacactaaataccatatatcatactttgtgatgaaatattgaaacgttctaagtttgggaacaaggcagggatgtctggtatctgttcatgcaatattattatgtgactggaggtttcagcaaatgcaataagatgagaaaagtaaaagtcatacagattgaaaggaaggcataaaactgtattttcaaagaacaagcaagtaatctacaaaacaaaaatctagggctaatatgtgaatttagtaacgtgacaggatacgaggccaatatacaagattcaatcttttgtatatcagcaattagtaattgtaaaataaaaataacatttaaaatgccatttataatagtgtcaagaacataaaatatttagggataaatttaatgaaatatgttcaacatctctacactaaaaactaaaacagtgatgacaaaaactaggttatttgaagtttttcttcttttttaatgtaggtgcttatagctataaaattccctcttagtactgcttttgctgtatcccataggttttatatgttgtgtttccattatcatttgtttcaagaaattttttggccgggctcagtggctcatgcctgtaatcccgccactttgggaggctgaggcaggtggatcacgagatcagaagtttgagaccagcctgaccaaaatggtgaaagcccgtctctactaaaaatgcaaaaattagccaggcatggtggcacgcacctgtaatcccagctactcaggaggctgagtcaggagaatcgcttgaacccgggaggcggaggttgcagtgagccaagatcacaccattgcactccagcctggacgacagaatgagactccgtctcaaaaaaaaaaattcttcatttcttcattgacccactggtcattcaggagcatgtagtttaatttccatgtgtttgtatagtttccaaaattcctcttgttaatgatttctagttttattccattgtggtcaaagaagacatttgataatatttcagggttttttttttttttttaaggttataagatttgttttgtgacccaacatatggtctatccttgaaaatgatccatgtgctgaggagaagaatatgtattctggagccattggatgaaatgttctctaaataactactaggtcaatttataatgtagttcaggttaagtctgatgtttctttgttgattttctgtgtaggaaatctggccagtgctgaaagtagattgggggcatatatatttacaattgttatatcctcttgatggattgatgcctttaccattatataatgaccttccttgtctcttacaatttttgtcttgcagtctattttgtctggtataagtatagctactcctcttttttaaatttccattcgcatggaatattttttccatccctttattttcagtctttgtgcgtctttatagatgaaatatgtttcttataggcaatagattattgtgtcttttttttttaatccattcagccactctgtgtcttttgattggagaacttagtctgtttacattcaatgttattattgataagtaaggatttacttctgccattttgttgttttctggttttcttttcctttccttcctgtcttccttttagtgaaggtaatcttctctggtgttatgacttaatttcttgctttttattttttgtatatctgttgtatgttttttgatttgaggttattatgaggcttgcaaatactatcttatgactcattattttaaactggtgacaacttaacactgattgcataaacaaacaaaaagaaaactaataactacactttttgtctccccacttgttaactttttgtttttatttataccttattgtactgtatgtcttgaaaagttgttgtagttattatttttgattggttcatcttttagtctttctgcttaagagtagattatacaccacagttacagtgttataatagtctgtttttctgtgtacttactattaccagtgagttttgtatcttcagatgattttttattgctcattaacatccttttctttcagattgaagaacttcctttagcatttcttgtaagacaggtctggtgttgatgaaatccttcagctttgaaagtctttatttctccttcatgtttgaaggatgttttcaccagatatactattctagggtaaaagtttttttcccttgggactttaaatatgtcatgccaccctctcctggcttgtaaggtttattagatgcctcaaggtagtcaagttaaatctatttggtgttctatcatcttgtacttgggtatttttattagttcattttcatgctgctgataaagacatacctgaaactgggaacaaaaagaggtttaattggacttagagttccacatggctgagaaggcctcagaatcatggcaggaggtgaaaggcacttcttacatggcagcagcaagagaaaaatgaggaagcaaaagcagaaacccctgataaacacatcagatcttgtgagacttattatcacaaaaatagcacaggaaagactggcccccatgattcaattacctcccccggggtccctcccacaatatgtgggaattctgggagataaaattcaagttgagatttgggtggggacacagccaaacagtatcattctgctcctggcccctccaaatctcatgttctcacatttcagaaccaatcatgccttcccaacagtcccccaaagtcttaactcatctcagcattcacctaaaagttcacagtccaaagtctcatctgagacaagccaagtcccttccacctatgagcctataaaatcaaaagcaagctagttacttcctagatacagtggggatacaggtattgggtaaatacagccattccaaatgggagaaattcacaaaaacaaaggggttacagggttcttgcaagtccgaaatccagcagggcagtcaaattttaaagctacaaaatgatctcctttgactccaggtctcacatccagctcaccctgatgcaaaaggtgggttcccatggtcttgggcagctccacccctgtggctttgcagggtacagcctctctcctggctgctttcatgggctggcattgagtgtctgtggcttttccaggtgcacggtgcaagctgccagtggatctaccattctggggtctagaggatggtagtcctcttctcacagctccactaggcagtgccccagtagggatcctatgtgggggctccaacctcacacttcccttctgtactgccctagcagaggttttccatgagggccccactcctgcagcaaacttttgtctgggcatccaggcatttccatacatcttctgaaatctaggcagaggttcccaaaccccagttcttgactcctgtgcacccgcaggctcaacaccacatggaagctgccaaggcttggggcgtccaccctctgaagccacagcctgagctgtacattggcccctttcagccacagctagagcagctgggacacagggcaccaagtcaataggctgcacacagcacggggaccctgggcctgacctatgaaaccactttttcctcctgggcctctgggcctgtgatgggaggggctgccgtaaaggtctctgacatgacctagagacattttccccatggtcttggggattaatgctagactccttactacttttgcaaatttctgcagccagcttgaatttctccccagtagatgagttttccttttctatcacattgtcaggctgcaaattttccaaagttttatgctgtttcgcttttaaaactgaatgcttttaacagcacccaagtcccctcttgaatgctttgctgcttagaaatttcttctgccagataccctaaataatctctctcaagttcaaagctccacagatctctagggcacaggcaaaatgccaccagtctctttgccaaaacataacaagagtcacctttgctccagttcccaacaagttccttatctccatctgagactacctcagcctgaaccttattgttcatatcactatcagcattttcatcaaagccattcaacaagtcttgggaagttccaaacttttccacatttttctgtcttcttctgagccctccaaactgttctaacctctgccgttaccgagttccaaactcacttccacagttttgggtatcttttcagcaatgccccactctactggtaccaatttactatattagtccattttcacactgctgacaaagacatacccgagactgggaagaaaaagaggtttaattggacttacagttccacatggttggggaggcctcagaatcatggtaggaggcaaaaggcacttcttacatggcagcagcaagagaaaaatgaggaggaagcaaaaccagaaacccctgataaacccatcagatctcgtgagacttactcactatcatgagaatagcacaggaaagactggcccccatgattaaattatctcctcctgggtccctctcacaacaggtgggaattctgggagatacaattcaagttgagatttgggtggggatatagccaaaccgtatcagtattgatatctttctctaggttttggaagttctctgttattatccgtttgaataaactttctactattatactatctctttctctacctcctctttaaggtcaataactcttagatttgcccttttgagcctgttgtctagatcttgtaggcatgcctcattctttattattattttttcttttgtctcctgatatggtttggatttgtgtccctgcccaaatctcatgttgaattgtactccccagtgttggaggaggggcctggtaggagatgattgtatcatggtggtggatttccaccttgctgttgtcatgatagtgagtgagttctcatgagatctggttgtttaaaagtgggtagcacctccccctgtgcactcttcctccttctctggccaggtaaggtgtgccggcttcctcttcaccttccgccatgattgtaagtttcctgaggcctccccagccatgctttctgtacaggctgttgaactgagtcaatgaaacctttttctttataaattacatagtctcaggtagttctttatagcaatgtaaaaacaggctaatacatctcctctgactgtgtttttttcaagtagcctgtcttcaagctcactaattctttcttctgcttggtcaattctactattaagggattctgatgcattcttcagtatgccaattgcatttttcaactccagaatttctgcttgattcttttcaatatttcaatccctttgttaaatttatctgatagaattatgtattccttctctgtgttatcttgaatttctttgactttcctcaaaacagctttgaattttctgtctgaaaggttatatgtctctgtttctccaggattggtccctggcactttatttagttcatttgataatgtcatgttttcctggatgtcttgatgcttgtggatgtttgtcagtgtctaggcattgaagagttaagtattcattgtagtcatcacagtctggccttgtttgtacctgtctttgggaaggcttttcaggtattcgaagggacttcagtgttgaatcttgaatgttgtaatctgagctgtactgcattagggggaaccccaagcccagtaacactatgatttagactcgtagagtcttcggtggtcttagataagacctggaagaactctctggattaccaggtggagactcttgttctcttcccttactttctcccagtctttcactctctgtgctgagccgcctggagctggagtggggtgacacaaacacccctgtggccacccactaggactgggctgggttaggcctgaagccagcacagtgctgggtcttacccaagaccccgttagcctctacctagctttcacctatgttcactcaaggccctagagttccacaatcagcaggtagtgaagccagccaggtttgtgtccttttcttcagggcagcaagttctcttaggccccaggtgggtccagagatgctgtctgggagccagggactggagtaaaaaaccttataaatctaccttgtgctctattctactgtggttaagctgaactcatgctacgagacaaagtcctttctactcttcccttccctttccacaggccgaggagcctctcccaatggccaccaccaccacaggcccatggggagtactgccagtctcactgatgttcacttacagcccaagggctcttctgtcagcttatggtgaatgctgccaggcctgggactcgcccttcagagcagtgggctcctctctggcccagggcaggtccagaaataccttccaagagccaaggcctggaattgtggatcccaagagcccgtttggtactgtaccccactgtgggcaagctggttacttaagtgtaagacaaagtcccctttacttttccctcttcttttctcaagcgggagtctctcaccatggccatcacagctgggaatgtgctgggtctcacctgaagccagcatgtctcagagtctcaccaaggcccatggcgtactacctggttattgctgctcattattcagagcccaagggctctttaatcagcaggtgatgaatcctgcctgacctggccccttctcttcaagggaataggttttcttctggaccagggtgtgtctagaaatatctgggagctagggcctggaacgggggcctcaaaactcttcccactgccctatcctgtcgtgcctgagctggtatccaaaatgcaaatcaaaattctttttacccttccctctcctcaagcagaaggaagcagtcactttcattgctgagaactgtgctgcttggagttggaggaggagtggcacaagcactccattagccaacccagctggtgtctcactaggtcacatgccccccaggtccacaagctccaagcccagcacaacactaagacttgcctaggagttgcagtccttgtggcacagactgcctttcaagtttacttaggaccccagaacactttagcccacagtgctgaggcttccctaaactcaggttctgactgctgggataggcgattcctctctggctatggctggtctaagtgctccttccatggacacacatctgctgagttcagcccagttttgctgagttcaaagtcccacagttgctgcactctccctcccccaaccacacagattctctgtaccaagggcactgcaaggggatgagggaggggtggcattggtgattcaagactataatttcgaagttaaaaccaggtactgtgattgcttacctgatttttggttcctataaaggtgcttttcttatgtaaatagttgttaaaatttggtgttcctgtggggaggatgatcactggaagcttctattcagctatcttactctgtctctgatgagggaaattaaagaaactaaattaatggagtaatataccacatttgtagattggaagaacgcaatattgttaacttgtcagttctctccaaatggatcaataggttcaaagcaatgccaatcaaatttctagtaggcttttttgtagaaattggtaagttgaagttctaaaatttgcatggaaatggaaaagatgtagtataaagcagtcttgtaataagacagaggtgaagaacttacatttgatttctagacttacagtagtgccacagtagtcaagacagtgtggtgttgacataaagatagaaaaaatagatcaatgggacagaatagttagtctgtaaatagtggttgattttcatccaaggaggaaaagcaattcaatgtggaaagaaaagtctgttcaacaaacgatgctggaacaactggctattaaaatgtttttagaagaaaatatatagaagaacattttcatcatctttggatagtcaaacttttttaggacccagaaagcaataaccataaaagaaacatcaataaaatggaattcatcaaaatttaaaccttctgctaagcaaaagacaccattaagaaataagtaggaaaaccatagaatgtgagttagttatcaccatgcatatatctctatctctctatgtctatatatttgacaaaagacttttatccagtgtatataaaaaacttatacagctcaatattaagaagacccaattaaaatctaatttttaaaaaatgggcaaaaaataagaaccggcactgaataaaggaagatataccaatggccaataagcacatgaaaatgtgttttaatattattattcagcaaaatgtaaatgaaaatgacattgagatatcactacatgcccattagaatggctaaaatcaaacggtggcaacagcttaagtggtaagattgtagaatgtaagcaaaagtctcatacgttgctggtaggagtgacacaaccactttgaaaattggtctggaactttctcataaagttaccatgcatctaccaaatgacccagcaattatactgtaaatatttacccaagaaaatgaaaacatacatccatacaaagatttgtacactaatgttcatagcagctttattctaaaactggaaacaacccaaatatctatcaacaggtgaatggatgaataaattgtggtatattcatataatggagtacagctcagcaataaaaagtataaattctaccaaacacttagagaagatttaataccaaattcttcacaaactcttccaaaaattagaagaggagagaacatttcccaacttactctatgaggtcagtattactctgacaccaaaaccagacaaagacatcataagaaaactacagactaatattcctaatgaatatggatgcagaaatcctcaaaaaaaaattacgaagatgaatccagtgacatataaaaaggattttgcaccataagcaagagggatttatcctaggaatttaaggttggtttaatatctgaaaaatcaattaatataataaaccttatcaatagaataaaggacaaaaaccacacaatcatctcagtagagtcagaaagagctgggtgtggtggctcacgcctgtaatcccaacactttgagaggcctaggtgggcagatcccttgaggtcaggagttcgagaccagcctggccaacatgctgaaactctgtctctactaaaaatacaaaacttagccagacatggtagcacatgcctgtaatcccagctatttgggaggctgaggcaggagaattgcttgatcccaggagacagaggttgcagtgagctgagaccgcaccactgcactccagcctggtcaacagagtgagactccatctcaaaaaataaaaataaaaataaaataaataaataaataataaaataaaaataaataaataaaaataaaaattagcttggcatggggctgcatgcctgtagtcccagctgcctggcaggatgaggcatgaaaatgaaaatcacttgaacccaggaagcggaggttgcagtgagccaagattgtgccactgcaccccagcctaggcaacagagcaagactctgtctcaaaaaaaaaaaaaatgaaattaatagagccagaaggagcatttgacaaaatctagcacccttttataatttttttttttttttttttttttgagacagagtcttgctctgtcacccaggctggatggagtacagtggcacgatgtcgactcactgcaacctccacctcccaggttcaagcaagtctcttgcctcagcctccagagtagctgcaattacaggcatgcgctaccacacccggctaatttttgtattttttagtggagggggttttgccatgctggccaggctggtctcaaattcttgacctcaggtgatccgcctaccttggcctctcaaagcactgggattacaggcatgagccaccatgcctggcccctttcataatttttaaaaaacactaaacaaaactagaaatagaaggaaacttcctctacctcataaagggtatcaacaaaaacccacagctaacatcatacttaatggtgaaagactgaaaacttacccttaggatcaaaaataagacaaggaagtctgctctcaccgcttatattcaacattgtactggaggctctagccaggcaattaggcaggaaaaagaacaaaacggattcattttagaaaggaagaagtacaactatttctgtattcagatgacatgatcttctatatagaaaatcctaaggaatccactaaaaaacctattaaacccaatatgttaagttcaacaaggctttaggatacaagcccaatgtacaaacatcaattatatttctacaagctagaaataatctgaaaatgaaattagaaaacaattgcatttacaatggtatcaaaaagtttaaaagtactcaggaatacatacaacgaagtgcaaagcttatataaattctgaaatctacaaagcattgtttaaagggtgcagtggttcacacctctaatcccagcttcctgggatgcctttcccatcttgtttgtcaggaaatatcttctcatcttttaaaaagccatttgaaggccagacgcagtggctcacgcctgtaatcccagcactttgggaggccgaggcaggtggatcacctgaggtcaggagttcgagaccagcctggccaacatggtgaaaccctgtctctactaaaaatacaaaaattagctgtgtgtggtggcgggcgcctgtaatcccaggtacttgggaggctgaggccggagaatcacctgaacccaggaagtggagagagagagagagagagaaagaggacctaaataaatggaaacacttcatgtgctcatgaatcaaaagacttagtagtattcttaagatggcaatactccctaaattgatctacagatttagtgcaatctcttatcaaaatcccagctggatttttttttccccagaaattgacaagctgaccctaaaactcatatgcaaatgcaagggaccaagaacagtcaagacaatcttgaaaaagaagaacaaaagtggagaaatccttcttgatttcaaaacttactacaaaaccacagtaatcaagacaggctggttatagcataacaataggtatctagatcagtgaaacaattgatagtccagaattaaaacttacatgtatgagcaattgatgtttaaagttgctaaaaaaaaaaaaaaaaaaatcaatgggacacctggagcatcaatgggggaaagaatagtctttccaacaaatgatactgggacaactggatatccacatgcacaggaataaagttaggcccctttcttataccatgcatagaaattaatgggctaggtgagggaggaatggagagttgtccagttgtccagtaggcatagagtttcagttttgcaagattaaaagttctagagattggttacacaacaatgcaaatgttcttaacactactgaactgtatacttaacaattaagggcccggcgtggtggctcacgcctgtaatcccagcactttgggaggccgaggcgggcagatcacaaggtcaggagatcgagaccatcctggctaacacagtgaaaccccgtctctactaaaaatacaaaaaaaaattagccaggcatggtggcaggcgcctgtagtcccagctggaggctgaggcagaatggtgtgaacccggggggcggagcttgcagtgagccgagatcgcgccactgcactccaacctgggcgacagagtgagactccgtctcaaaaaaaaggtaaattttatgtcatgaatattttactgcaatttaaaaattttaaataaaatttaaaaatttagctaaaaatggaccatagtcctgaatgtaaaagctaagactataaaactcttagaagaaagcaggggtaaatctttgtgaccttgggtttggaaaacctttcttagacacaacaccaaagcataagcaacaaaagataaattggacttcaaaggacactctcaaaaaacgaaaagacaacccacagaaagggcgaaaatatttgcaaatcatttttctgacaagagaattatatccagaatctataaagaacatttaaaactcaatagcgaaaggacaacccaactgaaaaattggcaaagggtctgaaaagacatttcttcaaagaatatatacaaatgaccaacaaacatcaaaacatcaacgtcgttagtcattagggaaaacattagtcattagggaaatgtaaatcaaaatctcaatgagaaataactttacacccactagaattgctgtaaacaaaaagagacaatagcaagtgttaatgtggatgtggataaatttggaaccttcatccacagctggtgggaatataaaatggtgcaggcactttgggacactttggcagttcctcaaaatgttaaatagagttaccctatgacccagaaatttcattgctatatatgtacccaaaagcagtaaaacatacattcatacaaaatcttgtacataaatgttcatagcagcatcgttctgatagccaaaaaaatggaaacaagccatatgtctataaggtgatgaatggataaatgcaatatgatatatcattagagtggaatactgtccagccctaaaaggaatgaaatattgatatataccattacatggatgaaccttgaaacattatgctaactgaaagaagccagacacaaaagcctacatatcacgtagcaaggggacccagaatagactggaaaggtatagcatacaatcagtatttgctggatgaataaatgtattaagtaaaatacccagtacagggccaactggatttagaaggtgaaggaaaaataaggctaaggtactactgagctttcttaagctgggtgagtaaggggtgggtgggaacattaaagaggcccggagtagctaggagggagaatggggttagggggtataatgggagaaaagggaagatatatagagttttcctttctgttgtgttttttttacagtggtgctggacatgcagtcccactcactagacattttggagcattacgtggaaatgcccatccagcggttggagaggtagggtaggatctgaagatctcaagcctcggaagcacagatttaggagtcactgacttagaggtggtagtttcaagtgacgtgatggttaagttcaccaagagaaaaagtttagaaagaaaaagagctgagccttctgccctattttttagaagagggtttctgagagcctgggtattcaaatgataagatgggtgtgtggtgcagggacaagacttcagtcagaggacccagggtctctgctttagcaccatcttgctgtgtg

SEQ ID NO: 392 - DNA, 103033 bp, Homo sapiens
aaaaaaaaaaaaagaaaaaagaaaaaaaaaaggaggaggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcgggtgagtccctctcgcctcatccccgcgccccccgcccccgcctcgggggccattgcgagcgggggcctttattagagactttgccccgccggggcctgcagggacaggggcctgggagccgcggcccgccgcgcgcggtgtggggccttggggggcgcccgtgccgcctccccctacccccacccccaccgcctcgccgggtctcgagccccgccggccttggcagtggccgaaacgaggcgatgggggtggggcggcacggacgcggtcgcgggggacgacagtggcacgcgcgcgcctcagtgcgcgtgggggaggggcgcgcgcgccgaccggcgtgcggtgggggggcgcctcgcgcgtgcgatcccgcgcgcgagcgagcgagcggccctgcgggctgcgcatgccccgccgcgctgattggccggctaggcggtgcgggggcgcgcgcggtgccaggcccgagccgtcgtggggtcgcgctcgcctggtgtatctggggctcctgcgccggggcagcagacgcgcgggattggccaaccggcgcgggggcggggccgcgcgttgcctggtaactgcggcgggcgggggagcgggagcgctgtcccccgccccgccccgctcccaggtggagtccgcagtgggctttgtcccgggccggcccggcgcgcctgccccgcggggcctgttctttgggggaaataaacacaatgaccggaaggaaaacttcagctttaggccatgaaaattaagccgtctgggttcagccagcacccagacgacgggagtgcagaggaagaaggaaaatgaaatggaaaaagctgtctccttcccgctccccgacttctccactttttcttaatccagcttttgctttttcgtgtagcgaattttgtcctccctaggttatggatttgcgctgatttgcggctggggatgttcacaggtggggtgctgttggagtagtgtccactcttggcgatgcgcagctcttgctgactgactactgacctcctttttttaaaaaaaattatttgtggagatgcgttctcactttgttgcccaggctggtcttgaactcctaggctcaagcgatcctcccaccttggccccccatagtgctgggattacaggtgtgagccatcgctttcggcttaattttcttttttttttttagaaacagggtctctctatgttgccctggctgaagcgcagagtggcacaatcatagcacattgcagcctccaacacctgggctccagcgatcctcctgcctcagcctcctcagtggctgggactacaggcgcatgccatcatgccctgctaatttttttttttttgagatggagtctcactctgtggcccaggctgaagtgcactggtgtgatctcggctcactgcaacctctgcctcccgggttcaagccgttctcctgcctcagcctcctgagtagctgggattacaggcgtgcccaccacgcccggctaatttttgtatttttagtagagatggcgtttcaccatgttggccaggctggtctccaactcttgaatcaagctgaaagcaatcggcccgcctcggcctgccaccaaagtgctgggattacaggcgtgagccaccgccctgggtcacgcctggctaatttaaaatttttttttagagatggggtcttcttgtgttgcctaggctggtcgggaactcctggactctggtgatcctcccgtttaggcctcccaaagtggtgggagtacaggcttgagccaccacgctgggcctcatctcttttaaattcaactttgccgcagacaatggcttgatcagccaacagtgcagaggagaagtctccagtccttcagggaacaaaaggggaagttagtttgcaaatgagaacgtgcaggtagagtgccctgcggaggcggggtcttctccccaggctgaggcctgtggtgtgggatgaccgattttatttcctgctacaggatttttctgtggctgctaccttggctttcgtttctcctcctccttgagatcttggtcttttggctggaatgacatttttcagcctatggaaatctttcttgctcatatgcagccacttccttaaggtcttctcttttttttttttttttgctgctgttgttgagagggtttcgttctatccccccaggctggagtgcagtggcgcgatcttcgctcactgcaacctccacctcccgggttcaagcgattttcctgcctcagtctcccccgagtagctgggattacaggcgcctgcccccaagccccgctaatatttgtatttttaatagagacggtgtttcgccatgtttgtcaggctggtcttgaactcctgacttcaggtgatccgcctgcctcggtctccgaaagtgctgggattacaggcgtgagccaccgctcccggcctgtggtcttctcttatattgcatagtcagagtttgttccttcttagtctcccaatcaacttgtgtgcccttcctcgcagggcacctttattttctctcttttttttccttttcctttttcttttcttttcttttttttttttttttcggaagcggagtttcgctctcgttgcccaggctggagtgcagtggcgcgatctcggctcactgcaacctccgcctcccgggttcaagcgattctcctgcttcagactcctgagtagctgggattacaggagcgctccaccacgcccggctaagggcacttttactttcctctgcatctggcctagtcactgggtgttgagctcgtaggggcagggacaagaagccttttcctcctatgtctttctccctccacttccccctccagtttggcatcgtcctcgtgccttgccggtggtagcaatgctgcttacatttgagtgtcttccgtgccccctccatggctcttgagcgctttggatgtacagtatttttcttatttaatctttgtgacaagtctgtaattctattctatagagcggaacaagtctagagaagttggagagttctgtactcttgcttgcctagcacatgaacctggccagtgtgactcaacccctaagccgaggttgtgaaaccaccgcgcctgggcgtccccgggagagctggcatgtgcggactctgcttgctgggccctacctcccaggctgattctgcaggtctggggagttgccccacaatttgcatttcgattagctccccaggtggtgttgatggtggctgcttcccggacagccctttgagaaccattcacaatggtgcaaaatgaagggagagaaatttattggagatatttgctttttcttactttaaaattagatcttggccgggtgcggtggctcacacctgtaatcccagcactttgggaggccgagggaggtggaacacctgaagtcaggagttggagaccagcctgccgacatggcgaaaccccgtctgtactaaaaatacaaaaattagccgggtgtggtggcgtgcgtacgtagtttcagctacttggggaggctgaggcagggggatctcttgaacccaggaggtggaggttgcagtgagatgagatctcaccactgcactccagcctgggcgacagagcgagactgtgtctcaaaaaaaataaaaataaaaataaaatagatgttaaagaatgaaaaataattcggacgactgacggtagattgctcagaaaactggctgagagttgagaattcctgttagccatgattagaaaagttaaaagtttcataagtctccagtttaaaaaggggccatggatttaagtgtggaataaaatgggaaatctttggaagtttggcttttttcccactctgatttatttattaatttagtcgcagcacgggcatttgttacattatcctcttcagatgcccaaagtctgccacaccaccacacagaaggtttgagtgataggaccacagcttgtagttttggcccttggaggtaggggggttggggagcattgtgtgctgagtctcctctgccacatgcccctccagcgattcagcttactcaaatatgactacagagactgacattaaaatgtaggctttgggggttctttttgcgggacagggttgggggcaattcttgctgagaaagatttttaggttttttctttctttttttttttttttttttgatggagtttcactctgtcgcccaggctggagtgcaatggcacaatcagctcactgcaacttacgcccccccagggtcaagtgattctcctgcctcagcctccggagtagctgggatcataggcatgcgccaccatgcctggctaactttgtatttttagtagagacggggtttctgcatgttggtcaggctggtctcgaactcctgacctcaggtgatccgcctgccttggcctccttaagtgctgggattacaggcgtgagccactgcacctggacccttttttttttttttttttttttttttttttttgagacacagtcttgctctatcgcccaggcgggagtgtaggtgcgtggtctcggctcactgctacctctgcctcctgggttgaagtgattctcctgactgagcctcctgagtagctgggattacaagcacgcaccaccacgcctggctaattttttgtatttttagtagacacggggtttcatcatgctggccaggcttgtctccaactcctgaccttgtgatctgcccgcctaggcctcccaaagtgttgggcttacaggcgccctgtgatttttaggtttttaaaattataatggatttctttccggggaaaataaccgcagataggtgggaggaatggttttagtttacagttgatgacccccctcctttccccacctacacccttaggcgagttgtacacactcctcaggggatcccaacttccatggccactgtcctatgttctggcattttcgatgacccataggtggacaggttgttatcatctaaaggagctgaacactgaacaattactaaacacttaaccttttctgttattactggttaccagctatttgcattgcatttcacctaattcatttctactgttgtttcattctttgttgatgacatgaatgttttatataaacatgagtttttgcaatatgcttcataactggggtggtataattaacacgaaattgttttaccactggcttaaatagatggatgtcaaatcatttttatgtcagtctaagggaaagtatttatttatttttttgagatggagtctcgctctgtggcccaggctggagtgcagtggtgccatctcagctctctgcaacctccgattcccgggctcaagcgattcttgtgccttagcctcacgagtagctgggattacaggcatgtgccaccatgcccagctaatttttttgtatttttcatagagatggggtttcaccatgttagccaggctggtggtctccaactcctgacctcaagtgatccacccacctcggcctccctaagtgctgagattacaggcgtgagccactgcgcctggttcgtttattgagtgaaggttattcattgttaataactgaaagaaagtagaaaatacacctaatcagttgcttattctaattgtagagttgagatacttgggaatcagtaggcttaagctggcagcatagctctatgaagactcatactcggttaactaaagtgtattggggctacctacctgggggagcaaaacgccttagtgtcttagaagatgtgtgtttttttattgcattttattttattattatttatttttgagacagagtctcgcttttgtcacccaggctggagtgcagtggcgtgatcttggctcactgcaaccttcgcctcctgggttcaagcgattctcctgcctcagtctcctaagtagctgggactataggcacccgccaccatgcccggctaattttgtatttttagtagagacggggtttcaccgtgttggccaggttggtctcaaactcctgacctcaggtgatctgcccgccttggcctccgaaagtgctgggccaccgcacccagccaaggatgtgtgtatcctgtaaaaattgtgtgggtacgtcatcggaagaggtgaaggtattgtcttgataattcttcattctccattcttgccctgtcgtcctttactgttgtccttttgttctggaactctccctgctgtcttcctgtttgttttctcctctgtaaaattcttgttttggtattccatgcctgtttctggcagtactcatttgctttttaccactttggcctactgagaaagtaagagaaagttcagtatagccaggaactgtcagagttgttggaggattgactcattctcctttggttgtaacttgtttctgtttttgtttttttgagaaggagtctccctctgtcgcacaggctaaagtgcaatggcgcgatctcggctcactgcaactctcgcctcccaggttcaagcgattctcctgcctcagtctcctgagtagctgggattacaggtgtgtgccaccatgcccggctaatttttgtatttttagtagatacaggtttcaccatgttggccaggctggtctcaaactgctgacctcaaatgatccacctgcctcagcctcccaaagtgctgggattacaggcatgagccaccacgcctggccaacactctatgtaggatttttaaagaactagttacttaaaaaatatatcatgagagggaagacaaatttataaattgagagagggtttatagcttatggctagcgacacaagtttgaagtctgactgcctggattccagtcctggcccttgccgtttcctgcctgtgcgaccttgggcatttcacttcatctttgtatgtttccctattttttgttttttttttttgagacagagttttgctcttgttgcccaggctggagtgtagtggcgcgcctggctcaccgcaatctccgcctactgggttcaagcgattttcctgcctcagcctcctgagtagctgggattacaggtatgtgccaccaccacgcctggctaattttgtatttttagtagagacggggtttctccattttggtcaggctggtctcgaactcctgacctcaggtgatccacccgcctcggcctcccaaagtgctgggattacaggtgtgagccaacagtgcccggcctattttttatttttatttttattttttgagacagtgtcttgctctgttacccaggctggaatgcagtggcatgatctcagctcactacaacccctgcctctcgggttcgagtgattcttgtgcctcagcctcccgagtagctggaattataggcatgcgccaccacacctggctaatttttgtatttttagcagagacagggtttcaccatgttggccaggctggtctccaactcttgacctcagatggtccgcccacctcagcctctcaaaggctgggattacaggcctgagccaccacgcctggcccctatttttaaaaatggagttgataatagaacatgtttcgcttctaagagctgttgcaaggatagagtttaagtgcttaggttgctgtctggcatgtagtagacactcaagaaatattagtcataaaagtactattataaagacttttgggaaattgaggaagcgaaaattttactagtaatatcgactatgacgttaatctccaagaactctggagaatatgaattgcaagggcaaggacttattcctctgtgggattttcccctgtgactgttacattgtttttatgttttgttttgttgagatggagtctccctctgtcacccaggctggagtgcagtggcgggatcccagctcattgcaaccttcacctctgcctcccgggttcaagtgattctcctgtcttagcttcccaagtagctgggactacaggcgtgcgccaccatgcccagctaatttttgtattttttagtagagaaggggttttactatatgttggccaggctggtctggaacccctgacctcaggtgatctgcccatctcagcctcccaaagtgctgggattacagacgtgatccaccgcgcctggccagagcttgacagttggattgatgaaacctgagaatgtatgctttatatgttgttcattttaatttgttatatctagaaatttagctcttactgttgactataacacatacatgacgtgagtagaattttatctagattgagttttcagaccgtaattggtttcaagaaaataaataaggtattggaagtgaactaaaattagtaactggctttggcattagactttaatgcacttaaattacatgatctcatctgtgagataatttgacagaggaggacgatggcatgtattatgtccatatgaggaaagggcagagaaatagaccctgcaagattcattagtgttactccttcctcctgttcgttttctttcttcgttttccccccctggtaagcattaaaaaaaattttttttggctgggtgtggtggctcactcctgtactcccagcactttgggaggccatgactcacttgaggtcaggagtttgagaccagcctggccaacatggtgaaaccccgtctctactaaaaatacaaaaaattggccgggcacggtggctcacacctgtaatcccagcactttgggagtccaaggcgggtggatcacgaggtcaggagatcgagaccatcatggctaacatggtgaaaccctgtctctactaaaaatacaaaaaaaaaaaaaaaaaattagccaggcgtgatggcgggtgcctgtagtcccagctactcaggaggctgaggcaggagaatggtgtgaaaccggcaggcggagcttgcagtgagctgagatcgcaccactgcactccagcctgggtgacagtgtgacactctgtctcaaaaaacaaaaacaaattagctaggcgtggtggtgcgcacctgtaatcccagacactcgggaggctgaggcaggagaatcacttgaaccctggagtcggaggttgcagtgagccaagatcacgccattccactccagcctgggccatagaacaagactatgtctcaaggaaaacaaacaaacaaaaaaacacatctctactgaaaatacagaagttagctgggagtggtgacaggtgcctgtaatgccagctgcttgagtggctgaggcatgagaatcacttgaacccgggaggtggaggttacagtgtaccgagatcttgccactgctctccagcctaggcgacagagcaagacaccatctcaaaaaaaagaaaatcctgtaagatgaatttgttcctttatgaagaataaatttgtgtctgccatttacaccgtgaatgcctttctttggagtggttccttgtagtgttttttgttgttgtcgttgttgttaaattgtggtaacatatacttaacacaaaaattaccattttaacctttttttgtggggggagggacgggatgtcactctgttgcccaggctggagtgcagtggtatgcttttggctcactgtaaccttcgtgtcctagggtcaagacatcctcccacctcagtctcccgagtagctgggactacaggtgcatgccaccacgtctggcttgatttttttattttttgtggagatgggggtctcactatgttgcccaggctggtctccaactcctgagctcaaacaatctgcctgcatctgcctcccaaagtgctgggattagagacatgagctaccacacccagcctgattttaccaaaagaaacttttttttttttttttgagacagagtcttgctttgttgtcaggctggagttcaggggcatgatctcggctcatggcaacctccatctcccgggttcaagtgattcttctgcctcagcctctcaagtagctgggactacaggtgcgcaccaccacgcccagctaatttttgtatttttagtagagatggggtttcaccatgttagccaggatggtctcaatctcctgacctcatgatccacttgcctcggcctcccaaagtgctgggattacaggcgtgagccaccgcgcccagtcttaaccatttttaagtgtatgtatagttcagtggtgcagaacttttttttttttttttttttttttgagacagggtcttgctctgttgcccaggctggaatgtaggatattatcaagttcatctgtgtgttagaatctccttcttatttaatccttcttgtggtttttggagtctttgttttgtagcatggcaaagcccattgtgtgtgtgtgtgtgtgtatgtaagaagtatatataattatattatggtgtacttggagaagtggagcatgatgaagagtttgatccataatataactggttatatagaaccctgtttagcagacagagcctaggaagttttctgattgtataggttctatgcttttgagaattcctgcttgtgttttgatctcatttccatacacagtccttaaagatcatatttatttatttatttatttatttatttatcgagatggagtctcactctgtcacccaggctggagtgcagtggcatgatcttggctcactgcaacctccacttcctgggttcaagcaattctcctgcctcagccccctgagtagctgggattacaggagccggccaccacgcctggctaatttttgtatttttagaaaagatggggtttcaccatgttggccaggctggtcttgaactcctgacctcgtgatccacctgccttggcctcccagagtgctgaaattacatatgtgagccaccgtgcctggctaagaagggatcgtttaaatttttaaaaataccttaatttatttttatagagacaggatctcgctgtgttgcccaggctggtctcaaactcctgggctcaagtgatcctcccacctcagtctcccaaagtgctgggattcaggtgtaagccaccacgcccggcccaaaagaagggatcttttatcatgtcgggaacagtaactattcatttattcaacatactgatgggctcatcctatgaggcctcagaacacagcatgtttcttggaaaatactggcatgggcaaatgacattgttgagagcttcaggataaagaatcttttagtttagtttgtatatccagactagtttagttttttttttttttttttttttgagacagtctcgctctgtctcccaggctggagtgcaatggcacaatctcagctcagtacaacctccacttcctgggttcaagcgattctggtgcctcagcctcctgagtagctgggattacaggcgtgcaccacaatgtctggctaatctttgtgttttttggtagagaacgaggtttcatcatgttggccaggctggtctcaaactcctgacctgaagtgatccgcccgcctaggcctcccaaactgttgggattacaggcgtgaaccatcgctcccagctggaaggtgactttttttttttttgagacagtgtctccctctgttgcccaggctggagtgcagtggcacgatctcggctcactgaaacctccgcctcctgttcaagctcttctcgtgcctcagcttcctgagtagctgggactacaggtgcacgccaccatgcccagcaatttttgtattattagtagagacggggtttcaccatattggccaggctggtctcaaattcctgactttgtgatccactcacttcgacctcccaaagtgcggggattacaggtgtgagccaccgtgtccggccaaggtgactttttaaagttaaattttaaaacgatctttgaggagtaaatttgacataagcaggtgttcatgcacaaatgccttaaaaggtacacatacttcatttcaaagcagttatttattttgacacttgtctcattaattttcctgctctctcagaaaataggttattttatttagccgtgataattaatgcagtttgttgggaaataagctattttcaatttaccaggcttggatttggtgagtttttatgtaaattaatagatatatgtacatatatttttaaaataactattttagtgaagtttaaattataaatgcttgctcattcactgaatgcttttgtgatgcactttattaagaattgacatgcattctgataacaactttgtaaggtaagtatgcagactgttgtcattttccagactagtaaatttgggattaaagaatcccagggtcacctgtaagatttgagacaggacttgaattcagaacttttgcctgattgcaaagctcaccttcctaatagctttgctctgttgcctgccttctgtgaacagtgcttttaaaaaagtaaagattgtcgggtgtgggtggctcacgcctgtaatcccagcactttgggaggccgaggtgggtggatcatctgaggtcaggagtttgagaccatcctggccaacatggtaaaaccccgtctctactaaaaatacaaaaaattagccaggtgtggtggcatctacctgtagtcccaggtactcgaggcaggagaattgcttgaacctgggagacggaggttgcagtgagctgagactacgccactgcattctagcctgaacgacagagtcagactctttctcaaaaaaaaacaaaaaaaaaacaaaaaaaaaaaacacctcaagaacaaagtaaagatggacctttagataatagctacttgattttcattttctcttccaaatggtttttccaaaatccaactgagttttaaatttggagtcatgtcaaagggacacattctttgtgtattggcagagtaagctgctgctgtttaaaaatctggactatcaatttaaaagtataattaatacatatgcaaaaatggtgtcttaaactgtggtgcaaggaaaataggtctttccgaatagctggtaagatttttccttgtttgttttttaaggatgttgttttggctactgtgaaactcagaactcagagctgaacttgtgatccactgattgggcagatccttttttttttttttttttttttttgagacagagtctcactctgttgcccagggtggagtgcagtggcgtgatctcagctcactgcaacctcagcctcctaggttcaagtgattctcttgcctcagcctcccgagtagctgagattacaggcgtgcaccaccacacccggctaatttttgtatttttggtagagacagaatttcaccatgatgtccaggctggtcttgaactcctgacctcaggtgatttgcccaccctggcctcccaaagtgctgggattataggcatgagccactgcacctggctagatcttttctttattattttgtcattctttccttcacctggcttttttaaaaagttaaatttagctattagctgtctgaagtgtcttgttttttttttttctttaatggggtcaccatactataaagctttaagtacgaatacaacacagttgtaaatcgtttcaaatcttaacccttcaaatttattttattttttcttgagggatatttgttatttattgatgtaagtgccagctttatttcagcagatagaaattaacaattttgtatcttaaaatgtcagcatacgcccctagaaaaatttcacagccggctggccatggtgtctcacgcctgtaatctgagtactttgaaaggccacggtgggaggactgcttgagcacgggagtttgacaccagcctgggcaacatagtgagaccctgtctctaccaaaaaatcaaaaaaattagccgggtgtggtggtgcattcctgtagtctcagctactaagaaggatgaggtgggaggattgcttgagcccaggaggttgaggctgcaatgagccatgtccctgccactgcattccagcctgggtgacagagcaagaccctgtctcaaaaaaaaaaattcaaacccttgatttaaaaatcaatcctgatcaaagatttggcctagggatttcttattttatttggaagtacttgccattcatatatatgtatgagttatatatattcatatatatatgagttaaaaattaaagtcaaatgaactaaaatgagttctttggctctatttcttgtctgctgaagtgtatatgttaatatacattaatataaatcgtgatagtttatatcctgttattaaatatttgtaaaacagaacctctggccgggcacgatggctctcgccagtaatcccagcacttcgggaggctgaggcgtgcagatattgcctgggctcaggagtttgagaccagcctgggcaacatggtgaaaccccgtctctactaaaattacaaaaattagccaggagtgatggtgcacccctgtaatcccagctactcgggagctgaggcagcagaatcacttggacccggaaagcagagtttccagtgagccaggatcgtgccactgtactccggcctgggcaacagagtgagactctgtctcaagaaaaacaaacaaacaaacaaaaaaaaacacagagcctgtgaattgctgacctaatttattttccttgggaaaatacctagtaagcctatggagataaactcttagaattgaagtattgttcattataagcaaggcatacagaagtcctgcctattccaggtctagtgtagtctctggagaacttatcttttctaagatactatgtacagtaaacaggaagctctctgttggaggatatgtcagagctggagattggactagaatactgaagacaatatcgacaacaatgacattttttgagagtttatgagtttactgttttgttttttttcttttgagacagagtctcattctgctgcccaggctggagtgcagtggcacgatctcggctcactgcaacctctgcctcctgggttcaagcgattctcctgcctcagcctccctagtagctgggactacaggcgcgtgccaccacgcccggctaattttttgtatttttagtaaagatggggtatcaccgtgttagccaggatggtctccatttcctgacctcatgatctgcccgccttggcctcccaaagtgctgggattacaggcccgagccactgccccgagctgagtttactgttttaagtgctacctgcattaacatctttaatcctcatagcaatcctgagatgtgaggtaggcactattatgatcccattttaaagttgagaaaaatgaggttaactaatctgaaaaatatagtaagggacagtgttaatataaaactaggcagccagacaactcctgctcttaactgctatgtggtttttggatttgtttgtttgtttgtttttgttttgtctgagatggagtttctctcttgttgcccaggctagagtgcaatggtgtgatctgacctcagctcactgcaacctctgcccctcaggttcaagcaattctcctgtctcagcctcccgagtagctggaattacaggcatgcgcagccatgcctggctaattttgtatttttagtagagacaaggtttctctgttagtcaggctggtctcgaactcctgacctcaggtgattgcctcacctcgccctcccaaagtgttgagattacagggatgagccaccacgcccggcctctttttttttttttttttttttgagaccagtcttgctctgtcgccaatctaaagtgcagtggtgtgatctcagctcactgcaacctccacctcccaggttcaagcgattctcccgcctcagcctcccgagtagctgggattacaggcacccaccaccacacccagctaatttttgtagttttagtagagacagggtttcaccgagttggccaggatggtctagatctcttgacctcgtgatctgcccacctcggcctcccaaagtgctgggattacaagcgtgagccaccgcgcctggcataaaactatttttaaaagaagaaaaatagctacaaaatttaaaaagcaggtaaaatgtacaactaatataaaccagctagtgatctatgactttttttttttttttttttaacagggtcttgttctgtctcccaagctggagtgcagtggtgtggtcataggtcactgcagcgtcgaactcctaggctcaagtgatcctcttgcctcaggctcctgagtagctgggacaacaggcgtgtaccacacctggatactttttaaatttttggtagagaagggatctcactctattgccaagctggtgtcgaactcttggtcttaagcagccctcccacgtcagcatcccaaagtgttgggatttcagaggtgagccacggcgcccagtctgagtcacttttaaacttagaaaatagttgcaagaacagcaaataaacaaaacttgctcacatatctttcacgtagagacttgcattcaagttctgcccatcgttttggtgatggatgtcctttattgcaagactgtaatccaggatcacatttccacccagtttccttgcctctctaatatacttttttgagatggagtttcgctcttgttgctcagactggagtgcagtcgtgcaatctcagctcactgtaacctctgcctcccggtttcaagcaattctcctgcctcagcctcccgggtagctgggattacaggcatgagccaccacgctcaactaattttgcattttttttttttttagtggagacggggtttctccatgttggtcaggctggtcttgaactcccaacctcaggtgatccgcccacctcggcctcccaaagtgctgggatgatgggcatgagccactatgcccagccctctaatatatatatatatatttttgagacggagtttcactctttcacccaggctggagtgcagtggcaccatctcagctcactgcaacttcttcctcctggttcaagcgattctcctgcctcagtctcccaagtagctgggattacaggcacctgccaccacacccagccaatttttgtatttttagtagagatggggttttgccatgttggccaggctggtgtcgaactcctgacctcaggtgatccacccacctcggcctcccaaagtgctgggattacaggtgtgagccatccatcccggcctaatatactttattttagaacagtttttcagtgttttgagtttcattcatgcccttgacctttttgaagactagaggcatttttatagactgtctcttaactcaggtttgtccagtgcttcctcatgcttatattgaggttaagcattttgagcaggaatatccatgttttccttgcattttgttgggtgggacgtggtgtttgtctgtctggagactagtgttaactttgatgacttggttacgatgggatgtgccatgttctccttttttttaaaagaatgaatatttttaaaagaagaaaagtagctatgaactagtattttgtggtacaatactttgggaaaatgaaaatatctccttttagtattgaggaatcctatttctttgagaggctgttttttttggggggggcagaaggtcagttcatagacttaaataccattatagttgttgtctaagcccttgaaaacttaatgtttttctaaagtttaaatttgtagataatggaatttgaaaaatatttaaaatcggattaaattttacagtgtatagtgtggtttgaaagagaatggggggctgggcgcagtggctcacacctgtaatcccagcacttgggaggccgaggtgggcagatcactagaggtcaggagttggagaccagcctagcaaacatggcaaaaccccgtctctactaaaaatacaaaaattagctgggcatggtgatgggcgcctatagtcccagctacgcaggaggctgaggcaggagaatcgcttgaacccgggaggcagaggttgcagtgagccaagatcatgccactgcactgcagcctgggtgacagagcaagactccatctaaaacaaacaaacaaacaaacaaaccaaataaaaagacagagaatggggaattgaggacatctagtcagttggatagatctggattctattcttagcaattctgtgatcttgggcaatttacattgtcttttaagttatcagctgttcttaggttataaaaagatccattttgtaaattgtgtcaagcagatgtcgaccatttataataaacttatcaagatatgaagttaatttctttgctgtcattcgaaagacaaactgatagggtcagcaaactaccttaaacatgttctcattaaaacaaaaattaaaaacacagctcctatagccagacgtggtggcagatgcctgtagtcccagctaattgggagactgaggtaggaggatcctttgagcccaggagtttgcagccatcttgggcaacatagtgagacccttatctgaaaaacaaacaaacaaacaaaccaaaaccctagcaaagcacattttctatagaagctactcagtggacataattaaaacaaatggtagtatcttgaaaaaattaagacatttagtgtgaaccacatgtctagaaaaaaaaattaaatagaaaacattaagatatttacaaagtctgtgtttacaatctgaactgattatattaaatgtatactgacattttagggatgaataaatttccttctgaaaaacagattttagttttggcttttagtacttaataattatagggagaacatggaaatattaaataccaacaatttggctgggcatgatggctcatgcctgtaatcccagcactttaggaggctgaggcgggcaaatcacttgaggtcaggagttcaagaccagcctggccaacatggggaaaccctgtctctactaaaaatacaaaaaaagctagctgggtgtggtgtcaggtgcctgtaatcccagctactccggagatccagccaggagaattgcttgaacccaagaggtggaggttgcagtgagccgagattacgcccctgcactccagcctgggcgacagagtgagactctgtctccaaaacaaaacaaaaacaaaacaaaaaaccgaaaaaaccccaacagtttcagagatgaaaagatttaggcggcctaaaagattgccaaaatgtagtattacatgataatctaaactagttttaatgcagctgaatcctggtttagactaaagtcagctgattgaactactagtattagatcttttggatttattttaagcactattttaggacaaaatatctaacattttacttgatgaattttaactttttcttaccactcattgttttgaagaaattactttgtaaaagtttgagatgtcactaatttttcccttggcattaagcgatacatgaattcattttattcttctgactgaggatgtttctgttagtgtatacattcaagaatatgatgatgccattagtcatttaattttgttgaaacttggctttagtggctgttaataaaatgaattggttggccaggtgtggcactttgggaggctgaggcgggcagatcacctgaggtcaggagttccaagaccagcctggccaacatgctgaaaccccatctctactaaaaaaaagaaaattagccgggcgtggtgacatacacctgtaatcctagctactcgggaggctgaggcaggagaattgcttgaacccaggaggcggaggttgcagtgagccaagatcacgccactgcactccagcctgggcgacagagtgagattctgtctcaaaaaaaaaaaaaaaaaaaaaaaagtaaatttgggttttacagtttttcctcttatacaaaagataactggagactagatctcaaagaatgaagacagctggaaagctggaagacaccagaaaaccaagaaagagagaacttccctgaaatactggccaaggcagaagtgcatccaccagtactgcagactcaccgctgtagtccattttttggaatagggggacaaaaacttaggtttggacggaaaatttctctggtaaaagtattatttctgtctgtctctctctctctctctttaatggacacgggcttactctgtcacccaggctggagtgcagtggtgccatcatggctcactgcagccttcacctcctgggctcaagccatcctcctgtctcggcctcccagagcgctgggattacaggtgtgagctactgagcccggctttttttttttttttttttttaactcaagcctgttgaataattacagaattgaataccattacctgtcttaaatactgtcttccagggacaatatcctagtggcaattattttagctaattttgaaggtttttctcagtttttattcatctaagcatctaggggtttagtgattattgtctgaatgcaaaacattgagttaagaaagatactgatttttgcagtcttgagtttatctcgccttccttaagtaaaggtgcagtgtagatcttcattgcttattacaagtaaaaatagtagcctgtagaaatttgtgcagaagaaaataaaataatgggcctggtgtttctcatcagtttaaatccatttcaccttcgttgagactgagtcttcagtcttttaggtggcgagtcaaggttttactaatttaaactattgtctaaattcagggctgtctttcattgttaaaggagatagtttgcctgacagtacctggaagcagtgttttgtgacataagtaatgtgttcacctagataatcggtctgtaacctactcatatatatatattttttgagacagagtctcgctctgtcacccaggctggagtgcagtggcgcgatctcggctcactgcaacctccgcctcccgggttcaagcaattctcctgcgtcagcctcctgagtagctgggaatccaggtgtgcgccaccatgcctggctaatttttgtatttttaatagagatggggttttagcatgttggccaggctggtctcgaactcctgaccttgtgatttgcccacctcagcctcccaaaatgctgggattacaggcatgagccaccgcgcccagctatatttttaaaaattttttaattttttgagatggagtctcactctgttgctcaggctggagtgcagtggcgtgaacttggatcactgcaacctccgcctcccgggttcaagggattctcctgcctcagcctcctgagtagctgggattacaggcgcccaccacacccagcttatttttgtatttttagtagagatggggtttcaccatgttggccaggctggtctcgaattcctgacctcaagtgatccacctgacttgacctcccaaaatgctgggattacaggcgtgagccgctgccatattttccatttattttttttttaaccaaatgccttattttcttagaatgtgactgatgctgatacagaaagttcagtgtccactatcatctttgctttctaatgaaaaggatattatactttgcttcagtcagttcgtttatgatgagtggcagttaattctctgctgaaagactgtgtagtattatagttgcaatcactgtctaattatttaccttgtgttgattatgtttttaaaacctgccattctttgattgttattatgcattaaaaaggcagtttggtcttgaactctagacctcaagcgatcctcctaccttggcctcccaaaatgctgagattacaggtgtgagccaccacacctggctgtaaagaggcaatttggaatttagagagggattctagtcccttgttaaagaactaactctaggctgtgcacagtggctctcgcctgtaatcccagccctttcggaggccgaggcaggcagatttcctgaggtcaggagttcaagaccagcctggccaacgtggtgaaaccccatttttactaaaaatagaaaaattatctgggtggtggcggacacctgtaatcccagctactcaggagtctgaggcaggagaatcgcttgaacccgggaggcagaggttgcaatgagctgagatcacaccattgtactccagcctgggtgacaagagccagagtccatctcaaaaaaaaaaaaaaaaaaaaaaaatatatatatatatatatatgtatgtatgtatatacacatatatatatgtatgtatatacacacatatatataattttatatatttatttatatatatttgtgtatatatattataacatgaaaaagaaatagggcatgaatgtaatttaaataaaagagtgttctagcacctgcccacttgccagtctgactggaaccttgttttgaagcagaaatgtattgaaagttcagaagtatctcagagaacagcatcataaaaaatattaagaacctcagtttttattagggtaatgataaggtttgtaaaaatcttcaagcgcgttcttcctttcactcactataaaatatttttttttgtctgggtgcagtggcttatgcttttaatcctagcactttggtagactgaggcgggaggatcatttgatctcaggagttcgagaccagcctgcgcaacatagtgagacccgatctctactaaaaatacaaaaaattagccgggcgtggtgctgcaagtctgtagtcccagctagtagggatgctgaggtgggaagatcgcttgaacacaggaggtggaggcttcagttagcagtgatggtgccactgtactcgtccaggcaacagagtgagactttgtctcataaaacccaaaaccaaatgttgttgtgtgctgtttggtattaacagcaaggaatcagataattaaagcagaagtacagacaaaaagaaaattttatggaattagttattggcttattttgaggaagaatggatcagaacagcaaggacacggataaatctaatacctgaaatggatctccaacaggaaactcgaggatttcaaacaatggctagagtcttgttttcagagataaagaaggcatcacatatacagtagccaaccagaatcggagataaacaatgaaatagcaacaggccaattgagttcaactttgaaactcatgaaggagaattaaaatcaaatcagggaaacgaaaggtgaagtcaaaaaacgttgagaatagaagaactgaggagattgaaaaaatgggaggctgggcgcagtggcttatgcctgtaatcccagcacttggggaggccaaggcgggcagatcacctgacgtcagtagttcaagatcagcctgaccaacatgacgaaaccccatctctaaaaaaaatacaaaaattagctgggtttggtggcaggcacctgtaatccgaactacttgggaggctgaggcaggagaattgcttgaacctgggaggcagaggttgcagtgagccgagatcgtgccattgcactctagcctgggcgatagagcaagactctgtctcaaaaataaaaaaaaagaaaaaaagaaaaaaaaatgggaaagaaggcataccaggctcacatagctgttattttttgtgtgtctgtttaatcacagtatatcccgtgtcatcttgttctgaccagcccacagtaattgggtttgggtaggctcatgacacatatgcccagatcttttacacaaaatgtaatgggaaggctgggcatagtggcttacgcctgtaatcctagcattttgggagcccaaagcagacggatcaactgagatcagaagttcgagaccagcctggccaacatggcaaaatcctgtctctactaaaaatacaaaaattagtcagacgtggtggtgcacgcctgtaatcccggctactcgggaggctgaggcaggagaatcacttgaacccaggaggtggaggttgcagtgagttgagattgtgttactgcactccaacctgggcgataagtgagactccgtctcaaaaaaaaaaaaaaagtaatgggaggatgtgatagttctctgcctctgggatcacaggacaggaatgtggtacgcatgaaggtgcatgtggctgtcaggtctgccttagggagaacacccttctgcttaagctgagagaattctaatgacttattttgtggttttggatctagctatatgtggagccagtataacctttagacttaattaattaaatgaagcaataaaagttctcttttgtacttgatcttgtttgaattgggaattggtaacctcgcaatctaaagtagttctggctaattcataaattgttcttgagaataaaggatatggaaggtatggttcccagagttggtgaggttagttattcttactgaaaacaaccaacactgttgtaaaattataaaacaaaacttttgtgaaaacaccagaaagttgaaaagtagagaaaatttgaagggctgggttatgggaactcaattgacagaagtgagaattactcttgtcctgaaggcaaacatttcaccacttgaccttgagttttaaaagctttgtggggtgagagactcagaatagtctgcatccttacttgtggcctgggttaacttctactgggtgggccaaggaaccaagtctcgaacttggattagagtgattctaggcaggtgttgtctcttgacacctggaggaagctgccttcaccctaggcttaagattataagtaattttttcacgtaaaataactaactcactaagataattaggcatagaagggaataagaaccatgcataagggtaagaaccactgggaacaacagaaatagtcctgcaaaaacttgagatttggaattatcagagactataaaataactgccccattaccaaagaaatatgacaatcttgaaattccttagagagtaggaaactataaaatatgacttagcagtaactagaaatcatagaaatgaaaattacaaacaaaattaaaaaccggataggtgttttaacaacagaataaaaagatgaagaaggagttagtgaaatggaaggtaagccagaagaaataattgtttagtatggagaagaaaacgtaaaaaaaggtaagaagctaaaaggataagtgatgactaacatacattaatgtgagtcccagtaggataggagatagagaatggggcagaatctaaagagacaatagcttagagttttccacatcgaaggataccatttcatagttaagcctatgaatgacagacatatgtttaataaaaataaaatctacacctagaatacacagtgaaactgtagaaaacatcttagacaaagaaaacctcttaaaaacagcaggagtaggaatgggaatcacctaaaaagagaccgtagattacttctcaatagcgacagtggaagccaaaatataatgacaccaacagataatgaaataaccttagtgtgctgaaagaatataattgtcaacctaggtttctattccagcgaaaatacctttcaagaaaaattttttagcaaacaaaaacagtttgtcaccagaggacagcaggaacacaaaagaatgagcaaattatgtcataaatacgtggttacatctaaaggaaaattaaattaagcaaaaatagtgttgcatctaaaaatacagaattaggccgggtgcggtggctcacgcctgtaatctcagcactttgggaggctgaagcgggcagatcacctgaggtcaggagctcaagaccagcctgcccaatgtggtgaaaccccatctctactaaaaatacaaaaattacccgggtgtggtggcaggcgcctgtcatcccagctactcgggaggcagaggcaggagaattactcgcacccaggagctggagatttcagtgagccaggatcgtgccactgcactccagccggggcaacagagcgagactccttccccccaccaaagaaaaaaaaaacttaaaaactcgtacctagttgcattccttatgagcacagagcaaaatgtcctcattttacctggtttaattttttttttcttccacggcctcttttactgggagacctctgagttttgatgtgtcatgacagataggagaggtcatatccttgtgatttgtggttcattgctggtgacatcagaaagtaaagtcaaccaggaaaagactccatgggcctggctcaggtggcttctggagcaccacctccatcaaggagcttttcctggggtccatgtgtagtccatgttgcctgctctcccacccagggttgctgtgcttattatacaagatggccaataaagcatgacatatattcaataaatgttcatttctttttccaacccttcttattttaagttgagggtattcataaaagggattgagcatttccatttatggacgaggcaactgagtacagcccccaggggcacgcagcgagatggctgtctgctgaacccatacaccagctctctaggcgtttggtcctgtggggaccggtgcatcagatgcttcctaagctggcgtcacctgcctggcccgatgcctcctctggtgttcattgtttaattaatgccacctcctgatggcagtttctttctgggaagaggagaaaagagagccgtccccaagtgaagggtgcagggaagcctccacgaatagtttcaactaaggactgtcccaggaaggaaactcttgggatgggcaaagaacagcgaacttccggtgtgacccggatgcacccatttccagagagcaggaagcacagagaaggcccgtgggtcgcccttggggtgctttccatcctgcagggctcgctgcctgccctgaaagttctgataaagacataggaccttcatcaccaggggcgccccgtgggctgttgctgtagcgtctgtcccccatttcttacacacattgagtgtgattgttaccagtggagggtgtccaatggaagaagcaccaaaagccgagatttattgaaagtggaaggtacagtccacaaagagggggcgggccgagcctgggggctgaagagcccctttacagaattttctggggtttaactaccttctggggtttaactttctggggtttaattttctagaggtttcccattggttacctggtgtacatcctttgtaaatacagtagtggcctgcaagcagtctgattggttgtgaaaagcaaccaattagaggctgacttgaagttacaaaggttacaccctatgcaagcatctgtggaaagcaaccaatcagagactaaagtgaagttacaaagttacacttgtatgcaaatgacgacttgccctgccgggctccagtaatcccagtactttgggaggccaagatgggtggattacttgaggtcacgagttccagaccagcctgaccaatatggtgaaaccccctctctactaaaaatacaaaaaattagccaggtgtggtggcagttacctgtaatctcagctactcgggaggctgaggcaggagaatcgcttgaacccgggaggcagaggttgcagtgagctgagatagcgccattgcacttcagcctgggcaacaaagcaagaccctctctcaaaacaaaaacaaaaggccgggcgtggtgggaggccaaggtaggtggataacctgaagtcagaagttccagaccagcctggccaacatggcgaaactccatctctactaaaaatacaaaaattagttgggcgtggtggcgggcacctgtagtcccaggtactcgcgaggctgaagcaggagaatcgtttgaacccggaaggccgaggttgcagggaacccagaacgtgccactgcactccagcctcggcgatagagctagactccgtcttaaaaaaagaaaaaaaaaagtccgggggcgatggctcacgccggtaatccggccgaggcgggcggatcatgaggtcaggagatcgataccatcctggctaacatggtgaaaacccgtctctactaaaaaacacaaaaattagctgggcgtggtggcgggcgcctgtagtcccagctactctggaggctgaggtgggagaatggcgtgaacccgggaggcggagcttgcagtgagccgagatcgtgccactgcactaaagaaaaaggaaaggaaaaaagacttggtcgcagtcagtctgggattcgttgcaggaagcaaccaatcagaggctgaagtgaagttacaatgttacactcctgtgcaaacgtctgattggttgcagaaagcaaccaatcagagatactttgaattttccatctgggacacagaaaaagtgggggtggtggtttgcaaactgagtagcctcccatccttttgttacttaggtgtgaaaagttggggttttccttttgatttagttctaggaagtcagcatgaattggccttaggttccctgcctccagaccctattctccggcctcatgatgacttgatggcagatttatggcgattaaagatgagaaaaagtggtaacagcagtaggcagaaaattgccctagtttcatgttctgactgtgatagtggcaatatgaccttgacaaatcactgcatttgtaaaatgagaacacatctctgttttctttcgctggggaattaaaggaaaagtgagattatgaagaaatactatgaattttcagaaataatgaaagtgtacgctaagtgaatgtctaattatagaaacatatatgcctttgttgtccatttcgcctaagccacattttaatggaaatttacttagacttgggggagagggagagggaaagaaaaccagacaaattcacttagttttatccaagagaaaaagaatgggacctaagctgttaggccaaataatttctataatttacctattcacttgcttgatacggcctttacttccgtctctagtcagggacccttgtgttgggaatcagatttgcttctgtttgttcaaatatatggggataagtgttttgtttgttttgtttttgttttttttttttgagatagagtcttgctttgttgtttgggttggagtgctgtggcgtgattttggctcactgcaacctccacctactggattcaattgattctcgtgcctcagcctcctgagtgactggaattacagatggtacaccaccatgcctggctaatttttgtatttttagtagagacagtgtttcgccacattgcccaggatggtctcgaactcctggcctcatgagagtcacctgccacggcctcccaaagtgctgggattacaggtttgagccactgggcccagccaagtgtcaattattttttattatggtttgtatttatttattttattttttttgaggcggagtctcactctgtcgcccaggctggagtgcagcagcgcaatcttggctcactgcaacctccgcctcctgggctcaagcgattctcctgcctcagcctcccaagtagctgggattacaggtgcgtgccaccatgcccggctatttggaatttttaatagagacagggtttcaccatgttggccatgctgatctcgaactcctgacctcaagagatccacccgcctcggccttccaaagggctgggattacaggcgtgagccaccacgcccagtggattatggtttttattataaagcgcaacttcctaagtatgtatgcttcgttatttgttgatgggtaatctgggctagcagttaattcacatggtaacagataaagctagatcacagtctttaataatagggaaatagagcatcctctttaataatagggaaaagatttactgacatttttaggcataacagttttctgctgacagctcctcagctgcttgtccacgttctccagaaccctggggctttagttaaggaatactcgggtgttgtcagtaaattaatttgtttttacagttactattcttgtttccagtgtttaatttttaaatttttcagttatctttccatattaagtttatttaattattcaatagctccctaaaagtagaattaattcaactaaattaaaagggacaatttttaataggcatctaatttgcatgctatttacagaaaacctttttagtgtttcagttttagaaatttgctttagattttgccatgttagtatgtctttatatggtgtattgttttggttttattttggtaaaatatacataatttttttgtgtgtgtgacaggctcactctgtcaccaaggctccagtgaggtggcgtgatctcggctcactgcaacctccgtctcccaggttcaagcgattcccctgtctcagactcttgagtagccgggattacaggcgcccaccaccctgcctggctcatttttgtatttttagtagaggcagagttttgccatgttggccaggctaatctcgaactcccgacctcaggtgatccacctgcctcggcctcccaaagagctgggattagagacatgagccaccacgcctggccagtatgtttttatatggtgtgttgttttcattttattttggtaaaatatacttaacataaaatttacacttctaaccattttgttttgtttttttgagacggagttttgctcttgtcacccagactggagtgcagtgctgcgatctccgctcactgcagcctccgcctcctgggttcaagcaattctcctgcctcagcctcccaaagtgctgggatgataggcatgagccaacgtgcctggccagaatatgctgtattataaagaatcttacatgttacttgatgcctgtgatctattttcttagtaagaagagaaacttctctccactcagcctcagtccactgtacccactcttttgtgtgtcaggatgttcaggggagaagagggcttagcatctctgtcctgtgttgagttgtggttgcccgtcactgggctgtaaagtgccttgcctcgtcttgttcttacttgggagaaatttcactgattctgggtgccacctggatttatttggggtgtgatattgacccaattttctggaaataacaatatatagaaaattaggggatagattctttatcttatgagggtttgggcaagtcaaatacttagtttctgagccttattttgtctctagagcaagaaaactgtaaattaggcagccggtgaggggccctcacagctttggctgtgggttcaggacaccagatttctaccactcactttcttcttacttctcctgcacagggatcatggcccaagttgcaatgtccaccctccccgttgaagatgaggagtcctcggagagcaggatggtggtgacattcctcatgtcagctctcgagtccatggtgaggccttctgttccatcattccatagttgggtaggcctgcactgtagataaggttgatttgtttttgtggaagatagaattttatggtttttagttttaatgagtactttttctttacttttttttttttttttttttttttgagacggagtcttgctctgttgcccaggctagagtgcagtggcgagatcttggctcactgcaacctttacctcccgggttcgagcgattctcctgccttagccttccgagtagctgggattacaggcgcctgccaccacacctggctaattttttgtatttttagtaaagacagggtttgaccatcttggccaggccggtctcgaactcctgacctcttgatccacctgcctcagccgcccaaagtgctgggattacaggtgtgaaccactgccccaaccaatgagtagtttttcttcttgaatagttatgggtttaagcctttcacatcacagtcattcattcattcattcatttatttgagacagagtttcgctcttgttgcccaggctggggtgcaatggcatgatataggctccctgcaacctctgccccctgggttcaagtgattctcatgcctcagactcccgagtagctgggattgcaggtgtgcgccaccacgctcgggtaattttttgtatttttagtagagacagggtttcaccatgttggtcacgcgggtctcgaactcccgacctcaggtgatccacccaccttggcctcccaaagtgctgggattataggctgaggtcaggagttcaagactagcctggccaacattgtgaaaccctatctctactaaaaatacaaaaaaattagccagcgtggcagcgtgtgcctgtagtcccagtaacccgggaggctgagacaggagaattgcttgaacccgtgaggtggaggttgcagtgagccgagatcgcgccaccacactccagcctgggcgacagagtggaactctgtcttaaaaaaaaaaagaaaaagatgcccataaatattttgttcccaggttgttatggtggtattatttttaggggggaaaattggaatcaccaaccttttaaataatgttatcagtaaatcattcaaggtatattcattaaatggaatactatatactctgtaacattttaaaagaatatttaatctcgtagaaatatgcttagtaaaagtcagtaaatactctgcccacctaaaagtgattctggctgtgtgtacacaggggaatacttctggaggtggggattatgtaatgaatgctgtagtgtgggtttcagacccccaccctccttttgtactgagggcactaattgcccaggtgccatggctgttcgagcaccttgtacaagattccaccctttcccaggggagggccatgccagctcccagctctgggtgcagctacatcagtgttcagtgcttcgtctgtccggccctgcctgccttccgcctcccaagtgctgtaattgacagtgccccccagcaagcctgtgtaaactctcagtctactacttggagaatctgacctataagagattacaagggaattgtgttttttttttccttataaattctgtgttgtcttttgtttaaaatcaggccaaaaactatctcgaaagagaagtacctttaaaaaatgttgttagtttttttaattcatcgagcagaaatgatgctcttaaacgtccgcctgtaacatgatgtttgctgtttgtattgtagtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtaagcattgtatttttatcttttgcatttcattaattttaagcctaaatatttgtaggtaagacaagttatattattttctttctttctttctttctttttttttttttttgagatggagttttgctcatgttgcctaggctggagtgcagtggcacactcttggctcaccacaacccccgctgcgtgagttcaagtgattctcctgcctcagcctcccaagtagctgggattacaggcacgcgccagcacgcctggctaattttgtatttttagtagagacggggtttctccatgttggtcaggctggtctcaaactcccgacctcaggtgatctgcccaccttggcctcccaaagtgcagagggattataggcgtgggccactgcgcctggccaagttatattttcttctaaaacagaatgaggtttaaactaaaaaagattttctgaaatgtttatggagacatttcaaaatgctcaaaaggaatcactgaaatatgtcaggatagatactgaagagttaagaaaaatggtagtgtttgttgtacggtgttccttgcttggctttactctgggttaatgagatgcattagagagaaggtaatgaaggtagagaaattttgaataggttaaaacttttactcagataaggagttattttctttttcttttttttttttgagacagagtttcactcttggccccctgggctggagtgcaatggcacgatctcggctcattgcaacctccacctcccatgttcaagcaattcttctacctcatcctcccgagtagctgggattacaggtgcccaccaccatgcctggctaatttttgtaattttagtaaagacagggttttgccatgttggccaagttggtctcaaactcctgacctcaggtgatctgcttgccttggcctcccaaagtgctaggatttcaggcatgagccaccactctcggctttttttttttttttaagagatggggtctcgctccgtcaccaggctggagtgcagtggcgcgatctccgctcactgcaacttccacctcctgtattcaagcaattcttctacctcagcctctggagtagctgggattacaggtgcacaccaccatacctagataattttttgtatttttagtacagacagggtttctccatgttggccaggctggtcttgagctcctgacccgaggagcccacctcggcctcccaaagtgctgggattacaggcgtgagccaccacatccggccgggagttcttttctagataaaaagttggtgtgttgaaaaccagtgattcactgtgcaagtttgtttaagcatattgcaaaattaaacagttctcctccactccctcacagatacgagtcaccttatcacagtcttcagtgagttttgtaatctgcatttagagcagtggtgagcttatttgacattggaacagtgttgaaatttactatagggttttaatacccacagcctttcacagtatgaccattttcatatctgtgtttaacctaacactgtaggttttatgttaactgattgatacagcattttcttaaaaacatggaaagggaacaaaaaaagctagggtatctataggcacatattatatatgggcatacctcattttttgttgttgtcatttttgtttttttgagacggagttttgctcttgttgcccaggctagagtgcaatggtgcgatctcggctcaccgcaacctctgcctcttgggttcaagtgattctcctgcctcagcctcccgagtagctgggattacaggcatgcaccaccacacccagctagttttgtatttttagtagagatggggtttctccatgttggtcaggctggtctcgtactcctgacctcaggttatctgcccgcctcggcctcccaaagtgctgggattacaggcgtgagccactgtgcccgaccgggcatatctcattttttttttttgtgccttgcagacactgcagttttcacacattgaagatttgtggcaaccttgtgtcaagtctattggtgccatttttcctgcagcatgtgcttacttggttctctgtgttgcattttggtaactcttggcatagcattatttgagactttttcatgattattgtatccgctgtagtggaattttttttttttttttttttttttttttgagatggaggtttgctccgtcaccctggctggagtgcagtggtgcgatctcggctcactgcatcccctgcctccttggttcaaggtattgagatcagtgatctttgatgttactattgtaattgtactgggagtcctcgaacgcacacatataatatggcaaacctaataggtaaatatgtgttctgactgcttcaccaatcgcctggtcccccatcattccctttcctcaggcctccctggtccctgagacacaatattgaaattaggccggccaggcacggtggctcatgcctgtcatcctagcactttgggaggccgagatgtgtggaccacgaggtcaagagatcgagaccatcctggccaacatggtgaaacaccatctctactaaaaatacaaaaaattagctgggtgtggtggcgcgtgcttgtagtcccagctatttgggaggctgaggcaggtgaattacttgaacctgggaggtggaggttgcagtgagccaagatcgtgccactgcactccagcctggcgaaagagcaagactccgtctcaacgaaaaaaaaaggaaattaggccaattaatagacctatagtggcctctgagtgttcaagtgaaaggaagagttgcaggctgctcactttacatcaaaagcagaaatgatgaagcttagtgaggaaggcatgtcagcagctgaggtaggctgaaagctaggctgaacaggtagccaggtggagaatgcgtaggaaaagttctcgaaggaaatgaaaactgctgctccagtgaacacgcaaatgataaagcaaaacagcttattgctgataggaagaaagtttgaatggtgtggatagaagatcaaaccagccacagcattcccttaagccacagcgtaatccagagtgaggccctaactctcttcaattctgtgaaggctgagatgggtgaggaagctgcagaagaaaaattggaagctagcagaggttggctcatgaggtttaaggaaagacacagtcagctgggggcggtggctcacgcctgtaatcccagcactttgggaggctgaggtgggcagatcgtctgagctcaggagttcaagaccaccctaggcaccctggtgaaaccccgtctcttctaaaatacaaaaaattagccaggcctggtggcgtgcacctgtagtcccagctgctctggaggctgaggtacgagaatcgcttgagcccaggaggcggaggttgcagtgagctgagatctcgccattgcactccagcctggactcttgagatctgtctcaaaagaaaaaaaaaggaaagacagagtctctataacataaaagtgcaaggtaaagcagcaagtgtttgatgtagaaactgcagcaagttctttagaagatctagctgaggtaattcatgaagatggctacactcacaaaacccgattttcaacgtagacaaaacagccttatattggaagatactctctaggactttgctagctagagagaagttcattcctggcttcaaagcttcaaaggacaagctgaattccttgtgaggggttaacgccgctggttactttgaagccatgttcatttaccattctgaaaatcctggggtcctgaagagttacactaaatctgctctgcctgtgctctattgatagaacaataaagcctggatgacagcacatctcttgatagtgttgttcaccgaatattttaagcccacttttgagacctactgctcagaaaaaaagattgctttcaaaatatgactgctcacagtcactcacagagtcctgatggaggtgtataaggagatgcttgccattttatttttattttttatttagttttttttgagacagagttttgctcttgttgcccatgctggagtgcaatggcgcgatctcagctcactgcaacctccatgaacactgttgaaatgataacaaaggatttagagtatgacataaacttagttcataaagcaatggcagggttttggaggattgactccaattttgaaacaagttctaccgtgggtgaaatgctaccaaatagcctcacactacagagagacctttcatgaaagcaagagtcaatgtaacttttatatgcattgggaaaccaaaacatctgtgtgactttactttatacttgtattattgtggtgatttggaaatgaacctgcagatgcttgtatgccactaaggtctaaagttaaacttctgatgtcagtttagattaaattggtgatacattcagcaacttattagtgaacaaaaagttttgttaattcacgaattttaattcccaattgtatttttagtttgttttaaaaactatcccctgccactgtattcctccccctgtcccttacccccatgctgtaatcttctaagctttatgttagtaacttatttttaaaatgttgacattattataatgttgagaaatgttcaagcattgattatgtttctgtgtttctttatactaataatgctgttttgattgtgtgtgtatcagctgctgtctgccccaccaataccataagcccgcctgcagctgtacttattctccccttccctgtcctgcctggcttatgtggttctccactggttagaactaagcattaagggcgctgtcctcagctgcaagctgtagtcactgtccatcagtattcatactttgtttttattgctaataattttttttttttttttaaggagtctcgccctgtcacccaggctggagtgcagtggcgtgatcttggctcactgcaacctcagcctcccaggttcaagcgattcttctgtctcagcctcccgagtagctgggattacaggcacacctggctaatttttgtatttttagtagagatggggttttgccctgttggcctggctggtctcgaactccttacctcaagtgatccacccaccttggcctcccaaagtgctaggattaccggcgtgagccaccgtgactggcctcattgttaataatttgatccatggagaatggtttctgtatctaattctccttcttctctttttttttgagacagagtctcactatcgcccatggagtgcagtggtgcgatcttggctcactgcaacttctgcctcccaggttcaagcaagtctcctgcctcagcctttctagtagctgggattacaggcgtgtgtcactacactcggctaattttttttttttttttcgagacggagtctcgctctgtcgcccaggctagagtgcagtggcacgatctcagctcactgcaagcttcacctcccgggttcacgccattcttctgcctccgcctcccaagtagctgggactacaggcgcccaccaccatgcctggctaattttttgtattttttagtagaggtggggtttcaccatgttggccagactgatcttaaactcctgacctcaggcgatctgccctccttggcctcccaaagtgctgggattacaggcatgagccactgcacccggcctaattctcaagtacctcttacttgtttgtgtaaagtactttgcagataaggagcaataatggtcttctggaaggtaatcaataggtttatgaggcaatcatagaaattcttcaggagaattctgagcgcttttctgggatttagaaaagcgttgttcagcagaaaaaagtatcatgtgagtctctcacataatttaaaactttctagttagaacattaaagaaaaataaagaaaaacaagtgaaattcattttactggtaatactttaacttattatatctaaaatatttcaacatgtaatcaatttaaaaattattaatgggccgggtgtggtggctcatgcctgtaatcccagcactttgggaggcagaggcaggcggatcacgaggtcaggagatcgagaccatgtggccaacatggtgaaaccctgtctctactaaaaatacaaaaattagctgggagtggtggcgcgcacctgtaatcccagctactcgggaggctgaggcagaagaatcgtttgaacctgggaggtggagattgcagtgagccacgatcgtgccactgcactccagcctggtgacagagcaagactccgtctccagaaaaaaaaaattattaatgggatatttgtcatactttttttgtaccaagtcttcaaaatccagtgtgtattgtacactcatgaaacatctgaatttggaccagccaagttgcaagtgccacatgtatctatttgttatcgtgctagactttgcaagcctagaatttttttgtgtcgataatcttctcatatttaaatttgtaaccaatacaaattttcttttttaaagtagtacaagggtactggtatgtagtatttttagctatagctacacttatttcagagatggtcaccatttcatattactttcattcatctaagtattttagatttttatttgaaaagttcccttttaaatctccatctccctgccttttattttttatttttttgagacggagtcttgctctgtcgccaggctggagtgcagtggtgcaatcttggctcactgcaccctccacctcccgggttcaagcaattctcctgcctcagcctcccaagtagctgagactacaggtgtgtgccaccatgcccagctaatttttgtatttttgtttgtttgtttgtttgtttgtttgagacggagtctcactctgtcgcccaggctggagtgcagtggcgcaatttccgctcgctgcaagctccacctcccgggctcacgccattctcttgccccagcctcctgagtagctgggaccacaggcgcccgccaccacgcccggagaattttttgtatttttagtagagacggagtttcactgtgttagccaggatggtctcgatctcctgacctcgtgatccacccgcctcggcctcccaaagtgcagggattacaggcgtgagccaccgcgcccggcctaatttttgtatttttagtagagacggtggtttcatcatgttgaccaggacgctctcaatctcttgaccttgtcatctgccagcctcagcctcccaaagtgctgggattacaggtgtgagccaccgcacctggccttttttttttttttttttttttttttaatttaagagacacagtctctatccatcacccaggctggagtgctgtggtatgttctcggccccatcatagctcactgcagccttaaacttctagactcaagcagccctcacttcagcccccagacagctaggactgcagacatacaacactatacctggctattttcatttttttgcagagatgtgtccttgttatgttgccaaagctggtcttgaactcctgggctcaagcaatcctcctgcttcagcctcacaaggtggtggaattacaggcgtgagcccttgggcttgtcctcttttttgcttttataacaaatcacaaatgacttgctattttgttacaaaataacaaatcattggttacaatgattaataaatgttaaagaatggttaggaaatagttttttcctgttagaatacatgataaaagtagttttccctgttaggatacaggaaaacgatttttactaaaaaccaaatattaaggtaatggatatggaccttattattatttttttattttattttttattttttttacaggtgttgaagaagaagaaaaagctgcagagatgcataaaatgaaatctacaacccaggcaaatcggatgagtgtagatgctgtagaaattgaaacactcagaaaaacagttgaggactatttctgcttttgctatggtaaaaacaatagatttaatttttctaaaagatacattatataattgaattttctaaagggaagcttatgtaattgattcgaaaatcatataacacacattttcagtgactgaatggattagcaataaccttactttcttccacttccattttgaaggaacccaggaggaagtgtggccagtagagctgtttctttctttctgttttttttttttgagatggagtctcgctctgtcgcccaggctggagtgcagtggcacgatctcagctcactgcaatctccgcctcccggtttcaagtgattctcctgcctcagccccctgagtaactaggattacaggtgtccgccaccatgcccggctaatttttgtgttaaattttagtagagatggggtttcaccacattcgccaggctggtctcgaactcctgatctcaggtgatccacccaccttggcctcccaaagtgctgggattacaggcgtgagccaccatgcctggcctagctgtttctttctaataagcatgctcatctctctaattccatgcaaagccaccttttcttactcttgtcacatcataaaacaaagctcttacaagaaaacagtcaaaggaggagattgaggttttactgcagggtcataggtgaaaatcaattctctggaatgggattttcagtatgtgtgaggctcgctgcccaataggttgacagtatatactcatttgtaaatgggaagtttgtatttacctgataagttttcaatgagaatattagccaaaacattcctggtattttatggtaatagttggatgtgctgggcttctgtattctgaggccaaattgtacctgagaatatgccaggatgggaccatcttcaagaaagacaatagtgcaagaaaccaaccattgctctctctatgtgttttttaaagtaaaatattttatctacttttcattttggcccttcggatcagtttcaggtttagaccttctgctgacatggggagatagaatgctgtagtattaattaattttgaaatcatatattataaaaaatcatggatgcccttattaagccacaataagctagcgatgatttcattttgtaatcttaccattgaatgatgttcatccgcttttcatctgccccagggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagaggtgaagtgctttctccctttgtacccatcaacagttgattcgtataaatttgaatatttagcttacgttaatgtatttttaaaatttatatttaacacagaagtcatttaaatgtatgctttacaataattttgcgtattcatacgaagttttgttttgttttgttttaatgcagaccttttttagagccaaagaagcatgtaggtaagtaagtgctttgcttccttgatagctggctggcctccgttttgctagattttcatacactttaatggtttctgttttattgtctttgagaatatgatgtcagacattttcggatgggctgtttagatgtttatataatccacaaaaggttcattgagctaaaaaagtggagacttgtttttttgttttcagcttcgctgcttgttttctatagaagatcatacatctgccctcacttaccagaattatgagtaggatttaattgacctaatgtcatcgactcggcaagatgttgttgggcacagcattgggtggggaggggatacgcagctgtgtatcagcattaccacttttgagagctgtgagtctcatggaagagagaaaattctgtaaaatgaacatggcaagaacattgcatccctacggcaagaatggctctgagaaagtgctgtggatgttattggaggttggattcctttatagttcaggaaagagttcatgaggaagagagcatttccaggaagggcgtttgaagaatgatgcggatttcagcttcctttagggaagtctagccatttcatttgaagggaaaacaggataaagagtaataccctttagagccaggtttatttgagactttcggaagtaaataaccagtatcattggaatacttttaaacatgtaactatgaaaggaaaaaattatatatacataaacatacacattgtgttttctgttaacctttgtcttattctcattgtggtgaaaagattaattttttagcagctttattgaggtataattgatacaccataaaattcacctgccttttttttttattattattttttgagacggagtcttgctctgtcgccaaggctggagtgcagtggcgcgatcttggctcactgcagcctctgcttcccaggttcaagtgattctgcctcagcctcccgagtagctgggattacaggcacatgctgccacgcccggctaattttttgtatttttagtagagatggggtttcaccatgttaggatgatctcgaactcctgacctcaaatgatccacccgccccggcctcccaaagtgctgggattacaggcgtgagccactgtgcccagccaaattcacctgtcttaagtatataattcactaatagtagatttacaatcttaaaatgtttttaaggggtttttacccatcatcacagtcttaattttgggatgctttcatcgtccctgtctctgttatttcatgaatgttgtagaaatggaatatgtagtatgtatcctattgaaatgagcttttttcactgagcatcactcactcgaggctcatcgagcttggtaggtgtagccgtagcttctttttattgctgagcactaactattctgtgacatgaacatactgtctgttgatccagtcatcagtttatagatattttggttgtttccacctttgggtattgggaataatgttacagtgaacatacttgagcaaggttttgtctggacatattccttgatatctcttggatatttacgtaggagtgcaattactaggaatagggtaaatttacactgaacttttttttttttttaattgagacggagtctcgttctgtcaccaagttggagtgcagtggcatgatcttggctcactgcaacctccgcctcgtggattcaagagattcacctgcctcagcctcctgagtagctgggattacaggcacgcgccaccacacccggctaatttttgtatttttagtagagacgaggtttcaccatgttggccaggatggtctcaatctcttgacctcatgatcaagggaggcctctcaaagtgctgagattacaggcgtgagccatcgcgccctgctacactgaactttgaagaaactgacaagctgttttccaaggtggctataccatgttatattctcacagcaggataggagggttacccccacattgctgccaacttacttcttgattttagccattgtaatagatgtgaagtggtatctaattttttttgatttttaaaaatttctctagtgattgttgatgtgtttttacttttctttctttctttcttttttttttttttgagacagggtctcaccctgtcgcccaggctggagtgtagtggcgccatctcagcttagtgcagcctcaacctcccaggctcaagcaatcctgctgcctcagcttctcagtagctaggactacaggcgtgtgccaccatacccagctcatttctgaacctttttttggtagagacaagctcttgccgtgttggccaggctggtctggaactcctgagctcaagtgatccgcctgtgtcagcctcccaaagtgctgggattacaggcttgtgttatcttcaattgtgcttattggtcatccatacatattttttggagaaatatctatttaggtccttttcccatttaaaaattgggtttgtttgtctttttattattgagtcttgttttttatatagtcttgatataagtctctaattgatgatttgttaaaaaaaaattttttttttctttttgcaatggtgtcactctgttatccaggctggagtacaggatttgggaatattttctccaattctaataaatctacattatccttattgtataacttgtcttcttcccttacttggtagtatcctttgaggcacaaacgttttaaattttgataaaaataagtttattcttttgttaacttgtgcttttttttttgagacagagtctcgctgtgtcacccaggctggagtgcggtggcatgatctcagctcactgcaatctgcctcccgggttcaagcaattctcctgtctcagcctcccgagtagctgggactacaggtgcccgccaccatgcccggataactttagtatttttagtggagacggggtttcaccatattggtcaggctggtctcaaactccagacctcaggtgatccacctgcctcagcctcccagagtgctgggattataggcgtgagccactgcgcctggccctcacttaagcttttgacttcatattcaagaaaccattgcgtaaacccaaaggcatgaagatatgacttctgtgttttcttccacaagtcttatagcttcaactctcacatttagatctatggttcattttgaggtcatttttgtatattatacaaggtaaaggtataaattcatctttttgcacgtggatatccaatgattccaggacaatttgcagaaaagaccgtcctttccctcaagatatccttgtcatctttgttgaaagtcttttgactctttgtttatttctgggctttctatgtaggagatcatgttgtgtgagaatcaagacaatttacccctttctttgcaatctaagtgcctcttatttcttcttcttgttgctctgactagaatataaatgtcacacagcattggtgatagcagacatcaccttgtgatattagtaggaaagcattctgtctttgaccatgaagtatgatgttagtggtaggatttttgtgtaaatctcttttaagatggagaaatatttatcatgtttatgttaaatttcagacttaaaagttttttttaaacttaattattatttttatttatttatttatttatttatttatttatttttttatttattttgagatggagtcttgctctgtcgcccaggctggagtgcagtggcatgatcttggctcactacaacatctgcctcccaggctcaagcaaatctcctgcctcagccttctgagtaactgggattacaggcgcccgccaccacacctggctaatttttatatttttttagcagagacgggggttcaccatgttggccaggctggtctcaaacccctgacctcaagcaatctacccatctcagcctcccaaagtgctgggattacaggtgtgagcctccacgcccagcctaatctcagcattttgggagaccagagtgggagtctcccttgaggccaggagttcgagataagcctgggcaacatagcaagatccaatttctacaaaaaatagaaaacaattagctgggagtggtaatgcatgcttctgtagtcccagctactcaggaggctgaggtaggaggattgcttgatcctcgagagttggaggctgcagtgagctatgatcatgccactgcacaccaacctgggcaacagagtaaaaccctgtttctaaaaaaaaaaaaaaaaaaaaaaaaaaatctgtttcatcatttatatgtcagcagagtcatattctccatattccatcttactagacaaatggtatgtttctgcatttctctcactgatgaaaataagagctttttcattcaaggaggttgtggttgggtgaagggatgaaaagcagtgtttattctggtgtgatccagagctgcaaagcctagttctaccccactaattctatatttaaagcctttagacatattatatttgaaatgttgaaaaactaactccaattttttttttttgtatgtaggtggtcgtgtgatggtaacagatgctgacaggtcaatactatctccaggtggaaggtaaaacctaatttcattactgctgtttaactcccacacctcaaaaagttttagttgttagataattgagatatcagaatattaaaaaggcctcatgtcacacatcttaaagtttaataggcaaggatatcatttggggatcttgtgaacatgccctctttgacttggtatttctgaatagtagagttcctgggaaaagccagaggcattggtcacactgtgaattggccttagagtggtatttggaagttaatatgctattctgtagtattttattatactgttttccccaaaagatagatagaaattaaagtactaagttcagttggtaactcttttttttttttttatttttgagatggagttttgctctttttgcccatgctagagtgaagtggcgcgatctcggctcactgcaacctctgaccccctgctgggttcaagcgattctcctgcctcagcctcccaaatagcagggactacaagcatgtgccaccatgcccagctaatttttttgtatttttagtagagacggggtttcaccgtgttggccaggctggtctcgaactcctgacctcgggtgatccacctgcctcggcctcccaaagtactgggattacaggcatgagccaccacgcctggcccgataagtcttaatatgctactctgtagtattttattgtacttttttccccaaaagatagatagaaattgaagtactaagttcagttgataactctttttttttgtggagacagagtctccctctgtggctcaggctggagttcagtggcatgatctcagctcactgcaacctccgcctcccggattcaagtgattcaggtgagcgccaccacgcctggctaatttttgtatttttagtagagatgaggtttcaccatattggccaggctggtcttgaactcctgacctcgtgatctgcccgcctcggcctcccaatgtgttgggattacaggcgtgagccactgtgcccggcccaataactcttatttatgcaataaataaatatgtcagttttaagctgagtcaggtttgcacccaccttggtcaagggagggatcttaacactttgagacccagagactttgaatgctgtgggaatggctgtcaccagcacgtggcttgatcagggctttcttctccttgcagttgtggccccatcaaagtgaaaactgaacccacagaagattctggtatgtactagcacttttagaatcaatggtgaaattaaggaagacttttccttagtgtagaagtttatagtttgactcaattattgttttgttttgataagaaagaggcagtcactactaatgtattccaactgtgacactatttgttaatgttatcacattaagacccagaaaggtaatttgctcagtaagtggtaggcagagttctttgccagttacatatgtttgtagataaaatgtatttttttttcccgttgtacagacatataatgtaagaggtcagctgttctatagtgctttttacaaaaatcaatagaatgcccccttcgtctccaccttccttctctgcactcctgttttccactctccaaggagaccattttcaattctcaaataaaattgctatttaattccttatttatttatttattttttgagatggagtcttgctttgtcacccagactgaagtgcagtggcacgacctcggctcactgcaacctctgcctctgggttcaagcgattctcccacctcagcctcccgagtagctgggattacaggcatacgccatcacgcacgactaatttttgtatttttagtagcgacggggtttcgccaggttggcctggctggtcttgaactcctgacctcaagtgatcctcctgcctcagccttccaaagtcctaggattacaggcataagccaccgtgcccggcccccgtttataattctgttctgtcctagaaccgtggcacccagatgttctcagcatatgtatttatttcatcatttcccagtgttatcctgtgtcctagtgccactgtcaagcctcccgctgctcggccctgtgccccttattcacacgggacactccttagtgggctgtcaccgccctgcctgccccctcatctccctctgtctgaccaggccctcggcagcttccccagccccttccccggccctttgtcagccttctcattctgccatgcttcctgggcagccacctgccccgcttcaccccatctaagggcatctcgaatgagttgttggggaggagggtagggccgcgttaacgtgtgtgtgcgtgcatgtgaatgagagcttttatgtatgtaagtgtattttgggagagctgcaagaaagtgttgaattatccttttttggaaaaggtatttgagtcttttacactgtttgctggttttacagaaggtttttcttttttctttattttcactccataggaaatctcaaatttttgtgtggttttcagtagattgtgccaaaaaaaatcatcattttgcaaatgtttccccttaattcatatattcatctcctgaatatttagtttgcttctaaaaagaaacatgctgaattcagaaaccccatgtgtttaattgaattctttcaactgtctttatgtacacatcagcatcattataggtttttttttttctcttttacactttgcatctttgtattcttaatttatcctgcaaataagatgtacatttatagccagggtgcagccaggagacagaaaccatatcagttattggaacagagaaaatttaatgtaaagattgttggccgggtgcagtggctcacacctgtaatcccagcactttgggaggctgaggcgagtggatcacctgaggtcaggagttggagaccggcctggccaacatggtgaaacccagtctctactaaaaatacaaaaaaaattagcagggcatggtggtgggcgcctgtaatcccagctactcaagaggctgagggaggagaatcgtttgaactcaggaggtagaggttacattgagtcaagatcgtgccattgcactccagcctgggcaacaagagtgaaactccatctcaaaacaaaacaaacaaaaacagattgttaactggttataaaattgttaactttgtaaccttaaggagaatactaaggttttttttaaggaacaattctaggcagtggctgccaccccatcagctttccatctgacttctgaggtggggtagtgtttggctggtgctggtggctgaggggcatggtgaggctgcttctggtagtgttggagacattgccaaccaggcacagctgttgtgatgggagggcctgctttggccaggctgaacgagggtaccaaggagtgacctttttgggatgagaatgcagacaagaagccaaaaggaaggcccagatctcttctcctcctctagcctttctctctgtagtgtatctttgtggcagagactcacatggagccagctgctatgcagagctcaaacttcagcagaaacccagaggatgggtttgcaactgagagacatcagttttgtgggtggcccaggctgttctctttggctgctcagcatatatacacacccttccctgcacatttgaccttctgtacaacaacgagacaactgttccatctaaagagatgcaactttacttcctacaaagaaatccatttttactctctcctcaaaatggggggacacagtgttccagcagtcacacccatcgctgggagactgactgaaaatccagtcgcgagctatgttacctgctctttaaatgcagtgcaaacctatttgagtaatctctagtctaatggacaaatggaaaggaaacttccagccaaactattgtgaaatactaccacacagaagagaatagttagtatatgcaagcatataatcttcacacaaacacatttgtaacagacaaggaagacaataggcatagtcgccacagtctacgtttctgcagcttaccagacttttttttggatttacctttttatttttatttatttatattttttgagacaaggtctcactctgtcgtccagactggagtgcagtcgtgcgatctcggctcaccacaacctccgtgtctcagattcaagcgattctcccacctcagcctcccgagcagctgggattacagacgtgtgccacccagccaatttttgtattattcatttatttattttagtagagacggggtttaaccatgttgaccaggctggtcttgaactcctgacctcaggtaatcatccgcctcagcctcccaaagtgctgggattataggcattagcctctgcacccagccagtatgtgtaaggttctttagccaattggagtgacccaaatttttattcctgaagggtctgaatccccagtggatctgccttttttgttagctgtaatgctgtgattttctttctttctttattttttttttttgagacggagtcttgctgtgtcgcccaggctggagtgtagtggtaccatctccgctcactgcaacctccacctcttgggttcaggtgatctttgtgcctcagcctctcgggtagctgggactacaggtgcgtgccaccactcccggctaatttttgtatttttagtagagacgaggtttcaccatgttggccaggctggtctcgaactcctgacctcaggtgattcgcccgcctggacctcccaaagtgctgggattacaggcacgagccaccgcacctggctgttagctgtaattttctattaacttttactgatggacatgaaagtgctaagttagcccagagagttgcaaaggtctcagatgcagtgttctctgccaccactgtgtagcagcaaaacactttccccttggtgattgaaggcaatggagtaactcctttttttgcttgttgcttcagggatgcataccctttgtatatcaatttaactctctttgagctctttctctagagttgaaaatattctttacaaagttgcccaagtcagagctcacgatttcgtttgtgttagggttggtatgactgtggttgaatatctcagtctgaaatgtgtatgtgcacccatgcattgttcatttctttttctttttttttgagagggagtctcgccgtgtcacccaggctggagtgcagtggcacaattttggcccttcccaaagtcaactttttaataacatcgattgcttttgcctattttgaccttcatatgagtggaattacacaacatgtactcttttgtatctggccacaaaggtctgcttcaaatcatctgtcctaattgtgggcaaagctttatgcagaaaggtgtgctttgtacccttacacaaatccctgtaataaaagggatgtattaggcagaaaaaaaccaatgtatctcattattgaaattgttgaccattatgctatctctcctttggaatactgagttattaaaactgatgtttataagtgtgtttcaatggtttataaaagtatttttaatattaagtgaaaagggagtgtggtaaaattttctttgattctaaagataagaatttgctggagaaaagagcagcacataattgcagaatattaataaatggttaaaactttgcattggctgggattatagtgattttttaccttctgctacctagcaaacttttgtcttttcaaagacgtaaagtctttacttaaaataaatatgcattgctgtatttatagggagggcagagaggatttccctacacaatctagctgaaagttctcacatgcaatcatatcattgcatttgcttttctaggcatttccctggaaatggcagctgtgacagtaaaggaagaatcagaagatcctgattattatcaatataacattcaaggtaatttgaattaatgcaatttttctttctaaaaattattcgtggttaaaattaaaatttgctcatcaattgctttaatttcttaaataatattttattgatcagttcttgattgacatatatattgtaattcagtcccggggataaaacatttaaaaatggggctaaaagatcaactcagacaatccagaggggatatgtaaaatagccatttgtgttcttaaaaggatgagcaaaagttgtggcacaatttagaattcaatcccaggttctagtgttgcaaaataaaacaaacctattaggcaaatgcagataatgtcagcttaattttttctcactgcataattatagtatattaaacacttaaagtaaaaaatctggttagctttgccatctacatatctaatacaccatcttcattgcatccaagataatgaaatatctataaccccaaaagtttcctgtgtccccttgttattcattgccctgcccagtattcaggcaacacggatctgttttctgttttaggttagtttgcattttctataaagtcttatgaatgaaataataaaatgtggactattttcatgggccggggagcagtgtggcttctttcatttcaaatgattgttttgaaattcatccacagcgttgcacgtatcagtagtagattccatttgattgttgatttgtattctattgtatgcctgagtcaaaatttattcatctctttgtctgttgatagccatttgggttcttccagtttggggccattacaaatagaggtactatgaacattgtgtagaggcttttgtgtggacataggccttcatttctctcttttttttttttttttttgagacagagtctcactctgttgcccaggctggagtgcagtggcgcgatcttggctcactgcaacctccacctcccaggttgaggtgattcttctgcctcagcctcccgaatagctgggatagcaggtgtgtgccaacacacctggctaatttttgtgttttttagtagacacagggtttcaccatgttggccaggctggtctcgagctcctgacctcaggtgatccacccgccttggcctcccaaagtactgggattacaggggctaacacgcttttttaaaatgaaatatttaaaacctaaaagcatagtatcagtctgcccaggtttagtgaaccatagtatttgtctcttctctcctccctccaagaaacaacgtgtaactatttcattgaagcctttctttgggctcccccaaatccccacttttctctctattcttaagttaaccatgatcttgaaaactgagaattgtccttcctgatggtgatgtgctttactacgtaaatattctcccgggagtgtgtgtgtgtgtgtgtgtgtgtgtgtgtgtgtgtgtcatgtcatatttattgttttatatatgccacttcctgagtgaagcttacacagtggtacactgtatgtgttgttgagtatagtctgtcactcaatttaagttttcaagatttatcttttttttttttttttttggcgtgggggtggggatggatttttgctctgtcgcccaagctggagtgcagtggtgagatctcggctcattgcaacctccgcttgccgggttcaagcaattctctgcctcagctgggatttatctgttttgtcacaagtagatttaatcatgtcatcatggtagttacactgtgtgattataatacagttcgttttttcgttcttctacataaagacattgatgttttcttctaaaacttttgtattccaaaataggcttggatatatttctctgtgcacctcagtgctcctgtaaaatagtgacattcaaatgtgagtgttgggaatgtgttgattttctcaatgagtggtaggcacctcaagcatttgagaggtggaggttaagtatgttttagggtgaataaaatcaagtaccatttttagggtgaataaaattcaaatatgggacattaaaataatttgaaagtatagtgatacgtgaaggtattttgagtaaataccaactaaaaaaaatatagtttagcaatattggaagccaaaaacagtagtagcaggatagaataagactatgtcgtatttaaaggaattggtcactaagttgatataacaaccattagtttgtatgtgcctaactatgtatcctcacagtaaaagtaaaaattatttacaaattataagtctctatagatatgtacagtcatgtgggagattttaaccaatgatatacgtctagctgatgaatactcttttaacatttatatgctaaatagaatattttcactacagttaatatatgtaagctaactatagaaaactgtgtacccaagaaataagtttatttacaaagcatgaatcatttataaaaattgactgtatacttgttcacagtcttaataaattctctgaacatactgaaattaaattattaatagaaaacatacacagtgggaatcctaggaaacatgcttgtaattgacttaatgagggcctcattaaaaatatttagaccagaatattgagaatgccacatagttaaacttgtgaagagcaactaaagcagtacttagaggtcaattagtagccttcactaaggttgcatttttaaatcctgtaaatagcacatcttccttttcttgagctctgtatattttactcagagtcagaagactaggaagcagtggatctagcatttgaatttaggagtctacattccaagacttgctcttctttgagattccaaatagaaactatttctttatttctcatgcaattgatttttttctctgatgtgtcctttgcctgtaatgtgtagtgtggtgcatctttgtgaaatttcttaggctttagagaatgaagcctttcaaacaacttcggatgttttcccaattctcttcagagatagttaactgaactgtggtcatattaatgccaaaatgtgttttatattaaatagccattgaaaacacaatgttttgttttctattttaaaactattattattttaatcattaaaaagtttgatgataacatgtaaatgtgttgtcaaaatatagcagtttgtgaagttgaatttaactcagagtactttctgtgttttggaaagaaccttattagaaaaagtgcccgctgtgctggaagaaagggagaatgaattaatagctgttagtttgtcacatttctatttcagtagagattcaaggagatggtttacgttattttagagattctaaggaaggtatataacatttggttctgcatttttcttcagtatgacaaaagagtaagcaaatatttgccaaagaagaaacaaataaacctgtgagataaacctgcatttgtaatctgtatgaagtaaaagttacagtttactgttatgaacattgtactgttttaaaaaacccacatcttccattttagacataccattcccattcaatccatatgtccagtcatcttcaaaatttcttttgactgtttacatatgaattcacctgattacatttttccattcaccaagaccataaattgacattgctcatcttgtcagtcttttttttttttaatttttttctttttatttataaaaaggccattccatgtatctcacccaaatttgttgactaaagtcaccccacatttttttttgggggggattacttttgaagtattatctttgtatcccaaagcaggcccttctgaaactgatgatgttgatgaaaaacagcccctatcgaagcctttgcaaggtataatcttttcacttccattctcccacatactgcttgtgtttaatgtttccttatattgcacagactgtgttttaatatttataagtacagtattacttttctaaatggaaaaggaaaaaaatgtattggcctttttttaacatataaatgaacttcacaagcaacaatttttcaaaaatcaattttcccttttgtgaatctagtaatgaatctcgaaatgggtacatgacacactttcctattgaaggtaaagtacacatttataccttatctcagaacagtcagaagccaggttactgttttattggttagtgatgcaaatattgataaggtcaggttgatacttagtatttagaagaattctgaaatagcacttgttaatctgtaagtttcgaattgattgcctttttggcaattttttacagtgttcccaaacttgatactcataggctattagtaatggcatttacttctatctattctggctttgagtgcataagatgtattttctttaggcttagcatataatgtaaatgtaattgtttatttcagattttaaaagacatacagaattattgcttacacgaacaatcatcttaactgttattctttgctgaaattttactttttacctactggcctcatcatttcactctcattcctttgacctcacatctcttttttctttgacttttacagtcaaataacttaatgctccataaattcaaatattaagattaaaaaaagagaaaggaagtgtgtagagaaagcatattttaaaaatgaattaaagagtgactcataggtataggtttgtagatttacctagagtttgagttcaggtgagttttcacaatataaagtaagtggaaaagaatccccagataattgtgacatgctaaagctagatactgagaaccaaaaagatgtgacctcagtatgggacttttaattcaaggatattagctaccaaatgacagtttttcagaccgtaagcattgctttttaaaaatcaagataaaatacatttataacatatcttacttttagtatagcttctgaatttagttctcaatagataagacaaaagagatgaacatctgcttcctttcccctcaagcgatgtattcttactaataggtaatatgtttttttttggtacttaaaggcagtgtttttcaatcttttccatgttagtagctcagatctttaaggacagaggatacaaattagggggcagcttgcgttcttaatcctaagtggctctctgatgtcttagattcttcctttcctttttgtgagtaaaacttctgctctagtaggatgagcctgttcaccttgtgactgcctaactgatcattgctttatgttccagtttttagaagcaggcagattatattacctgacttaaaatgcttttgagactaaaggtagtatcttaaattttaacttacgagtttcctttaagtacaactttgatgaaattatggggattgagtttccatggctttcaccatagtgaaaatggaaagcatgaaacattccacagcaaaccctgaacttatttatagggagttaattaagtgtctgatcacagcaagcatttactctgatctgtttgtgtatgtgtgtctttgacagatgagcatggtacttgaagcataattctgcttcctcagattccaatatctagtaattttatcatgtagttatagtaactaatattaaatccccaaacctacttaggtctactctgtatttgtgttttcaaataatttttttagcttccaaatagaagcgttgtattcttttctgaattagaaaacattgttcgacttaactgctaaagagttagacaatcattttgcatatgtttattatgtcttagattgtttgcattgttacctagattctctttcatctttcaatgtcagtttttattggtttattatatgttgtttattttctttttaggaagccaccattcttcagagggcaatgaaggcacagaaatggaagtaccagcagaaggttaggagaaaaagagattgcatattttccactatttgttgtatgtttattctattttatagattctattatccttaaaacaccttatttggaaataaaaggtgattcccttggtatgccttcctagccaacaggttattatttttttaaaaattctaagatgtaatatacttctttgaccatactgattaataaagcctatgggaatgaaactaagtggtaagtaaagctcttacatgatgcaaaatgctacttttttttttgtcctggttttcttgtgccatattaaatatcttttaaggaagaatagcttcagtgtttcagaattaaaattactagctccattcatattttattttcaaatgtattttttaatactttagtctcttagtagggtaggaatttagtctacataaaatttatacaggagagagtttctccctttattttgtactcacaactactccataaatgactttgtcagtttaccagctctacagctttggttttagaattgaacgcctgactgaggtacagttctttttgtttagaatcctgagttcaacttatcatgtagggtggcttcttatttccaaggtgtttaaacggttccacacaaatttttgtagatttctcccaaggaaaatgactggtaaggtaactgaatcttgttttagaattatttctctcataaattggtcatgttatcccttatttttctagaatgaaaagaggagtctgttatgtaactgcttatattccattgtatttacatttttattttaattaaaaaaaaacatttgtttgatcttttaccttctttgagggaaaggcaatcttaaaagttccccagtataggctggtttctccaaattcaattatagaattagggtttctccctggaatacatttctctcaaaaatactgatatgctcattgtaaaccgttggttacatttccctgtcagccctttttatagaagattgtgtgggtgaatgttgtatgctttactgtgtggaggtgggtatcttctgtgtgacagagttttcagctttgaataggcgggatttagaacaacaagacctaggtaatagatcatgtgcagtacgagggctcattgggcagtaccgatggctcaccgccttgcagccccgccggcaggtactgcaccttgaagactgcgtttttaggacatttttactgtcatattccagtgttaacaaagttgaatcgaatctgggttctggcctttattcctttactaacaagtaaacataatctttggcaaatcaattaatctctcaacctttgcacaatgaaagagaactaatgaaaatactctataagcttctagcactaacactctgatgtacatttgtcttgtgtaggaacaaatatgaatgaactttgtaatttttgaaatatgttgcatacaaagccagaggatatagtcttgtgtgcacttgtgacactcagtctcttgataggaaagtctccattgtaaagcctgggttgtggttttattgaacagtagaaaccactcctcacatttctgaaaggagagaagaaattctaaccaaagtagaaagcatttgtttctatccgagcatcttctagctgtggcaggaaattcattgtgactttgtcatatcctcattcctccaagactatgggatttttttgagtcaatttctgcaggtaacatgttatcatctaaatttttccagagtttttctaatttttgttttcttttatccctatttataatgacaagggtcaaattttaatttcattaatatgaaatgaatgaaaatgccagtggatttttatagtaggctgcttttggagtatcaaatcagtaaaatgttggaacatatggaaacatgcttaataatgaatgtcattttagaattttatttttttcaagattctactcaacatgtcccttcagaaacaagtgaggaccctgaagttgaggtgactattgaaggttagttatctaaaagccttgattccaaagtttacttctggtcataaaaatacttgtcacattcacattgctaaatatgcatttcattcatttttaaaggagacttgtgggacgaatacatgtgtctgtgtggccaaagcagcccactccccagtgctttgggagttttagatgacagaatgaggccgtgagaattagcattggcccacgggtggcccaagctatccttgctatcagtgggagttgaaaagagaaaaagaaaattatgaccagacttgatacacacaaaaacagattctataatctattgggttgtgatagaagaagacttatttggagctggaatccctaatttctaattaagtaaagtggaggagaaagtgttgatagtttagtgagtaatttttaaagcaagtccctgcccccttcaacgacccgcaaatactacttagaggctgacatacaatttatctttcaaaactgttttgaagcaatagctacaaatatattctacaatactctctatagctaagattgcttcaaacctgtttttttctccaaagataagcttgaactcagctgagccagtttatcctgaattatttgaaaattcagctaatagaattattaactatcacttcatattaatagttattaaatgagcattgtgtttttccttttaaattaatgtctcacagctgggcacggtggctcacacctgtaatcccagcactttgggaggccaaggtaggcagatcacctgaggtcgggagctcaagaccagcctgaccagcatggtgaaacgcccatctctactaaaaatacaaaactagctgggtgtggtggtgcatgcctgtaatcccagccacttgggaggctgaggcaggagaatcgcttgaaccctggaggcagaggttgtagtgtgctgagttcacgccattgcactacagcctgggcgacagagtgaaactccatctcaaaaaaaaaattaaaattaaaattaatgtgtcacaatacttgtgtaagtttcttcccctgaaagtacttctttcttgtggtaaaatgtgaaaatggtacagtaaattgtacagtggaaagttttcttcaccctcactctgctcccaagtcccaatactgagggatgtatgccagcttattgtgtctacttagagaaataattgcagtacatatcttgatgcgaaaatacacagatgctttcagcatacattacaatgcacattttaaaatattacatattccataggcctccccctcccataactgcacatcttggtactttattagtttttttttctagctgctgcgtaacctttcttggtttgctgtctgtctctctttctctcttaataacctgtcacctactgatgtcacttggttatttctagtgtttgactactccaaactactcaacgtgtctgtcttcattgcttctaaaatataagtcaattagtagcttccacttaatacaagaaatcttttcatacttcatgtgttaacttaatatacagatttcttttttcataaatataatttttctaatctaaaacattttgcattgtttacagtctagcattaaatggttgaaatttaattcgtttttagtgagaaacctcattaacaggaaaaaaatttaagaacatacaaatattacaactactcagctgtgccctttctatggagatattaataggaggttattaaaattataaaaataaagcttttagggtaggactaataaccattttgatttgtcaaatcttaaagcagatagaagctgtattttttttttttttttttttgagacagagtctggctctgtcgcccaggctggagtgcagtggtgcgatctcggctcactgcaagctctgccttcctggttcacgccattctcctgtagaggctgtattaaaatggtttagaatgtaaatacttgcttttatagtataagacttttaaagaaaggttacgaaaatccagaaataaatggctcatgaacctgaagcttatgtcagccttttgaactttaactgttttggatggagtaataaatctcttttcttttcatttatttgtttatttatttatttatttgtttttgagatggagtttcactcttgttgcctaggctggagtgcattggcgctatctcggctcaccgcaacctccgcctcgcaggttcaagcgattctcctgcctcagcctcctgagtagctgggattacaggcatgcgccgccatgctcggctaattttgtatttttaatagagacagggtttctccatcttggtcaggctggtctcgaactcctgacctcaggtgatctgcccacctcggcttcccaaagtgctgggattacaggcatgagccaccgcacctggccattcatttcttttaaactaagacattgtgccataagcctgatttaatgttcacatttgtgattaagtagtagaattttgctagtagacctctttcttttcagaagaccagtgaaataccaggtctgagtaaagtaatccttttaaaaggtagcattttccatgtcatatgtgcatatacacacacacattttatgtattatatataaaaaatatgtatattatatagaaattacatcaacaattaaattcctcatttttttaagaagataaaaaactgtctcaatattaacaaggaaggtcaagtgagaacttacatgcacacctctggttaataatgtgtatcatatattctttctggaaagattacttccaaatggtaggagctatttagatacccgtagttaggaaataaaattttggtatatcttcataacagaaaaatatatagccattgaaatcctgataatgttttccaataatctgaaaaaagatctctaatataaaatgttcagtggaaaaaaaaaaaatcctgccttgagaacaaggcaacttgaaaagcaaaagtgcatctagaggataatcttagttttgttttggaaaatactcatgcttggtaggaagacggacaaaaataaactgagatattcctgcttgcttggagacgacttaattttctccttttatatcttttcacatttcccaaatcattggtagaaaaaaaaacagaactttgttatcaaataagtctgtccgatttttcacagtgttttcacctcgatatcttcatttgcaattatgtggagttctgaagtggctaatttgacaccgacgcggacgtgtttgtggatacagggtcattacttacccactgccggtgcgctctgagctgtgcacttccatttgtggcgttttatttgtacttggagtcggtggtaaacatttaaaacatacgtgacttaggtttgggaaatcggccttggactaataggaccgcatgcctcagttttcgtaaacaccgtgactacatttctgggttaaggtgaattgccgtcaggtatgttatctctaatgtgtgcagagaaaaccttatcagacttgtttcaggtctagctgtcatgggagtgctaagaaccgtgtaaaggaggtttctttcttgcgcagttctctcttagggcctagcttcccaaacctgagtcacttacctgttacctgtgttccttctgctgtggcctaactctctgttcattacttaacctgatttttttcccttaaattgattttaagtaaattcattttgtgatgaattttacgtcttcctaagtcaaactctggcttttttatttctcatattttgaaaggtatatgtaaataatttcaaatataattgactcacatgaccacacgtggcacacttactgcagctggtactgtaggttttttaggatctctgtaattgaggaggttagcgttggaaaacttctgtgttttttatttttatagctgccaatcagacacttaatgaatacacaattatatatgtaaaaaaaggagtctcagaggaattatgtactaagatttgaataatacgtttttagagtttcagtattttagtagggtttatgatgggcagttggactacctaccatccctttcttgtggaatttatgtttaagatagtgccagatacttgactgcagcatataattagggactaaactattcatatgttcatttaatccctccacaaatactgagcacattgtatgtaccaggtgctaagagttttttttttttttttttgagacggagtttcgctctgtcgcccaggctggagtgcagtggcgcaatctcggctcactgcatcccctgcctcccaggtttaagcagttctctgcctcagccttcctccgagtagctgggattataggcgcccgccaccatgcctggctaattttttttgtatttttagtagagacggggtttcaccattttggccagggtgatcttgaactcctgacctcgtgatccgcccacctcaccctcccaaagagctgggattacaggcataagccaccgctcccggcctctttttttttttttttttttttttttttttttttaagacggagtcttgctctgttgcccaggctggagtacagtgacctgatctcggttctccgcagcctccgcctcctgggttcaagtgattctcctgcctcagcctctggagtagctggaactacaggcacacgccaccatgtccagccaatattttacttttagtacagacaggggtttcaccatgttggccaggctggtcttgaactccttacctcaggtgatccacccgcctcggcctcccaaagtgctaggattacaggcatgaaccaccgcgcctggccacggtgctaagaatttagtagtgaataattcagtggcaaatcctcgggagtgttttgaaaataagagtgacactttttgtccttcacttctaggaaacgtggtgactatgttgagaaaagggggaaaaaaaaaaaaagagaagacctagagcagtcaatagttttttgacagaaaactagcttgggagcctcttggaactacctagggcacagagaagagtgctttagagcaggttggtggcaggggagataagaagttgttgattctggggagattttgaagacaaagccaccaggctttgctgtttattgtttaattcttgtattttcttaaatgtctctgcagcacttttaaaatggacataattgcttaggttagcacttgaacactttgttttaaattttttttattgctgccaaatagtcatttaataaatacccaattgtttatgtaaagagttttagaggagctataagtggtatccatgggtgaaagaatgaatccatttatttgaaatgtatagggtaattaatggctctagttttgaaatagatatattacctggtgttgattgtttttttaactttgaatagatgtcagattgtatgataacacattcccagtctgattatgttgaagctaagagtatcagaacatattgtaacatagtctatttattgattcaccggccagaatgcagtgataaacagctttagctctgaagcctgtattatctttaggtgtattcgttaatatgttgcaaaaaggaagttggtgttttctaaacacaaattttgagttagggacggtgttgccaacttgaaggtattggcggagtgcttttgttagtgtgggtagcataactattgtaaattgatgaatagcaccttttgcatattaaaatatcttaaaatgggccaggtgtggtggtgtaatcccagcactttggaagaccgaggtgggtggatcacctgaggtcaggagtttgagaccagcctgaccaacatggtgaaattccatctctactaaaaatataaaaattagctgggcgtggtggtgggcgcctgtaatcccagctactctggaggctgaggcaggagaattgcttgaacccaggaagtggagattgcagtgagccaagatcgtgccactgcccactgcactcccagcctgggtgacagagcaagactccatctcaaaaaataaaataaaatatcttaaaatgtattttaaaagctttacattttgattatggaaacagagtttgggcttgaatttgaagcatgctgaaacgtgtgtcttgttaaacaaaaatggttgtttatactttggaaacggcagataattggaagagcaatgcccagtatgtgagggcaggccctagagctttagttgatgttttatgcttcagagtaaaaagtaattttgatcctttgtggaaaggattttaggtcgagaaacccattttttttcttactttctcaaaaccaattaattgcaacaaagagttaattgcagaaaaaattgaggatgtggtgaagtttatagctgttctgatgcctgaatgccatgttccatatgacttaaaacacccaaagattaattaataagtttatgaaacagggtttttaaaatagaatatatggtgtgatattttatcaataactacatccagctgggtgcggtggctcacacctataatcccagcactttaggaggccaaggcaggaggatcacttgaggccaggagttcaagaccaacctgggcaacatagggggacccctatctctacaaaagttaaaaaaaaaaaaaattagctgggcgtggtggtgcaggcctgtagtcccagctatttgggaggctgaggtgggaggatcacctgagcctgggaagtcgaggctgcagtgagtggtgctccagcctgggtgaaggagggagaccctgtcttaaaaaataaagtaactacattcatctctatatatgttcacatttaacagattgaactttattatttgtcagtgaagaggaaaatgtgatatccctgatattttcaatattttacagtctttgttgtattaaaaaagcactctagtagatttgcctttttctctttctttttttttttttggtttatgatcgattgggttaccttcataaaatatatttatgctattaaatctattgtggtctaaaatgtttgtgtgactgaaaaagtgaagtcttttcagtaaggaaaacctgtcttcccttcccctgggcctcagctgtgaagtttggatttggactgagatccatgggatggagctccacaggtgtcccttccattccatctacagctgtgtttcctttctcatgtcattctactctagcagctttcagtttatgtcactcaatgaatagtcagcttaaatgatgatctataaggatacttaggagaccttaacctataggggaaatacttttattttagaagttactgcttaatgtttgtaaaaaaatatatagtaatattaagcatttataatgctttgacagtattcataggtgaaatgagtgtattttgttttaacctttggaagccagcataaaaatactcttaaggtttctaaaatctgtttgggagttggaaaatcgggtttttttaaaagtatattttcagaattgaggtccaaacttacacacttctgttttccagattgtttctacttaggttggaaccttaatctatttatagggtgtcttgaccatttttaatccttacagtcatacaaacccaggtgccagtcaagttttatttcacagggaggttgtcattttaaaattgttttctgtcctggtcccgtggctcatgcctataatgtccgcactttgggaggctgaggcagaaggatcacttgaggccaggagtttcagaccagcctgggcaacataatgagaccctgtccctacaaaaaattaaaagaaaaatagccaggtgtgttggtcccagctatttgggaggctgaagcaggagaatcatttgaggccaggagctcgaggttgcagtgagctataatcatgccactgccctccagcctgggcgatagaatgagaccctcctgacagatagatagatagatagatagatagatagatagatagatagatagatagatagaatgagaccctgccaatagatagatagatagatagatagatagatagatagatagatagaaagaatgagaccctgccgatagatagatagttttctatcaaattttttcctagatttgaacatgtttttctaaagtagcattcaacacatcagcattttatagcgtcattagttgttactatgattatgtttttctgaaatagtatcctttacaaaagcacttctgtctttctaagcacatacataggtcctaaaatgaatttgtctgatgttggtgacctcggaaccattttctccagttgattagcacggccagccagtcaataatttcaggtcactgttggccttagaggaagagcccaaaggcagcaagcaagggtgctggtgtccagtcgccttctagaagcattttcaccttcccttaagatttcccttgattaacacagaagtgtctatagaagtgacccagtgctgccccgggcaacatcgtatattaggccaaatttgcatttcttacctttatgagaagcaccctcgtagtctagtggagttacacacacacagtctgatctcagctgtgctctccagagatacaacatagtccaatcaaataacatcctctgagcctgtttctttagctgtaaaataagaataacaattatacccatctaaaaagatagtgtcttgtacttgagtgatcttttttctatgatactgtctttaacacaataattattttcttcaccataccacatttgtttttaaataagaatttcttaaaatgatgttttcagtattttatagatgatgtttgagcagcaatattaatagcatgttacctgacactttgagggactagaagatgacagtggcagctgatatgacccagatgtctctaatcctaacatgaggtgtactgaagggtcacagcagagtgagttcctggtgtatccacaaggaaatgagcacggaactctcacaacagcgtgtgtgctgtgcgctgtgcttgaatagctgactgctcctttatacacagcctctgtgctgactgaatcaacagtatctgtttcatcataatgcagccctatttctttaagcccatacattttgcacttgttaaaagtatttgaacaggccaggcgcggtggctcacacctgtaatcccagcactctgggtggccgaggtgggtggatcacttgaggccaggagtttgagaccagcctggccaacatggcgaaaccccatctctatcaaaaaaatacaaaaattagccgggcgcggtggcgggtgcctgtaatcccagctacttcggaggctgaggcatgagaatcgcttgagcccaggaggtggaggttgcagtgagccaagattgcatcactgaactccagcctgggcaacagaacaattctctgtctcaaaaacaaaaacaaaaacaaaaacaaaaaaaaactatttacccaatttcccttgcttatgcatgcttaaattttgtataagcttaaatatcttttccatctaagctgtactctatccccttttataactttaggtggctgtctttattaaaagttttttcttgaaagtcttaaaacaatatagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcggtaagttctcagcgaacgacgtgaccttttccttcatcttctggattctcagtgtgactgataaatgttgcaacatgctctgcagggggaaaatgctttagcgtctattactgcatcataatctcatctttggaaagccaggagcattttgaaaattacattacagacattgtttaaacatagtttggatttaccaaagcataggacattgtcttgtctgatgttaattagtcagctcaagattagtgctaaagacttagtaatttagttatttctcttagctttaaaatctttatttcagaactatttcacctcttggttttctttttttttttttttgctctgtgttactgcagctgctaatctgtgagctctcaatggatgatgtatcctagcaagggactgaatgagatattagcggcaaattatgttgatgattcatattttgaataaatggaatattaagcttgtatacatcttgaaaatagtactttaatattctactgtgtcgtagtcacaatgattggatatgaattgaatttttgtactttttaaatatgtttttgttctttatttttaatttttattattatttttttgagacagagtcttgctctgtcacccaggttggagtgcagaggcacgatctcagctcacagcaacctccgcctcccgggttcaagtgattcttctgcctcagcctcctgagtagctgggattacaggcgcccaccaccatgcccagctaattgttgtatttttagtagagatgggatttcaccatgttggccaggctggaatcgaactcctgacctcaggtgatccgcatgcctcagcctcccaaagtgctgggattacaggcatgagccactgcacttggcctgttctttagcattttaagttgcaactatatatccgtaaagtcttatttccacacaactgagacatgttttaggaagtttgctaaaagacccctggagacctttatcgtggtctcccttttgtcgtgtttcatttgcttgatcttttctgccctcctgcttttcagaaattaaaaggctaaaaagaggtgctaaatgttaaaacttctcgtgtagtctcccatgagactattaaaagtaatggcaaaagccacagttacttttgcaccaacctactaattctaagaaccaccaaaaaggggaaagttcttggaaagcagtaaaatgatatggacagttgggatgtaaaaatgtagaaaatatgtcattgtatgttcagtcatcccaagaccctagtgctgccccgatggtagggacttcttaatgagaattaacttttgctcaattttcagagaaatggaatgctcgcatcactgatctacgtaaacaagttgaagaattgtttgaaaggaaatatggtatgtctaaataggaaaattcctgtaatactttgttcatgagcatttacacaatggcgttactgttcatcatgggggtgatgtggacaagcccagcccagggctgccagtgaaccgtgccacactttcttacacgtctctcattgtaaggtccttagtagtgtctgtctaaatattagaaacagtctttgtttctagattacagtaaagctaaggaaaagttgtatttctatagttatcagctaacatttcttttaaacttccagcatggatatttgggaatttatttacatatttattacaaagctctggatcttgggggtttcattaaaaattatttttttaactgacagtttctgttaatctactttgttaaatccagtatttgctgagatccccctattgtctctacttttatctttttttttttttttttttttttttttgagacggagtctctgcattgcagtagtacaatctcggctcattgcaacctccgcctcccgggttcaagcaattctcctggctcagtctcccaagcagctgggactacaggtgcccgccaccatgccctgctaatttttgtatttttagtagagacagggtttcaccatgttggccaggcttgtctcaaactcctgacctcaagtgatcctcccgccttggcctcccaaagtgctggcattacaggcgtgagccacccttcccggccactgcttttatcttgatgtataactgagttgatgctagatttcaattccttctttgtccttttactattctgtcctatagccacctttatataatgatcaaagaaattcgcaatttgttattatcatttttattttttataaaatatttaaaatgatttaaaataaaaatcattttatttttatcatatttattatcatctgttatcatttttatttggatgactatttactttgccattaactagcaagcggtaaaattgtatgatatgcagttttaactgaattgctataagtgaaaatttaaatgcaataaaccatattgatggtatttgtgttaacaaacttaaaatgagcattttttcttcatcatgagtaatataacctacccctcaatgaaaatctacaattagagtaaatttgctaatgaattcagtaacttttccatatttttagtggtttacttaaggttctcttagtgtttctcccagtttttaatagcttacaccttttttgcccgtggttttttgttttttgttttgttgttgtttttttttttttgagatagagttttgctcttgttgcctagtctggagtggcacgatcttggctcactgtaacctctgcctcccaggttcaagcaattctcctgtctgagcctcctgagtagttaagattacaggtgcccgccaccatgcccagctaatttttgtatttttagtagagacaaggtttcaccatgttggccaggctggtcttgaactcctaacctcaggtgatccacccacctcggcctcccagagtgctgggattacaggcgtgagccgctgcgcccggcctcatgttttctattggttcattatgaagcaaaaacttcatagcatgtgctacctggaagcactgtaacctagtggtaagatcataggctctggggacacagtgccttgccacgtctcttctcctgtctgagtcttagtatcctcttttgtggtcatgagaactgaagatctatcctggagattgataagatagtaaagtgcttcacgtaatacctggcatacatgtaataaatgcttcctgtgtgtatatatatacacacatatacatatatatgtatatatacatatacacatatacatatatatatatatatatatacataaacacatatacatatatatataacacagtgaaacccccgtctctactaaaaatacaaaaaattagctgggcgtggtggcgggcacctgtagtcccagctactcgggaggctgaggcaggagaatggcgtgagcccgggaggcagagcttgcagtgaaccgagatcacaccactgcactgcagcctgggagacacagcaagactccatctcaaaaaaataaaaaaaaagttaaagagcactacagattcaatgatttattattcttttctacaaattgtgtttaaatgatatctctttctctttttgtccttatagctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaagtaagactcttggattcctgttgaactcttgtctcttttctgagtaatacgtcttttttattgttgaccaatattcattcaccactaggttctatgtgatgaagtttgagttattttatgtatttttatcttgcactttttaatttatctgggtccagcattgcatcagtcatgcagtgttggcattcgaagcatgaacagtgcccgcactggattggcatgcaactcacattttctttcacaattttctgctacttttgctaaagaacatagaatccacgccttgtttttaggcctgatatatatatatattttttttttcgagatggagtctcacactggaacccaggcttgagtgcagtgtcgcaatctcagctcactgcaacctctgccttccaggttcaagcgattctcatgcctcagactcccgagtagctgagattacaggcgtgcgccaccatgcctggctaatttttgtatttttagtagagacggtgattcaccatgttggccaggctggtcttgaactcctgacctcagatgatctgccaacctcgccctcataggcctgagatttttaaagcatgcgtgggaatatatgattgtttttatagatgtgcagaggaagatagtcttgaatgcaatatgacattaaaggatcccatttaagatttttgtaatatgcttcaaagacctgtgggttgcaaagttacctctttacttgtgaggatacatgctccatgaagcaccttatgagacaacttgcaattattagtttgctttttactctgtagaaacctcaaattaagatttagttgtgggctgggtgtagtggctcacacctataatcccagcactttgggaggccaaggcggctggatcacccgaggtcaggagttcgagacaagccaggccaacaatggtgaaacactgtctctactaaaaatacaaaaattgaccaggtgtggtggtgggcgcctggaatcccagctacttgggaggctgaggcaggaggattgcttgaacccgggaggtggaggttgcagtgagtcgagactgcgccattgcactccagcctgggaacaagagcaaaactccgtctcaggaaaaaaaaaaaaaaagatttagttgtgctcaagcatccagattatcttttcttttcaaaaccagccttactgactaaatgttaaatatgtactagtcgttattagtttgctgaatattacctagtgattattgagtatttattctcacctttcagacatgagcttctgaattcaacacgtgaagatttacagcttgataagccagcttcaggaggtaggtcttcaatctcgaggcagatcagaagattatgtgcaataattatttcacgcttaacattgatttcttctttatgttaccttccacatgaaataatatgtctctaactattaattatgtgccattacaggagaattcatgttgtcaaaattctaataatttctagaagaataaacgcatcttctttttattaacccattgtaaatacttataaatattgcatttatgggtagacagaagtaaaagaacaatatttgttctacttttgatgcaagatttatctggcataatgcattgaacagtttattattgaagtctacacgagtcaatggaacaagcattcattgaatgtccatgatatgcaggacataagaaggtttccttttagagcatggagccatttatatcatctcttaattgttagatgtattttgttttgttttgttttgttttttgagagggaatcttgctctgttgcccaggctggagtgcagtggtgcgatctccgctcactgcaacctcccgcctcctgggttcaagcagttctcctgcctcagcctccctgtagctgggattacaggtgcctgccaccatgcccagctaatttttgtatttttcgtagagacagggtttcactatgttggccaggctgatctcaaactgctgacctcaggtgatctgcccacctcggcctcccagagtgctaggattacaggcatgagccaccgcgcccagcctgttagatgtgttttaaaataaatagaaatataattgattttcttgcttgcttttgctctggagtggagtggagtgaggataaaacagaatggaatcaccctgttgatatttactaagatagaaggactgcagcaagatcatagccctaatcttcctgtagcaagtgttacctgctagctgttcctgaatacactgagttttgctttttcctagctctaatgaatgtttcgttcttcctctttttgtacagtgtcagcattgttttagaaataaatacattctagaatcttaggaataattttattattgtctttttttttttttgagacggaatctcattctgttgcccaggctggagtgcaatggcgcaatctcagctcactgcaaccgctgcctcctgggttcaagcgattctcctgcctcagcctcatgagtagctgggactacaggcgtgcgccatcacgcctggctaatttttgtatttttagtagagatggggtttcaccatgttggccaggctggtctcaaactcctgacctcaagtgacccgcctgcctcggcttcccaaagtgttgggattacaggtgtgagccattgcacctggccacgaatcttagaaataattttggccataggaaaaggaaaagttatacctcttattttatagtaataatgtttaataatcaagttattaaacccattaaattgagaacacttgtattactgttattttgacagtaaaggaagaatggtatgccagaatcactaaattaagaaagatggtggatcagcttttctgcaaaaaatttggtaagtctgttttttttaattaccccttcaactaaaatgtattactgagtaacatttttttaaatgttgttttattttaggaaagtaaatacagtgaataggactcagctttagttttccctgttttttttttttgggtttttttttttttcttgagaaggagtcttgctctgttgcccaggctggagtgcagtggtacgatctcagctcactgcaacctcctcctcccgggttcaagcaattctcctgcctcagcgtcccaagtagctgggattacaggtgcccgccaccacgcctggctaacttttgtatttttagtagagatggggtttcgccatgttggccaggctggtctcaaactcctgaattcaggtgatccacccgcctcagcctcctaaagtgctgggattataggcgtgagccaccgcgcccggcccccattctatgaattatctgtggaaagttatttcctttaaaatggcatgctcgtgaggttgaaggggtaaagaacattgatctggttgccacgcagatgaaagtgtagtcggaaatgtgttaccagtttgccatagccgatggaggagggtaattacggtcctgaacagttagtagcaaaaggctgcttccagatagtatttaggttgtgtcctctattgtccatgatgattttctttctctcttttcttcctaaggatattgaaaaacaaactttaatcttttaaagatctcagagctattaagattgtcttaggaccaggacacttaaatctgcccaaatctggctgttgatgatcggtcatctctacttgtctttgctgtattaagtctattcaatagttaataaatatgtttctagaaagagtttttttcaagtaaaacaaaattgacctgtgcctttctttggattgtactaaaatctgatttcaatacaaatgtagtctcccgaattgctttgatttttgtccagcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaaggtaagatgataatctgtagaaatagtttcagtgtcttccctgagaagaggttaatttgatgaagaagggccttttgtttaccttatgacttatttctattgacaatgaaggcattaatatttagattcacttagtgaacaaatattagtataagcatcagatgtgcaaaattgggtctaacaagaacactgtccttggggccttcatacaaagaaaaatgcactgaaggccaggcgcggcagctcacgcctgtaatcgcagcactttgggaggccaaggcaggtggatcacttgaggtcaggagttcaagactagcctggccaacatgatgaagccccatctctagtaaaaatacaaaaattagctggaagcggtggtgcaagcctgtagtcccagctactcgggaggctgaggttggagaatcacttgaaccctagaggcggaggttgcagtgagccgagatcgtgccactgcactccagcctgggcaacagagcgagactccatctcaaaataattaaaaaaaaaaaatagaaaaatgcaatgaagtgttattgagcgtttttaagggagaaggcaaggatggcacacccagctcggtcacttgtgcatccagaagagatggaaggtgtttcaagtgaaggaaatcatatgagtagggggaggaggtggcaaatatgcctgcgtatccacagaactcacccaccgtgtgtggagtgaggactgccacgtgggcgtggtggggttgcatggatcgacttgggtgggcaagtggaggaaggcctgagatcctacgaacacagaggcagtcacgaagtggtctcgaggcagatgcctctgaaaataatgtggatccgccctttagaaaggtaattctggcttgattttgaaggataacacaatggttagtttgggtgcagggttaggaacagaaggcctctctccactcattgacgggatgtggaagggtaaaccttccttactgattggggtcatgcctctgtgtgtttgttgggactgagttataagggataggaaacgtttaagatgctacagcgagctgcttctggctgtgctgtgggacagttcatgtaagattcagaaacagaattgagctggtttgggggaaaagtgactttcgcctgtttatcttaaatataggatgattttgaaggtctcacccgaatatctgaaaattgccattttcaaaataaactcgtcaccaaaatgatttttttttcactataaaatgaaggcaggatgaaccatatttataactaattggcaatgaacagctgtgtgagaaaggcctgtgagttgcttctaaatgctttattactaatatcaactctgtttctacagaccagaacttctgactcacagtaccactgaagttactcagccaagaacgaatacaccaggtaaactagttgtgaaatccttttttaaaaacacagatcagccaggctcggtggctcacacctgtaatcccagcactttaggaggctgaggcgggcagatcacaaggtcaggagatcaagaccatcctggctaacatggtgaaaccccatgtctactaaaatacaaaaaaattagccgggcctggtggcgggcacctgtagtcccagctactcgggaggctgaggcaggagaatggcatgaacccaggaggcggagcttgcagtgagccgagatcacgccattgtactccagcctgggcaacagagcaagactctctcagaaaaaaaaaaaaaaaaaagcacagatcaatactttttaagcttttaaaagttaatcttttaaaattatggaagtcccccttcccctgcctccccaaaaaatcatttgcagaagctcaatccagccactccttgatttatcaatgtgaacacctgcagtgcacagataactcaagctttgaccgtagaccactgctatccatgagaaaggcagtgtgccccacaaatgcaagccacatgtgtaatcgtccacgttctagttcagcctgtaatcattataaagaaatacacagggaagtatttcacggtctttatcccatgttctttatttgacagttggcgcgtctttcatactcacagcatatttcagttccaagtagccacatttcaaacatttcaactgctcggggatagtacctgctatatgcatttagaccttaatgtttattcatatgtatcgtgttcctaaaatggcagactgtaactctgacctgcacacaaatatcacagcctaatagggaagatctaagaagtctctgttcaatgaatgatgttattttctttattagagctctaagtgtgcctttatttctttcctatctttttttttttttttttttgagacggagcctcactctgtcatccaggctggagtgcagtggtgcaatctcggctcactggggcctccgcctcccgggttcaagcagctctcccgcctcagcctcccgagtagatgggactacagctgcacgccaccacacctgggctaatttttgtatttttagtagagatggggtttcaccatgtcagtctggctggtcttgaactcctgacctcaggtgatccacctgccctggcctcccaaagtgttgggattataggcatgagccactgcacctgacctctttctttttgtttgccgttgtgtaatgtcagaggaagtgaccacactctgtagatcatcagccaccttaggaacttctgttgccaagaaccaataaatgcccataccctgtagtgtgtaaatgcccataccctgtagtgtgaagttttctgttgttagaaataagtgttaggaatcaagtatgaaatttgtgtgtgtactaggtgtatacagattggtgcagttaatcatgctcacgactactaaggtgaacaaatgtttcaagttgggttcctgggtgtgccctaaaatacttctccttcagctctcacagcaccttgtggacatgagtgaaggtcagtcagtgtgccaaatagattttgtgtggattatggcatggaaagtggctgagaaattctgtagcagggtaacaaaattatcttggtccaggagtcctgtagtggagaagataaaagtcaatgcttaactcataggttaacctcagcatgcttttgatttggtcaagcaatcaaagtactggtgaagaattgaagattggaagtgacacattttttgctcagggaagtaatggagaaagaaaaatcttcctggaggtagatcttcagtttggattagtctgaacatgatgaaacctgtagaaaccttcatttctcaagacaaagctcaaattcaaggttgtgaggaatgcagtcaccacttttgttaggggcagttgtgacagtgagtgactgcaaaaactgagaatgcgaagcctctattgtaaaaagaatgtgcaagtgccatagaagtcactgcaaggattgggtgctggagcagtgccggacctgccatcgtcaccagagtgcagcagattcaccagaaggagaatctccactcttgtcgtcactaacagcacttgactttgtcccattcataaaagatcttggaaggaattaaaggtgcttggtggttcctcattccaacaacaccttacttggcctgcccgtggaacatgcgttagtctttggacaggacaactcgagtcacagaccacaagagaaaagaattttgtggccatcagaattgtctgcttaaacacaccacgggtgcacagtgtcctcagcttggtgaaagggagatgtcacacgcgagaaggcagcggagccaggcatgtgatggagtgggaggtggcacctggctctgtgaggaggctgtgaagtcctgcatgggaggagcaaggtgggggaggagggggtgggggtggggcagaagaggaggctgagcagttaatagaggcgctcgaccttagaggaggagagtccgaggtctttattggtagtattcaaatgtggttcatccagagttattttctgtggctgaatggcctactctgaaatccacagggaaaaaacaactcacattcaacccttgagatgctaagttttcttttaaagtaaaggaaatgttataagattttctgaaaccaccaacctttagcgatattgtcagaccttctccaacattttccactgcatttgtcagcaatcagagatgacctccacaccgaggcgaaccctccaccccccgacccgtttcctctttctctctttccctcctttgctcatccagaaacacttcagtcatcctgcattgtctccaagttgacctccatcctcatccgcacctcgtccacacctgaatactctgtccacatcagtgatattctacatgtctttataatagcttttttgtttgtttgtttgtttgttttttaaattttgatgcttaaaaggcaatggttgtcttagggataggaaaacacaccccactgtcactgtgagtgaagctgaataacgtctctaggtcttttaccattgctttcttttttttctgaagtgatttttccttttatgtccattgctttaagccattcgtgaaattgcacagtgatttctggagtggggacagaaggaaggcggtagtaaaagtcattggtgctgtggcccagttggctggaggaggtgcagggcagggcggcctgcgctggggcagctggaggagcacagatgtccccacgggcaggtggatgagttctgagagctggagggccggtacagtgtcctccatggttccagcttgtgggcttgatcaggccgtcacctgcggtggccactgagctggcgatgaactccgtggccttggagtcgccctcggcagagatgatggccgccgtcttctgctgctcagcccttgccaccacagatctggccctctcttcttcctgctgagccacctctttggttccactgcttctgcaaattccttcccgaaggtcagatccaaggtcacagcatccaggaggagcccaaaggttgctgcttgctccgaagttaattgctcacctgtctggagcccagctctccctgcgtgatcagttctccagcgtcagcctgagccgcccccagcttgaggagctccgcagtgatggatggcagcacattcttcattggcttctccagtaattggaagatgcaaggacctggccagcaacaaggtgggaagaggacgcccagtgtgatggtgacaatctttgctcacagtgatgattggtgcataatgtggtcaagagcagcagtcaaaaataattggtttcttttcccatgggatgagaaagtgcgttccttcccctatcacagtgtcctgaatgccatggaattggtcgaagatgacagacagctctctgtgcagcatcacattgtagaaggcagagttccccacacctcctgcagaagctaaggacagggcagacttggcagctgtgtttccatctgctggacccactcacgcctgcgtccactccaaccccccacatgaattccgtccctttatcattgatttctgatgcgaaaagtcactttgattagtgaagtgttgctttatgtagatttttaggcacacatctgttagataaaatgaggattgcctgtagagaaagcaaataaaagcaaagtccctcttgttgaaactggtgtgggagcccttgaacctcatgcagctggcctccctgctctgaccgagttccctgagggacttctccaaggaggaatgtgtgagaagcactgattttgagcactctttcatgtggacaaatttcactttatttacaatgtaaacttaaatttaaattctgtctttctaggctgggcacggtggctcacgcctgtaatcccaacactttgggaggccgaggcgggcagatcacttgaggtcaggcattcaagaccagcttggccaacatggtgaaaccctgtctctactaaaaatataaaaattagccgggcgtggtggcggctacctgtaatcccagctactcgggaggctgaggcaggagaatcgcttgaacccaggaggcggaggttgctgtgagctgagatcacgccactgcactccagcctgggcgtcatagcaagactctttctctaaataaataaattaattctgtctttctgcagtttttctgatatttggcaagtactggaaattattattttccttaagaccccaaattttcacaccaacatggcacatgtatacatatgtaacaaacctgcacgttgtgcacatgtaccctagaacttaaagtatgataaaaaataaataaattaattaatttaaaaaaaaagaccccaaatgtttgcttttaacaaaactgaattaagagaatcactgcaggccgggcgtggtggctcacgcctgtaatcccagcactttgggaggccgaggcgggcagatcacgaggtcaggagatcaagaccttcctggctaacaccgtgaaaccccatctctactaaaaatacaaaaagaaattagctgggcatggtggcgggtgcctgtagtcccagctactcaggaggctgaggcaggagaatggcgtgaacctgggaggcgaagcttgcagtgagccgagatcgcgccactgcgctccagcctgggcgacagagcaagactctgtctcaaaaaaataaaacaaaacaaacaaaaaagaatcactgcaaacaagagtactttctagcaaaatccattctgatttgcaacagcactgataaataacatggttattgggtttctttttgttttccagtcaaagaagattggaatgtcagaattaccaagctacggaagcaagtggaagagatttttaatttgaaatttggtaagtaaaagccagtatttatgtctttaataacatatcaacaaagggccatgtctgaatgaagtatagaagttcgggaccagccgggtgcagtggctcacgcctgtaatcgcagcactttgggaggccaaggcgggcggatcaggaggtcaggagatcgagaccatcctggctaacacgatgaaaccccatctctactaaaaatacaggaaaattagccgggcgtggtggcgggcgcctgtagtcccagctactcgggaggctgaggcaggggaatggcttgaaccccagaggcggagcttgcagtgagccaaaatcgcaccactgcactccagcctgggcgacagagtgagactctgtctcaaaaaaaaaaaaaaaagaaggaaaaaaagttcaggacctaaagaaggaaggtcccagaaactgggtttctgtttctttctaccactacacttgctactgaaaccaagcagatgacttcatttctcttggattccactttctcacgtgtcagaatgggagaggaagggaggtgttgggataagtttcagttccactgtttgtacttctcgtctggctaacacccatgtggcaaataggtttcatcatttgtttcagcttagatttgttgacagcggtttcctggagtgctgtcttgagaacgattctgaggaggctcagcaagaaagagtgtttcagttgattgggtgtgtctgtcatggagaaggaagtaaggagtgggcagtgctagcaaaattcccggggcacttctgtccattatctcaatacctggggttgacatttcctgtctcagatcaggagtcctgactaccctgcctctgaccactcgaactgagtgctgcttagctgtatcgtagacaccgcctgtttgtgaacagacaccctgcttcttgatgataacacaaaggccagcagggtccactgctgtgtggaatggccttcggtcatttctgcccagagcatagaggtcattttcactaataacataactctccttttgattgaaagtgttaaaatgttcctcctaaaagcacttattttttaggctcgttcttcagatttgccccatatcctaagcaaaatgccttcaatatgaagtggatattgcttgaccgtagggagcttgtccatactgtactcgagaatgtagacacaaagaaagaatgtctgtgtcaaatgttatcctccgcaacttaacgttctcttgcactttcagctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaagtaagttctttttgccactgtagtcgtttctggaatcaaaacaataaaatgacatttctgttaagatgtttttcaagctagaggtgacaggcgtggctgtaagtccttgatggcaaagcctggctgtgagctgcagtccgggtactgtccattgcccctgcccatactcaatcatcttcatccgtgcaaggaaaatagtgacaatcgcctccgcggagtcaccgtgaggccccgtggtgactcgcagcatgcctgagtacttgaatggaagtttaatttgctggtttttatctgctctgttattcctggtcaatcttgagagcgactaaatattgatgattgagtttctttcttttttttgagacggactcttgctctgtcgcccaggcttgagtgcggtggcgcaatctcagctcactgcaacctccgcctcctgggttcgagcaattctcgtgcctcagcctcccgagtagctgggattacagacttgcaccgccacgcctggctaatttttgtatttttagaatagatggagcttcaccgtgttggctaggctggtctggaattcctgacctcaggtgatccacccgcctcagcctcccagaatgctgggattacaggcatgagccaccgtgcacggcctaatgattgattttcttatctacatttctgcagaattttagtggctaaagaaagtacactagtgttttttttttcttttttaatgaaaatagtcacttatttactcttcataaaatggcttaccagtcatgggaaggaaaagtcagggtcttttgtccacaacactaggaattattgtgttacaggatgattctgtgaatgcctttagaaaaaaaaccctgatcacatcacgaccgttttactagctgtgaggccaccactgtgctggctactgtaacacttcttggttttctttctagacctgaactagttatttcctacttgcctcctgggatggctagtaaaataaacactaaaggtaagagacgacgtgtactccgtatcctatttgagcgcattaagacactctttatccgcattccttaaatcatacggaatcggccaatatctctgtggggcttggagttgtttactttgctttctaaggtattttatttaatggaactatttttctttttttttttaaaaaaaacaaaacatttcattggaaatgtcacatttgcaatcccagttcattcatgttttcacagctttgttgagcccctgtggaggattacactacaagtttaattctgcaggtttctttgaaaagaaccaaactgtatgaattttaatactctgctcttataaagcatctccttctgtatttttttttccctacaatatacaaaaggaactctgcttattttacagctttgcagtcccccaaaagaccacgaagtcctgggagtaattcaaaggttcctgaaattgaggtcaccgtggaaggtaagggccagtcctcggtatgtttctgttcattctctagttactaattatgtcagttcactagctatgtgtttatacaggtttatacagatgacgttaaccaaactagcttttaactgtgaacagctgcctgtgataaagctaaatttctgaatgcttctaattgaaaatttttaaatccttaatagaaaacagataacatggatcacatcataaacttcccccaagaaaagtcctaaaatgcttttcctttatcataacaaataagggtgcagagtcatgtggaatgttttatcttttttttcctcttcatttttttctattcttttaaggaaagaaagtttagggtggtttaaacagcagtgccttgaataaaagtattttctttttcttttttgagacagagtctggctctcttgcccagggtggagtgcagtggcacaatctcggctcactgcagcctccgcctcccgggttcaagtgattctcctgcctcagcctcccaggtagctgggattacaggcgtccaccaccaactccagctaatttttatatctttagtagagacggggttttaccacgttggccaggctggtctcgaacccctgacctcaagtgagccaccacgcccagctggttcttgtcttttcaggctcacagtgttaaaatactgcatacaatactaaagacaatctccaaccaactgtcaagtatggatatttcttccatctcttcataaatgcagaaggaaatcactgcattaggatcattctctacatcccaggtgtcaagtttttaaataagagtttgccgtactggtgttgagtggcgcagaagtccctatttagtcatgtggcacactttcagagagcctgctttctcataagatagccaacaagcatccatggacaacttacacctgattaattatttctgttcaaaaatgccaagaattaaaaatatattgaacccttgactttcctccttccggaagagatcagaggaagatctctcttatatacaagatgccagcctttcctaaagggcagagccaagttcacggggcctgggaggcctgctttaagaatacaaaattagggccaggcgtggaggctcacgcctgtaatcccagcactttgggaggccgaggcaggcggatcacctgaggttgggagatcgagaccagcctgaccaacatggagaaaccccatctctactgaaaatacaaaattatctgggcctggtggcgcatgcctgtaatcccagctactcaggaggctgaggcaagacaatcgcttgaaaccaggaggcagaggttgtggtgagccgagattgcgccattgcactccagcctgggcaacaagagcgaaactttgtctcaaaaaaaaaaaaaaaaagaagaagaagaagaagagaagaaaaatgggtttctgtagaaatagaaaaatggtttctgtggaactcgccggaatgacaagaatacccatttcaatttgaacctagctttgttttctggcacaggctggacttgaagattgtaacctagagacacttacgtcattaaatgtgtgttgattatcattattttttctgtcttttaggccctaataacaacaatcctcaaacctcagctgttcgaaccccgacccagactaacggttctaacgttcccttcaagccacgagggagagagttttcctttggtaagtaagcgttttatttttctttctttcatagttttaaatagaatacgttcattatgtttcattttaccaggtgaattgttcctattggtgagtcagtatatatcaaaggttaaaggaatagcccgtagagccaggctgcctgagttcagatctgagttcaaatccgatgccacttgggcaggcgaatacaccctgcctcagtttccctttgtgcaaaatggtaataacattactttctttctcatgaggttatggtgaggattataaatactgtcatttaaagtacttagaaccatacctcgcatgtagtagagactataatttgtgggggcattttgggggttttcatttgttttttctttattttagcatttgttcacttatttgtagtcaacataaaagcaatgtactaaaacagtttgcttatgtatcaggatgggagtagttgtcaagtcatatcatggtaaaagattatgcattttttatttcttcttaaagatgcacaaataaggccaggcgcagtggctcacgcctgtaatcccaacactttgggaggccgaggtgggcggatcacctgaggttgggagtttgagaccagcctgaccaacatggagaaaccccgtgtctaccaaaaatacaaaattagccaggcatggtggcgcatgcctgtaatcccagctactcaggaggctgaggcaggagaactgcttgaactcaggaggtggaggttgcagtgagcagagatcgcaccattgccctccagcctgggtaacaagagcgaaactctgtctcaacaaaaaaaaaataagatgcacaaataagatgaaacactcctgcctgtgaatgtgtattgataagtactgtgataagtattgcaatttaactctcttatgttttatatgcagaggcctggaatgccaaaatcacggacctaaaacagaaagttgaaaatctcttcaatgagaaatgtggtaagtctattttgaaaccttcttactgccacgcagggtgccttcatgggagtaggagggagcagagtgggatactgagcgttggagtatccctgtcattggcaacgtgtgggtttttcgggattgaatggcgtcatttcgcccatgttctgtttcgtgtacgcggctgttttgcaggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagtaaggaaactggatgaagtgggattagcatgagttgattgtgtttgacactgggagatgggtatgtgggtttgtgtttgtggcagggctgaattagctctggagtcagaaaaactgctttttaagctgcactcttgtatatgtttaaaacttctggccaggtgcgatggctcacacctgtaatcccagcactttgggaggccaaagcaggtggattacctgaggtcagaagttcaagaccaacctggccaacatgatgaaacccatctctactaaaagtacaaaaattagctgggcgtggtggcacgtgcctgtaatcccagctacttgggagactgaggcaggagaatcacttgaacccagcaggcagaggttgcaatgagccaagatcgtgccactgcactccagcctgggcagcaagagcaaaactccatctcaaaaacaaaaaaaaaaaaaaaaaagaagaagaaattttccttatgctgctggtagaagggaaggaggactccaccatactagagagataacgacttttggttgctaaatctacacagctatgttgttactatttgatgctgctggaatctgagcagctgtttagtttttcaagtccttttatttctccaacttaatagaatattttcaatttctcctgtttgcttgaacatctgtggattaggctaacataattgaaatagataggaatgggccgggtgcggccataaatcccagcactgtgggaggctaaggcaggcagatcacttgaggtcaggagttcgagaccagcctggccaacatggtgaagccccatctctacttaaaatacaaaaaaaaaaaaaaaaaatagccaggggtggtagctggcacctataatctcagctactcagggaggctgagacaggagaatcacttgaacccaggaggcggaggagatcgtgccattgcactccagcctggatgacagagtaagactctgtctcaaaaaaaattaaaaaaagaaataagaataattggaattttatagtacatgctaatgcacatgaattatttgaaatcaattgaaatgaattttaggtttcatttgcttggtgtcaggcttaattttgagtcacccagggatgctctcaagcaaagctggccactttttttttttttttttttttttttttgtgagacagaatctcgctctgtacccaagactggagtgcagtggtgtgtgatatcggcttactgcaaattccgcctcctgggttcaagcgattctcctgcctcagcctccaaagtagctgggattacaggcatgtgccaccatgcccagctaatttttgtatttttagtagagaaggggtttcaccatgttggtcaggctagtctcaaacccctgacctcatgatccgcctgcctcggcctcccaaagtgctgggattacaggcgtgagccaccgcgcccggccgccaccttttatgcttttggccaggtctgcagaggtttggcagcctctaagccctctgcttctgcttccggagtgagagcctcaagtgctcctgttttcacagcccatcttgtgtttccatgctgcgtttgtggggcgttttctctttccatcctcaattctggcgctgattcttttcaggatacattctaaccttggaaagaagatgccaataaaaccagtgtaggggaagggcagccaatgagaggcagcaatggatgttaaatttacaattgtggtttgtctttttggctgtggttctttagataagcatgtgatttctgttcttcatgactaagaattgaatttagactttacagagttactggtttgtaaatctttgagttgtttaaattttaatgttagagttttactgtttgatcagcacattttttttctcttttgtctataggcccgaaatgtttgagacggcgattaaggagagcacctcctctaagagccctcccagtgagtgtattttctgtattttcattgctatagaacacacgctcttaggcatgcattgtgcagctgtggtttacaaacattgtttaaagaatagccattgaggccaggcatggtggttcacgcctgtaatcccagcactttgggaggctgaggtgggtggatcacctgaggtcaggagtttgagaccagcctggccaacacggcaaaaccctgtctctactaaaaatataaaaaattagccaggcgtggtggcaggcgcctataatcccagctactcaggaggctgagacagcagaatcacttgaacccgggaggcggaagttgcagtgagccgagatcgcaccactgcactccagcctggacaacagagcaagactcatctcaaaaagaaaaaagaaaacccattcaaagttgtagttcaggctatttcacaatttttagttatttaataattgggtggctctgtgagtgtgtgatgatctcctaagtacccccaggaagagaaaaacagtgaaaggcagcccttcagggggcatcatgtcttcttgaaatgatctaccatggaaagaaagaaccttgaacaggactgagataaaacagtctcagacagcatgattattagagatgttgaccgtgttttctacaaattctgattttaaatgtatattttcaggaaaaataaattcatcacccaatgttaatactactgcatcaggtgttgaagaccttaacatcattcaggtgacaattccaggtatgagttctctgcttccatcagagtttttgggggtctcttcagggcctcttggactttcccaactagagaggtttgctcagctcatccggggactcggatacattacacgttgcctggtgctcctcccagactcctacagcagttgccttccaaatacagttgctctccaaacagcaacggcaagttttggcacttggcatgagctaaatcctgttaaccacccaaatggctagtctgttccttaaaaaaagtctatatgagaccgggcacggtggctcacgcctgtaatcccagcactttgggaggctgaggcaggaggatcgcttgaggtcaggaattcaaaaccagcctagccaacgtggtgaaaccctgactctactaaacatacaagaaaaattagccaggcctggttgtgtgtggctgtaatcccagctacttgggaggctgaggcaggagaagtgcttgaacccgggaggtggaggtcgcagtgagccgagatggggccagtgcactccagccttggtgacagagccatactccatctgggaaaaaaaaaaaatctatataaaacagcaggtaaaggtctttataacaagaataaatttgtagcatttttagttaggcattattttaaacaatttcaaatttaattagctcaaagtgctcaaatacttaaatcattaaaaaatggaaaatgcttgaaaacattacacagagctcctaaaaattgggattaaaagtgcatcattgagcagcggcttgtacctgtagtctcggctacttgggaggcttaggcaggaggatcgcttgagcccaagagttcaaggccagtctgggcaacatcgtgagaaaccatctctttaccataaaaaaaaaaaaaagcagtatttaagttttgggttttctctgaactgtttcagatgatgataatgaaagactctcgaaagttgaaaaagctagacagctaagagaacaagtgaatgacctctttagtcggaaatttggtaagttttgcatttgcaaagtacagttgctataagcaaagagatttgttttaataagatcttttcagcagatgatggttggatggttgtaatcctatataaaaggagttaaaatttaaaagtgagttgtttgtgctaaatttatttaataagataccattagtgttacactattgattgtcagtatgaaagttaatgaatttaaggttcaccatctggcagtgtggctcacacttgtaatcccagcactttgggagcccgaggcaggtggatcagttgaggccaggagttcgagaccagcctggccaacatagtgaaaccctgtctctactaaaaaattcaaaaaattagccgggtatggtggtgcacacctgtaatcccagctactcaggaggctgtggcacgagaattgcttgaacctgggaggcagagattgcagtgagctgagatcaagccaccacactccaacctgggtgacagagcaagactctgtctcaaaaaaaaaaaaaatttaaggttcatatttaaatttgtttgaagtgtacaaagaccttagttaacagcagagacagtctttaaaataaatgttgatcttgtgcttttgacaggctgtttaaggcggtgggttaatctgtgctgttgtgctgtttgtctcactgtccctgtaggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattaggtaagtgagagtttcctgcttagtcacaggagcgaatctggagctcatgaggctgactcttctaaaatgcagccacaggtagtcatcgaatccggcttcctatgctgtgcaatcaacaaatcaaaataacttgtgtcatcattagaatgtcagatgtgcttctacgaactaagctgactcttttaattctttggcaaagggttggcaaactaggactgtttgccaaattcaggctgcctcctatttttagagtcttcctgaaacacagctacacccgtattatccatggctgctttcctgtcacagtgagtaagtagctgggactgagaaggcatggcctccaaagtctaaaatatttactctctagcactttgtagaaaaaccttagctaggcacagtggctaacgcctgtaatcccagcattttgggaggccaaggcaggcagatcacctgaggtcaggagttccagaccagcctggccaacatggtgaaatcccatctctacaaaaataaaacagttagctgggcatgatggcgggtgcctgtaatcccagctactcgggaggctgaggcaggatagtcgcttgaacccaggaggtggaggttgcaatgagccaagatcatgccactgcactccagcctggacgacagagtgagactccatcacaagaaaaaaagaactttgtcaacctctgtcttagggcgccttgtcacaggcttcgggtcagacggattcaaccttgcatcagccatttgttagccaggtcactctgttctttgtctgtaaatgagattgatcgttgttcccactgagagtgtcagctccttcccgtagagcaggcatgatgattgtactcacctctgacaccattgtgagtgccacattccttcccacgtccttgtcactgtaagagatgcccacctgagcaccaaccccaggttatcttcccctttgtcttccagccccccagaaacagctacgactcaacctacccaatcatttcatcatcagattgccactgtctctagttcaggtctcttgggactggcactcagaaatctcataataaatcctcttgaggcttctcatacactcgtcttcttccaatcttctttccctcaaaatctcatattttggttccacttcacccaccgtcattctccatatcactcccaggagttaggcaaaaagccccttccgttcttccgtatgttaaacttagaatcactctgttccctgctctgcgtttctattttttgtttttcctccatttactagtagcttaacactttctaacagtgttcttattattgatacgtatctatctcttccataagcttataaggtcacggataatacttctcattgtagtacgtaaatgacgtgggctagatatgagttgaataaacagttatacctgtaaattcttacagagtgaaaataaattgttatactttacaatttgtttctctctttagaccatttccaggacttgtgattaataaccgtgagtattttgtgaagtgttttgtttttgttttttcctggggtctgacgtgtgtgcgtgtgagtgtgtatacatgcttaacgtatatcacgttacttcacctatgtcagtaaccaggccaaatacttgttttagccctcagtaaaaacaccaggcacttcctagttgtaaaattattcaagcttcttaacttcctatcctcgatgcacttaatcataaaatggtaataatagcaccgattttgggggagtcgttccagtagatggaaagcatctggaacaggtgtcagcaagctcctgccgacgtgtatgcataaagttttattgaaaccaccatcgtgtccatttgtttatggcagaactgagagatggcagcagcaagtgtgtgcctgcaaaacctaaaatatttactaattggctctgcaagaaaagagtttgcatccccctaacctagaacagtgtctagcctctagtatgtgtttagcctacagtatgtgctcagcgaatacaatctatatttattactgcttttatgactgttataattactgtgcttggatttcgttacaaagtaagtcacaatgtgcctgcttctgttagtatttcagcacagtgcctggcacacatggggctctcaaatattgctgagcgagtgaacaaatgtcctttcaattccttaacgttgatgtcattttcaatagtattttgagccaaacttaattttgcgagtgtgttttgttttcttaactttattattaaaaatgtataaaagtgaggccaggcgtggtggctcacgcctgtaatcccagcagtttgggaggctgaggcaggcggatcagttgaggttgggagttggagaccagcccgtccaacatggtgaaagcctgtctctactaaaaatacaaaaatcagctgggtgtggtggcgcgtgcctgtaatcccagctactcaggaggctgaggcaggagagttgcttgaatcctagaggtggaggttgcagtgagctgagatcgtgccattgcactccagcctgggcaacaagagcaaaactctgtcccaataaataaataaataaaatgttctcttttgttcctgttcttgtgcggtagtgtggtatagagttttatggtaattactgtgaattagtgattctgagggacatatcagaactctgaggtttgtttccttctcatcttgagggaaacagcaaatgtatgttaaaatgcttttccaagggaacaacacatccttacattatttaaaccaatctgcttcattttcagagctggttgatcagagtgagtcagaaggccccgtgatacaaggtgagcgaggcaggggagggcccggagctactcctgcctgcacagtggcacacatggcgtgcctgcgtgtggcttcggctctcagtcacctgccctgaggggactcagttacacagcacacacatgcttctctgtggttttcactcctgggtttgacagctgatcaaaacataaattcaagctgtgggtcctgattgagaactgggggctgcagaccatttgcaccccctatcccagctcaggcctaacatcaggaaccccaggattaatgggtaggatgaaatggcagagcaagagggccgtcactttaacctgactctgccatccatttctaatgtctgccataagtcagtgagcaaaatgttcttcagtagaaatgtacagattgtgctcttaaaaaattccttaaaaaacaagtggaatggcctggtgctgtgtgagtcattgaaagtaatgagactgggcgtggtggctcacgcctgttatcccagcactttggaaggctgagaagggtagatcacttgagatcaggagttcgagaccagcctggccaacatggtgcaaccccgtctctactaagaatacaaaaactagccagacgtggtggcgtgtgccggctactcaggaggctgaggcaggagaaccgcttgagcctgggaggcggaggtcgcagtgagccaagatcgtgccactgcactccagcctgggcaacagaaaggagattctgtctcaaaaaaacaaacatacgaagaaaaacaaaaaaagtaatgaaaagcttttattaaagggagtaaacagaaggataagggagaaagcataactaaggagcttgttttcatggtagagctatgttaagactctgctctttcaaacttcagttgtatatgtgaacttaggaccacatttgaaaaacagaaatttgaaagtacacttggataatcgtgtgctccatctcaagaccgtgagcattgtttcatcatgcacctgtgtttgtacagagtctagagggcttttctcctcttcctcctcctgggttctttacatagtataaagcagctgttgaacaatgtggaaatcagtctctgtgtttctctttagaatcagctgaaccaagccagttggaagttccagccacagaaggtaaaagggtggggtggtcctgcaagtccttaagacttcttctttcttcttcttttttttttttttaaagacagagacttgctctgtcacccagggtggagtgaggttgcgcgatctctgcaacctccgcctcccgggctcaagcagttctcctgcctcagcctcccgagtagctgggattacaggcctgcaccaccatgcttggctaatttttgtatttttagtagaaacggggtttcaccatgttggccaggctagtctcagacttctgacctcaagtgatccgccagccttggcctccaaagtgctcggattacaggcgcgagccaccttgcccagccaagacttttttatcaggacaaaggattgtgcatttaaactatttcactagaactgggtggtggttttgctctctttcttctgggtgaattggatttgcaggttatgctgttgagtgatgacgcatagctgcttttgctccatttcccccagatgacttggtaaattctccgtgaatgactctgctacataacctagataacctaacgtgtgtcctttaaatgcatgtaagccagaagatgtatgttactttgaaaacataagtaacaaaattttgaatgtattgctaaagagatgtctctctgaagctcttttgatgtttggtgtcttgtccttcttattaaaccatatcttagtaaatagtttggtacgaatggatttatcactgagcaggtctgcaaaataattaatcggtaccgttttgtttctgttgatagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgacttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaagtca

SEQ ID NO: 393 - DNA, 36369 bp, Homo sapiens
tcctttaggagctgccggtggagagtgagtgctggtcctgtggaggagggagcaagccccgtggtccggagtgcatttccatggatggcttcagagctggccaggatggacagtactccaggcagtgggaaccgcacgtgtgatggcgcagagggaagaaataaagcggccgctttgggaaactgtaagtcgtttgtggctggaatgtcaagtttgaaggtagagtagcgggtttggagattagaaaggttctgaacataaagggccttgcatgctctgttaagaaggctgtccccctccccttggggctgggggagaaaactcacaattctgtgttttagaactatggccagagtaatagagtgaaggcgaactgcctgtgaaacactagaagcagagagatgagttggacaaatttcaccccacagtgctttaattaccaggtctttaaaatggagactgcagtaacacctacttcaaagtgttgtgatgaggagtgcctggaagagtgcctagcacatggtagatactcaataaatgtcaggaagtagaattagtagcagcagaaggctgccatggcaagagaggatgaggggcttcagagctggtccaggcagaagcagagagaatggaagagacgaaactgcttcaagagctatttcagctatctgaacctaaaggtcaggggagaattcattagctgagcagacagaaggaggagagcaaaaatattatgagtggacatattaggagtatgggagagcagtgagcaagcttgctgtgctggaaagtgagattgcgcaagaaaagaaagagaaataattatgtaacagtagtactagaccaggttgtacaaggctaaggccaggcttaaacattttttaaattgtggaaacaatgaagagctattgcagagcattagactcaggtggggtcagaggcctagcttcaccatttgctgtgaccctgggcaagtgcccctaactcacagatgtccaatccaattgactttctgcctggaagaaaatattccatatctgcaccctccataatggtggccactaatcacaggtggctattgaatacttgatatgtgactagtgtgactgaagaactgaatttttaattgtatttaatttaaattaatttaaatttaatgtatttaagtttagtgtatttaatttaaattaatttaaatttaatttaattaatttaagtagctgcacatgactagtggctactgtgttagcacagctagacccaggactcctgtccctccatctgtacacagggaatgatgatgaaacatcacaggcttgttacaaagatcgagatatattgagataatacactcaaagtgctcaacacagtaattcaacaaattattgctgctgctgttgaaattgttattgtttttattgaacagggattgcatgacatacgccaagtcttaggaagattagttagactataatatccagttagatttgatgggggaaaattgtagaggataaagcattcacaaggttatttcagtggtaaggtgtgagagaattaagatcttatccagtgaaagaccttgagaatgggaaagaatggaatgattgttgagccataaagcacatgggtgtgcaccactcatacacatcttctcatatcagcttccttccaaggtattctcagagagtacactcccaacccagcccaggacagacactactacgacccctacaagatgcacagccattctccctgcctgcgccagaaactactagtgctccacaacacacaccaacatttgtgtgtctctttctgggcacagtacctcccaaatttgaactacacttcccagcttccttgcagtcaaacggatgccatgggatcaggttctgaacaatggaatgaaggcagaagcaatgtgcgccatttctaggctgggctcatttaaaaatcttccatacaacctgcattccctcttcccattctgtgacaattttagaggccatatgtaccacataatggaaagaacctaggcttgaatgaatggatggagcagagctacccctgtcccctagaccctcactggactatagaatatgagtgagaagtgtcagtggctttgttacagctcagttgcttgttacagctaaccttattatcctaatacatcatccctcattccactgaagttcatctaaacaggtcctatatagattacccgtctaaaccatcaatccttctgaagtctcttttgaactgggtcccaccaacactaagacagatttctaattccccatctgcagacatcctgactgctgacattcctttctcactccccgcagatatacacattccagacatatcttctcccacaatgctgggtcaaggatacacctactgagctatcttccagatgattgagtttattggacatgtcagggcttcctcctctcctgttaatccccatgcagagagacctctgatgtccctggggcatgtctttgtttactgtggctcagacccaaacctaggtgttatctctgagtcctccctttcctctgctcctacaacaaattcattacaaaatacagttggatttgccctgtcctctctctccattccctctgccaccctagtccagccaccatcatcaccacctacctacctgcagcagcctcctaactggtcctcctctgttcgtctttccccctctaatcctctctccaccaagcagctggagcaatcttttaaaaataatagccatggccgggtgcagtggttcacggctgtaatcccagcactttgggaggctgaggtgggtggatcacttgaggtcaggagttcgaggccagcctggccaacatggcaaaacccatctctactaaaaatacaaaaattaaccaggcgtggtggcacgtgcctgtaataccagctacttgggaggctgaggcaggagaatcacttgaacctgggaggtggaggttgcagtgagccaagatcgcaccactcaactccagcctgggcaacagagtgagactccgtctcaagaaaaaaaaaatttaaataaataaataaaaataacaaccagaacatggtactcccctgcttcaatcactccagtagcttccatagctcttagagtaaattgattggggtcttgccagctccaaccagccttactcacccttgctcattttacttcagacacattcgcctttctgtttctcaaacgtgccacacttgttcctgtcccaggttttttgtgctttgtgcccggaaagctcttctctgagtgtttataagattgatccctcatcattcaagtctcagctcaaatgttacctcctcagaggattcctcgctctgttttatttcctccacagcacttatcatgacaaaaaattgtatttttactttccacccctactcctgctgtccctattggaatataatctccaggaaggcagggtaactgactcgtcctgattcattggggactcttccagttttaccacaaaaagttccacgtcccagaaaacccctcaatatagggcaaactatgatagttattcactttatgtctgccttgatcacttctgtattcccagtggctagtataacgccaggtgcctaggtaggaactcaataaatattcaatacatatgaaaagggctgaatgtccataaataattctttgaccctggctctagggggcagccttccccaaccttgtgcctgaacagacagctttgcaggttggactggtagcttgtgtacctaggtagtgagttccacaggattctccctagaccttatgtggtccccttgccgcccctccacccccccaccccagcccttgtggagttcacagctgaggaccctggctgtggcaacccgaggctgtgcctgacacagaggtagattccttccctctccccattctaccccacccaggcccccctcctgcagcttcgccttcctcctgaggtcaggcttgtagaccacagagcagaaagggctgtcctagacagcagcagcaggtggctggctgcaaggaggagctggccccatcaccatgcattctaggaggttgcagggaggactcaactctaagggctaccttggacccagaatgcagctccccagggctagggctgccttctgcccctttagaaggggttcacctcaattctcagggctagagtgaaactgctcagagtctggcttcttgctgagaccccatttcctctgcctgcccactgacagcctagaggtctctgcagagggcaggatggcaagtgagaagatgttgagtggaaacagcaggtctttgaactcaggagctaagaaagcatcagaggcaggtggcctggggggtcagggggaggggagggggatcacaggtgcagctgcctggggagagcagcatgaaggagctagggcccaggcctgcctccctatcttggtgttctctagcgatctccatctcctaacctgaacccgcaatcacagatacctgatctgattctctttcaccttttactgagggagctgttgctggatggggagggcggggtggataaagcctgcaattcacctccacagggacttgggcctggggacaaatggggctgactgacttccttgactccttggaagctgccaggggcaggagaagggcaggttgcagcactgtgaggagtgagagaataataaggcttgagggcaggaggggagggcattagctcttccccaagggaaaagcctggcagaggggttcatcaatatttgcccttcagatctgagtttgagaactggctttactgaatgagaaagtcaccatggagccttcatcagtgcacgtgggtccccctctagtccagctgaatgggcactgggtgaaggaaaagactagaaataaggctcttacctgtgcttagtccagagcaggggccccaagaatggcaccctagagagacttgagtggccacatctcatgatacttcttggaagaggaagggttggacaagagatggagtaagacagcgggaggaatggcaattggtcaagaactgggtggacaggccccaggagggaaagacagatcttgggaagctaagagggaggtgagaaaaagccatggcaggagggggagaaacttggttactattaatgcaggaaacctctcctgagggtcttctctgtataaggcactgaccacgcaaggcacgcatttttgagtacagcagagcagctctcaccctccggcagctaacattctcctggaggaggcagcatgcaatacttatgcaatgctttgatttcagtgtggtgagtgccaggcatgtggcagagaaatgatgccctgcaggggaagtctgacacaggccaggccctgaggtgggtgcagagccagactcaggggcagtgacaggccagaagctgccactttgcctggcccccagggcccagcaggcaccctcagctgaggccccaggaggctgggcttggggagaactgaagcagttggggagattaagtcaggattcggtccagccctgcagtgtgttaggcagagctcacggaccaggctctgcacttccaccagaggcaaagcaggcaaagcggctaaagcaggaggggctgaggctgaggggtgggaaggcagagcagtggggctgcctctctatcccccgcaaggcctgaggggggcctgtgccctctctcaggcagaactgcagactttcccttacttctgtttccttctctggaccccacttttctgtttccttccccacttttctgtttccctctgtggaccccacttttctgtttctctctctggatcccacttttctgtttctctctctggatcccacttttctgtttctctctccagaccctcttctttgtaccctcccctaatttttttttttttttttttttttttttttttttttttttgagacagagtctcactctgttgcccaggctggagtgcagtggtgcgatcttgactcactgcaacctccgccttccaggtttaagcgattctcctgcctcagcctcccgagtagcttggactataggcacacaccaccatgcccagctaatttttgtatctgtagtagagatggggtttcaccatgttggccaggatggtctcgatctcttgacctcgtgatccacccgccttggcctcccaaagtgctgggattaccggcgtgagccaccgcacctggtctaatttcttaccaagttctttctgaagggaggaaatgggcagtagatctgatgccaggaaaactttggcctattcggtttcttctctgaccccagtacttccagagtgggatttgggggtgggatggctctgctctgatgctgggaaggggaccttagccctagcctgctttcctggttacccacatcctccccctgccccagccagtgctctggatccagcctgactgaccaggtctgagagacagaactgggcatctcctaagcagggaacagggccctgctaggacccctctttcaggctcctgcagtcgcccctaccaagactctgaaacaaaaggacaaagtgggcacagggtttgagtcctgaacagaggcctgggcctgggatgagttggaagatgggagcacttaagacaaaggttttgggaaggtggggaaagttgcaaagaggggagtggtgggaggtagtaggtagtgtgggtgttcagcctcagaacagaatacaggggtgaggagaaaagtgactcttagggaaagtggccacaactggaatggggcagccattgcagaacactgatcactcaaggtcagatgcagtgtctcctgggacccacacaagacacacacacacacacatacacacacatgctctctctctccttgagaagcagaagttgggggagaaagcagttactcgtttctatacattcctgtaacagtaaacttgccgggaggcaggctgcttccctcccttctagggacctctccagccctgcccgtcttcgcctgctcttctggcttctctcaccctgtccctaccctccagcccagcatcaccacctcaggtctgttcagcgactgtttcctcatctccgccatgcatggctagcttgagcaccagccagaggaatgtgcctccaggagagtgtggggttcctgctttcacctctgcaacttcctgcagctcccagccctgactgtgagccccagcttgcccacattggcctcctacaggaggcaggagcccatccctcctctccctcccatcactgtcataagtggctcatgagtgactggttgtgacctgttagtcctaggaaggtttggcttggggcccattaaggctccagctccctgccgctgccccccaccccaggaatgggcaagggaggagatggaggagctgaactggaactgcccttgggggatggagcgggggcaagagtcagagggccttaaaccatgcagagccaggaggtagagtccagaggaggatacctgcctctctgctcaatctcttcccactgttgaccaaccacaggcaaggtcgactcctaggggtattgtgggaggctcagccacaggccaaggtcctggcacagcccttatatcccctacagctttatctcccagctggcctccaagctggccatttgctgcagtcccatgggaggcctattagtgaaattttcctccatcctccctctctccatcccaccaatcaccctcaaatgtcacggctgagccttgtgaacaaagctgacagcacaggatagaggagacatgagtaggagacaagaaggcagccaggaaggagggagagatggcatgaaaggccttgaaattgaactgggaaactagctcctctcccttccaccctgctgaggctacaggcccatagcaggcaccagctgactgcccactgttcctgttcatttcatttccacccgtaatcattaagcatcagcttcatgccagacactgtgctggggagggagagccaatcagattattgtattagggagataaaagataattccaataggctctggggccctgaagatttgggacagtgtctgctgctcagtttgagctctccagtttacagcaaagttccccggcacctacagtaaatgttgttgaatgaattcaagattccttgaatattcttgtggcattgcatagtaaggactgagcgaggcaaggttgagagtagcaatcggggcaggaggtagcagtgcacaatggtgtttaggaatatggactctgcagttagactgcctgagtctggctgtactacttattaactgtgtgaccttgggaaagttacttcgtctccctgtgactcagtttcctcactcgcaaataggaattgttctgaggataaaaagatgtatataaagtgactaacatagtattctgcaaatagtaaatactggaagagaccattattgggctagaacagttgcagtggggatggggcataacagagagatgcaagagatgcttcactggttgaatcaagccgacttggtggctggctggatgtgggagaatgaggaatgtagggtatcaggctcctcacttaggcagtagtggagtttgggaacagggagctgagagaggcagagcaggaggagaggcctcctggggcaggaagggagtatgaggttcctgtgaagacccaggaaactatgggctcaccttgtgtagagctcagcaaagaggccgaggtggggaaaatcaagcccagagtcaaagcctggtctgagaagcccccttcaccttcccaccctcctgagctatccatgggagccgctgccacctgcttgaagggaatgggggagggttcaagtaagtccatgctctggcaggagctcattgtccgagtagagtgtattaaggggtcctgctgtttagtttccatcatctgtaccaaggtgtgggcaaatggctgtggatatgagtttttccccctttataggagctgtcagtatgtttcagaggcaggactgcagagtggtaaagcacacagggtagaaaccacctgggcagagtcactcatggctctaccacttcctagtatgggaccttgggcaagtcatttaacctctttgtgtctcaggtccctcatctgtaaaatggaataacaaaaataacaaccttatctcatagggttgttgtgacaattcagtcagtgaatatatacaaagtatcaagaacagggcctggtgcatgttgactattcttattattatttatctgtcttaacacacctgccaagcatttaatgacagtcagaggagggtggaggcggtaccaggacatggcatgattgttaccatcttgcttgcatgtgttcctcagacacattcccagtcctctgccccttctaggcctcagccttgatcaaatatctgctgagcagtaattctactgtcgggtccccatccagggatcctgagaaggcaaaaacctgccccgtcatctgctttgatggcaggctgggggccttgcctgttagaggtaggacaagctagaaatgggacacataaaagatctactccctatgatctccccaggctaggagccaataggtaatcaccccaggtcctcttctcaatctccccagagagggggaatgaaaaagaaatggaaaaaagaaaggcaagagtagtgttgaaggggaacataggtgggggagtgggttgggacagtttcattttcaccgatttgagtgatccttggctccctgaggctcccccacacctcaacacaaacatattcgatttcccccctgccttttttttttttttttgagatggagtttcgctctgtcgcccaggctggagttcagtggcatgatcttgactcactgcaaccttcgcctcccgggttgaaagaattctcctgcctcagcctcctgagtagctgggattccaggcgcacgccaccacgcctggctaatttttgtatttttagtagagacagggtttcaccatgttggtcaggctagtcttgaactcctgacctcatgattcacccccacctcagcctcccaaggtgttgggattacaggcgtgagccatcgcacccggcctcaattttccttttttgagtagactctcctaggcagtctagtctacattagaagaatagaatacatacagagtatacgcagtataccatggtgagtacgtggagacagacaacctggattcatgccccagctccaccatttactagctgtgtgactttggcaatttccttaatatccctgagcctcagtttccccatctgtgacgtgaggataacagaagtacatacctcacaggatcgtggcagggattaaacacatggaaagcacttgaaagagtgcccgcacatgattagattttgtagctctgctgaaatgtatacaagtgtcctgcctcactccccagcatcttccacctgcccagagtaagggcagcaagaataggaaataggggacccctttgtgacccaactgccagtctcaggaagccttcctgcaagaacttctaggccagggcactggccccagcaacccgaaactcatgactccatccccctaactcttccccatgcatacctgtgactcccaacttgtcatcctttcctgtcagtttccaggttgctcttccttcttccaaattaccagaactccgttgaatggatttgggtctgaggtcagattcattctcaggctttcctccttccccggagaggcatttaaaactccaccagcgtttcttaatgtgtggacacagcagatgacctggggtgtttgttccaaatacagattttccatttcatgccaataggattgaatatgaattgctggggacggagcctgcattttagtaagcttctgggaaacattttttatacatgtatacattaaaaatgggattttaatcacaattaaaatttctctccccactttcaagaaaataataattggtggaggatgggggcttggcatcccaaaattgggagtataggcttcttagagctacctcttcccagtcttctcctcactttcaagaaaataatcatggtggaggatgcgggcttggcatcccaaaattggggtataggctttttagagatacttcttcccagtctgggctggctcaacagcaaagggaaaagggaagagaaggggcaaaaagtcctaaaaagctgggggtggggcgttcacctccttccaaaccctcattatcgtcctgaattacgggtcgctgtccccggccactgtctctccaccctctcaggagtggggcgaagaggcccgcgctgggccatttgcacagtggtggaaactgaggcccagggaggcgtggagcctcggtagcaagcctgcctagcagggcgctggaatgcccggtctccgcctcaacctacccggccaccagggagcgcgcggtagggggcgtggtactcgaacaccttctgctcccctggaagctctgccacaaccccaatctcctcttagggcccctacccgttctggagagcagtccttcctctccagcctcagtttcctcaactgctcccggtgtgtgtgtgctggggcagggggcagtggggcgtgggtctgggaacggaactgtgggaggcaaggcagcgggattccccgcgggaaagccgcctattccctcccccgggcggctggagaccctgaaccgaaacaggaggcagacacccccagccgggaagcggccccagcccggatttccctcccgggtgaggccgcagtgactcaccccctccccgctctccccggtttccttgtttgcatttctcctcccggccacgtggcggccagtgcagccactcaccgccggatccctgacaccccggccgttgcggcctcctccacacacttcggggccgctcctgccccctggggatactctgggctcaggcggatgtccactctggtacccccgggtgcggactccaaagcctgccagtgccggcccccttcccctacgcattcctctaccgtaaggcagggcgcctccaccccgccccctccgccagtcctggggaggggaagggggcgggcagcgcagggggtgtgacagctcccgcccggaccggtgccagcgcagccttgcttcagcgcccggtgccagctggctccttcgtctgagacgaaggcgcaggctcggggctccctgtcgccggtggctgggtggcgtccccccaccacgcccccacccctctactcacccaagaggagcctctccaccgagccctgcatcctgctgccctggcagccagtccagctaggcactggcccagttcactgtacctggacttacccactggcaccctccggatccccttatcaaagctgatgggggtcgctggggaccccccagccttttgctagagcctgcacggctgtgcgagcttgaaaagaaacatgaaggtgggtaaggtggggtcagggttgaggaggagcaggagagggcgggagaggaagctgacacggtggggagtttgggtgggagagggagggttagtcagggctgaggaggagaggagaagggtttaagccgaagctgcatttctgggagacctagtgaatctatagcttcatactgggaggtagtggagatccctgcaggggcatgggcagtgagatgggacagaattccaaagaggactaagaagggcctgatcttttccaagagccagctggagacccctaagtgcgccagaccggcaggccccagtgaaggtcttcctgttcctccccccagctcctggcagggttgcagcacctccgcctgaccagtccagaggactctaaggaagtagttctgcctggggcagttgtactgtggcccagccgccccagtcgtgtcccatggctgtccactttcctccccgtgtcacaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctgggtgagtacctttcacctgcccaggtgccagggccagtaccagagctagaggggggcctagatcatggcttggcatgctgctggtggcccagcttgctctgggggtgtacagtggtacagctgccgtggacactgggtcaggaagcttgtctgcagtgtgcgtgggtggctcacacagctgcaacgtgtgtgtgtctgtgtgtgtgttctgcccaaatgtctctgtttgggcatggggggaaggggaaagggatttgttgtttatctgtcacctcagtgagccggcattgagttaggtacttgtgtgttctttccaggtggaggtgggaggtatgggggccgggtcaatgggttggagtgaggtaagcttggttacagttctgggtgcatcaccgtggcaacattctcctttagtgagttactgaactgtgctaattctgcgttttggtcttagggtgaggtgatcatgtggacactgcttggtacctgcctttggggggctcagggaaggattctgagacatttggagaatctgagatcaccaaagtgccctttgctagtgagaaacatctctggacctgaaagaatgaaggagagagcagggaggggaaagaatggtgggatttgggaggcaagataatggctgtactatccaaatcagcagagaagctatccccaaccatccagactaaatagagtagcttagcttgagattcagttatgtctccactgcgtgtgtccacccaggtttcgctatgttgcctaggtaggtcttgaactcctaggcccaagcaatccacctgccttggcctcccaaagtgctggtattacaggcgtgacccactgcgcttggccgggagagttcatttcttttttcttttctttcttttttttttttttaaccagagtcttcctctgtcaccaggctggagtgcagtgaagcaatcttggctcactacagcctctgcctcccaggttcaagtgattctcctgcctcagcttcctgagtagctggggctacaggtgtgcgccaccacgcccagctaatttttgtatttttagtagagatggggtttcaccatattggccaggatggtcttgatcgcttgacctcgtgatctgcccacctcgccctcccaaagcactgggattacaagcatgagccattgcgcctagccgagagttcacttcttattggcaagtccttttgagtggaataaccaccaccctctccctccttccccctaccttgcccaactgccatttacagtgaggctgagttgaaaaaactgagacctaccaagatgaggggctcctctttgcaatcagaattgagaggagagtccacatgtcagtcctggtagagctgttctctactagggtcttccttatcatgagcctgggtcctcctccgctacccctctggctctccggctctccgctctccgggtcactggctgtagctattgcctggagccagtgggctggaaccctccctccctccttccctcttgggctataattatttgtgcatttcctgtccccttcccagcttgtggaagcaaggtagggggtagggagaaggtcaggtgccaggacaataggtcactggaggatctcctgggacctgaagtctgggagggagtggaggaggccaccaagctgtctcctgactctccacagcccccagaaatgaagggctggtgtgcaggggaaggccagaaaggtgggggtaaaggttgctggagtgtaaatggggtcaaaggcaccaaaacaaggcctttccgtgccaggtgggcgttggtgactagagggaacttagatttttagtgtttagaggcaggcggccactccctcttctgatgaccaactttggggactggggtggggaggtttcattccatcatgcctatatttgagaggctctgggtacctgtgaagctgtacttcttacctcttgatgatgcctttagcccagggaaggcttccgtgagggaatgagtgccagctgtgagcatgcacgcccatggtgaaggggtggagcccgagtcccaggaagacagcactgccagttattgaggccagacctccctcttcgaaagccaaggggaaaacccatcaacctcccagagaagaagtctgaagacagctctttctgttcctacctagaccaggacaagagaaaatgaaagcgggttacagtaggagggcttgcagttagatacagactaagataagacttaacagctattgcaaaagtgacactggaatgggatggaagaacatctttggaaaataagagggggaggtgagatcttgtctgatgtccgggggcaggggcaagatcagagtgacctgtggtgggttctactagctcagggaagtctgagatgattctctttgtgtgactgttcttggggaagtggccctgttttgtaactccgagaacgcactttcattcaacctatccaaataatagtagtagttaatagttatacagtacttatgtgccagacattattgaaagaggtttgcctttatcatatcaaataattctcacaacagccctgtgagataggtactaatgtcatcatctccattttatagatgtgaaaacaaagccacagagaggttaagtgacagattcagagttacgcagctgctaagtggcaaagctgggctttggtcccaggcaatctggctgcagagtccaagctcataaccacataaccaccatgctgcacttctctcttgctacgaacagtaacactgacaccttaaggcatcatcccggccccatgcacccttcccctgtcccaccacaagcagccctagcttgacaccttagctatggcccaagggaactggtctgacaggtccccaggctgtctggctctgtgcctgtctctccagcccagctctgacattcagtgacagggagtgagggtggggcaggccacagtgctggtgccaggggagttagtgcctcctcttccgccctgaaccctttctgttcaggaatgagagtggggagtgggtgaggaggaccttcaccttgactcatatcagctgcttcttcccaactgagaaccctgaaactgacatgactagcattgtatttttttgcactgtgtcctggtaatagggcccatcatgaaataataacatctgatcaagtcaactaaacttactaagtagttactatgatccaggcaccattccaagtactttatattattaactttttgatcctcataaccctttgtgataggtactattcatatcatcaaccccagtttacagatgaggaaaccgaagcactgcaaacttcagtaatcagcacgagctcacacaaccagatggtaacgcaaaagctaggatttgaacccaagcatctggctgcagagcctacacacttgaccactgcccttgaatagcagccctctctccgccccatcctagaaggttggcaggcacacaaacatcctgggggcacagagagggtagaataacaaacctgtctatctttgtctaacccagtggtttccaaacttacttgcccacagaacttgcctgaaggcagaatacctctactgtctgtgcctatagcacaaagctgaggaaacatgggaataggcataatggaagacggtagggcataatgctaagagcatggcctttggaatcagacataggtatgaatcctggtgcccttattgaccaacagttagggcaggttatagaaccttggagctttcttttctctagctgtgaaataggaaacaaatacctacctctggggtcagcaccagtagcagagttattcagtagaatcttacctttctaaatagttgtgtgatctctctgggcttttgctttccttgtcaaaatgagagggattccttaaagtcccttcctcagtgctcatggactagggccattctctgacctgcatcctcatcccctgggggaggacaggaaatgaccaacctggccacgtgacccagcaccacccctcctaatgtgccctctcccaagtcagaataataccaggaagggggctggtgctggagcctgggttgtgggctccaatgggagttggggcagggactggggccacctgggcattttgatatgaacaacaagtcattagcactcaggcactgtttgttccgacacagggggctggctgggtagcattcctgcccttcctcccttccctggctcctcctccttctcatttcctgtcgttaagtctccagggctctgtgtctggcactgggctgggccccatgacccgggcagggatacccttgggacacctagtgacttccgcccagccctgggccaggcgcctgcacatgccagacctcaggcctctgcttgggcacgcagtgccaagatgcctgtgcccagggccctgccagcaccaggactggttgtactgcaactccccagcaggtccttttcagggacctgaagccagatgggaagctaggagagaggtggctggtgaggggagaggaaaggggcaggtggggtgggtgtagggagactgagaatgggagcacttctgggtgggaacttgaacttctccacagctgtctggctgtccgaagtatgcgcaactgagttacacaaggtacctcacctccaggcttttatttccttgtaagtgacagaggacagacaatgcctgctctgcctatttcacatctgatcctattttacatgagatccaatgaaatcaagggggcgattgtgctttgtaaactgtaaagtgctttgtaaactgtaaagtgagccctttgagagggctcgtagatggtagagcatcctgtccagagatgtccacaaaccccagattctcaggtggtaggaagagaagggtcgtgaggggctttcatggccattattccagggcgtacaggcccgggagttccaaatggcttgttaccaagggcagggaatccttactaagcagtgtttccatgataaagtgcgtcttcctgagccagtcctgtgtgccaccaaggacttattcactctcgcagggcacaggctagcaacatctcagagaagaaagacgctttccagcaagcagccccaccctaatgcctcacagatgagtactagctaacatgtgcatacaactatatgccaggcaatgctttaaacattcgatgtgtagcaactcatttaattctcccaaaacctcatgagtcggtattattagtgctttgtagattttacagttcaggagactcaggtagggagggagaggttaaatcatttgtttcaggtcacatctgccatcagtggggaagcagagattttaatccaggagcctggctccagggtttgtgttttgacaaccaggctgatccgaggcccagagatggcaagacacctgctcatgggcctgtggaaggacacagaacctggctggggatcaggtctgtgaccccagcccaggagcggatgttcccaggcctcctgagctgctcacatcctggctcccatctcccaggtcttcttatctcatgtcctcatgctccttccagctccctcacttctttcccccaacaggggcagttcacctgggggcatgggcacacctgggccctgagtaagcagaatgggtgtcttagggctctcaactgtagggaggcagtccttgagttgggtttggtgatcaggatggcagggtgggaagaggcgatgcccggggcacagggtgctgagtgaatatttgtttatttgctgaaggagtggccacatggatgcatttggggttggggcctaggcaagagtgggagtgatgggggaggggaggtatccaagagctgggcttgaagacctcacactgatgtgcacgctttccctgctgcccccagacaccactcaccaacagcgaggagtccctggatttcagcgagagcctggagcaggtagaagcctgggcagggtggagctgggacaggcagcaccatgaggggttcagagcctgaactgctgtgcccttcctccctctaaggcctccacagagcgggtgctcagggctgggaggcagctgcatcggcatctgctggccacctgcccaaacctcatccgagaccggaagtaccaccttaggctctatcggtgagtggaggccctgctgcctccttgcccagcctcactgctttctctccgttccactttatgtcaggcacctgggcctcaccctgcttctagcacagggacgaaccaggcttgggcctcagagggtgcctttctaatgcatagttcctccctctccctgccaccctccttccactggcctgtccccttctaccttccataggcagtgctgctctggccgggagctggtggatgggatcttggccctgggacttggggtccattcccggagccaagttgtgggaatctgccaggtgctgctggatgaaggtgccctctgccatggtgagcccgagcccagggtggggtgccccgggctgggctgggcagtgagggggacaggacagggcagtcctgggaagcaggcactacttggggagtgctgaggggtggcatcgcagtggggtttcatacccacatagcctcaatttcctctcctcccccacgcctgggcctctgccccccagtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagccgtgagtcagaatccctgcaccccgtgaccccaggcctcacacagcactcagatttcacggtttctcagattgatctctgggggcatcccttacctgttgtggagggaagggaacctggctggcccagaagcccctggcgctgactgccacggactcactgtgtgacctggatccctccacactcccaaacccccccaagtcagtttcttcctctgtagatgaggatgttggaccagggggatctctgaggacccttcccactcagagacacagttgtggctgaaagcaagtgggttttggaaactgcagtccggtgggtccaggttcaaattccagctggactggctactggctgggtgaccttgagcctcctcatgctagttcctgttctgtcaagtgaggatgatagaaccactccttagggttgttgtgaaacaatgcatgcaaaatgctcatcacaagcgctgccacatgtgcgcactcagtaaaggttagctgctgctgataactgtcactgctgaggcaccgtctggcacaggcatcggctgggtgggtggagtggctccctgcacctgacgggcccacagttcacagtgtgctcccattcctcctgtccctgcagcccaggtcagcgcacggatgaagagctggacctcatctttgaggagctgctgcacatcaaggctgtggcccacctctccaactcggtcagtcctgcccctcccagccctgccccgtaccaggcatcttctcttcctgtgacttccctgaaactccaactgctgggccagagggcatttctccacttccatctatggctggaaattttcagtctgatttcttgcccccggcgctgccctgtctgaaaatccttccgcctctctcagcccattttctccacttgctttgtctcctgctgaatcctgggaacacctgacctggccacatctttgtcccccagcacttgtgtctttggacctaaccacacccctagcaaaagcctggctgctctgcacatgaacttgtcgccaccgactctcctatctccaccacacaggtgaagcgagaattagcggctgttctgctctttgaaccacacagcaaggcagggaccgtgtgtaagtccagcagggcataagaagccaggcacagggcctggacatgggcagaaggatgtgtgaaggaatggtaggtgccaggagggcccggtctgaggtatgcttctgtcagtgttcagccagggggacaagggcacttcgtggtacattatctggaagggatctgtcaacgtggtgacccatggcaaggtgagccctccctcctccccaccccagtgccctgggtcctaactgctccctggtccatgtcctcatgggcagtgcctttgttgatctactgctgctgaccccgtgtctcctgtgtgggttgttctcctgccgtgggtctgtcctggcaagagctgggggcggcaggggcggcaggggcgggctgagactgaggcctggctgcaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggtgctgctgctggggttggggagggcaggggccattcgtccagagaagtgatgtggagagaggagtagggaccagagcagagggcctgtaagaagcagggcaggtaagagatgctgggctatgacagctggcagtgggaccatagccctgggtgtgtgtgagaaggtgaagcccataaggcacagaaggagttcagtgagaccagtgacttcaggctcagtgtgggagaccaggggaaggatgggcatgcagggggcgggggactaggctgtgggggaggcaggatgcatggaaggtagggaaggctgaggaggtggagccaaagtcggaggtgggagaagggctgtgggtccctgtgggaccctcatggggctcaggggctggaatgaaggaggtagatgagagggtctaaagctggaacatcatgagttgagcatgggatgtggcctgttctccaggatgtggaggcaaagaccatgcggctggaagaacatggcaaagtggtgctggtgctggagagagcctctcagggcgccggcccttcccgacccccaaccccaggcaggaaccggtaatacacctgccatgctccctctccacactgtccctcctttcatttcccaatctttgctcccttcccctgtgtcatatccctgccctctggccacttgtggatggagaggtattgagggaccaggatgtgcctgctgagccagtctcctccctgccctaaggtgggacagggctggctaatggagaaaaatgatgtaattgattattgatgtctgcccaggtgtgggagtggggagtagtggcaccagtgccaaagattggccatttctgctaggtatacagtgatgtctggcaccccagagaagatcctagagcttctgttggaggccatgggaccagattccagtgctcatgacccaacaggtaagggcaagagacaccctgcctgctttctgactcattgggtggtccatggagcctgggagagagccaggtaccctgcatctgacgtcaccgaatgctggattggtctgtacagaagttggcaataagtcctcttacctgtgctcttggcttagtggggagcactatcacaggggctggacactgctgggaccttgcaggtggtgggatgtggggaagggtccttccagctgtccatacacctgtgctcagcagacttggcctctgaagcctcctcccatcccctcaccctgtcatacagagacattcctcagcgacttcctcctgacccacagggtcttcatgcccagcgcccaactctgcgctgcccttctgcaccaatatccttccagctccagggggatggtgtgcatggggataggatggtgcgtggggttgagagaaaatctcaccagcgtggctgtgctgagccctttaaatgccagcctgctgccaggcccagcttgccaggggccctgggcatcctgcccctcctttgcctcaggtgggtggccctgcttggatgttgtggttcccttgactggtgcccaccttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccaggtacctgggagtgaggcacagcggggctgggctgcccggggtggatgcagctacagccatctcagtgaatcttggctcttcttagaaactctcagacctggtgggcagggacacccgactcagcaacctgctgagggagcagtggccagagaggcggcgatgccacaggtgatgctttgactctgttaatttgtcatttccataactggcagtgccatggggaccaagagcatacgctctggagtcaagcacttggcttcagatccaggctgcaccacttacttcaattccttgttcttatcagtccccttgctgttcaccctcacaccacatgtccctccattctcatgcatcaggcactcattcatttattcattctcatatcctgagtgcacctgctgttctcacttcctccattgggcatgcatttattaccaaataccctcagtgccagcttctgccagtcccgcccggtacatttcctagactttaccttcacctttgcagatattcccacgggagcagctgagattcaggggggttgggagctcatctgaaacagcacttgatctgaaaccctgggtctgcatctgcctttaactttttccttcccctcctggccttggaaaatcacaaagtctgggggcctggtttcaagaccgtgttctcccctctttatgtgatacttacctggtcgtgcttacctctgaaccactggtgagggccggggagaatccagagccccaagggcctccctgctgcagccccagggatacctgggctcactcacctcccttctctcttgtctgcaggttggagaatggctgtgggaatgcatctcctcagatgaaggtgtctgcctggccccagtttctttcctctgctcctcctggactgcaggcccctccttcgccccctgaccctgaggggctctgtgggcgtgggaagctctcctcccacagacacacccttgggtctctgataggtgttcacggggcccttgctgcatgtggtgccctgggccaggccgtgccaggaggcgcagaggcctaaggtggcctccctcctcgcccactccctgactcaatgggccttttattccttttgggaggtaattcatgcccacaggtagagcctgggagatgaggaatggtggctggagttggcccctgaggcccacggggctcctggtggccagtgctgtgggagctcagaggaaggcgaggcccctccctggaaagtcagagggggccccaggccattctcagctggggcttaaagggaagcaaagaggggatgagaagatgtgactgcagccaggatttggttgaggaatggtgggagaaagaactggaaaggtagattaggttggtggtggggagggctgcactgggaataaaatccaggggcctcaccatccagcaggctccccatggtcccaccctactgtgtgtcccagcccctgcctgctggagactcttactggcttcttctcctccgcaggcgaagcccgttctcccctcagggcctttgcacttatcccttagcctggaagggtctttctctggctctgcctggcaggatccttctcgttctcatctcagccaaatgctgggttcccagacaggccccctcccgtctccctatccggagcaccctcccctttctcccaccacgctctgccttggtgtcctctgtgattttcttcaaagcactctcgccatgtggagttgttttctttgcctacttgctttctgtcctttggtatctctcccatcccactggagagttgacttccctcctgcgggcccccacctccgcttctccttgctcacatgctgcctggctcttggctgacgctcagaaactgatgtgggctcaccctcgcaggccgggcactgcgctaggtgctgatgctgcacctcattcaaccctggcctgtggggctgcagtcaggcaaggggcagagcagttcaacaacccgtgatgtgcagtgacacgggacactttccctgaatgtgcactggagtcggctcttccaactgtagtccgctcctgaaaacgggaggggaagagccaactccagtgcagattcagggaaagtgtcccgtgtaagcgactactggagttgagagctgcagggggcaagggtggaggaagaagaggattcctggtgggcaaacccaggaggaaagggaacccaggaggaggatccctggaggagcgagagtaagagtaggaccccagagcaggcaggaggtgggcagggccccctgggccaaggacaggggtctgatctttgtcctaagagcagtgcaaaccattaaaggggtttgagccaaggttggcaaagtctgatttgtgttttgaataggtcagctaaagagcctgggctttctccagcagacaatggacgccactgaagtcgagtgcgggagcttcacagggctctggtcaggcagattggaggaggagggctggaggcacctgggagggaggaggaggagcatagttgggccattggagtagataaggagtgaggcctcgtgggcaggtggaactggagttagcctgggcaggggaggagggggcacagaagacccacttcaaagaagaatcttcaaagcaagatgacaagctacggaagtgtggaggagcctggagctggggagaatggctggggaacagagtggtctgggaggcaggatgcaaggatccgatgggtatatggagtgtgaggtaatggatcattcatgtggaaggatgcagggggtttttgagaccagggtttggaagagagttcagcactgctggtagttttgggaatcacccatgtgcaggcgacacatgaggcagtaaggaactctgcaggggtccctgagatttggaaatgtagggaagagcaatggattgaggtccgaacctggaggatctgctatacgcagagctgggaggagggacagagtcagtaccagagtcggaaaaaagcagggtgggaaggggaacctgagtcaggagacttgcctggcaggcgctgccctgccagcagaggcctgacagtggtttccatgaactgcatccctgctgtgggctgggacagggccactgacacagtatcggagcacagagggggaaaggagcaggagggattccaactctgccagttagcagctgtgtggctttgggcatgttacttaacctctctgagcctcatttatttcatccataaaatggaaataaaaataatacttttgtcaaaggcgcattgtgaatatttagatcctcagaataatgcctggcttgtagcaaatggtagctggaggaaaaggaagagaaaaccaaagtcagcagctgaaggattttcatattagaactgctctggacctatctggcagatgcagaagcacacacacacggaggggcatggatttgccccgcccttagacatgttgtgtcttctcctggatccttggtcccaggtgccttacctgagctcaggtgaatgtggcaagcagagccctctggtggtgtgaatgctgtgtggcgcccgtgctcctggtgacacagggacctcacaatccctccctccacggtctcctctcatgtcctcccagccttattttctcgttcctcttcctcccaggcccggaacttgcctgtttggctccccaaccaggacgagccccttcctggcagcagctgtgccatccaagttggggataaaggttggtggtctgtgccggctgggcacagcccgacatctgcaccctgctgtctctgcctctcttgtcctgctgtcgtcactcttgacctcggtgtgcctgggccaaggtggcacgctgtactcctcagggtctgtgttccaggctgctggctagatctgcctcctacctgcctcttttttgctcagggcctccccacctgcagctcagcctcttggggatccctcccaccattactgcaatagccgccctctccctcctggggtggagatcaggcagcccttcccacagctcagtctggtctcctcttcagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtggtgagttgtgcccctggatagaccccaagggagggtggcccctcggatctgcgcccaggtcccccagtcaagatcattgtcatcattgtcatctttctggtcttcctcagtgtgaatgatggctagcattaatgggaggtggagtgcgtctgttcgaagtgcatttcatgcagtgtgtaagagcatgagctctggagcctgctgcttgcattcggcaccagccctttagctcaccatctgtgtgtcctctggcagggtacttcatccctctgtgctcagttttatcatccataaaatgggaatagtaggagtacttgcctcctggaggaattgtgaggatcaattgagttcatctatgaaagcatttagaatggtgcccggcacatagtgatacataagtattagctgctattattatcatcatttgtgtttagtcatttaatatgaattaataacaatctcatgagatacaggtacttttatcctattttcagacaagaacactgaagctcaaagggcatgagctattcctcaagctcacacagtgagagtagctggtcttggaacttaagtagtcttcatttgtttagtcactcagcaaacatttttgaggatcagctatgagccagcaatatgttaggagctggagataccacagcaggtaaaacaggtcagcttgatggttaagagcatagacggtggactcccagacccgtgaaggcatcttaggctcaccatttactagctgtgtgatgctgggcaagttgcttaacctctctgagcctgcatttcctcacctgtcagatgaggactgtaattgtatctacccacagggttgcaatggctaagtgagctaatgtgtgtaaagcacttagcacagggcctgccagtcagtgctgagaacatggcgggctcaggagtattaagatgggcctccagagaacctggaacattcaaaaccactgttctctgcggagggcacgggcttgacagctggaacccagggcagacaagaattaggggcgttcaagaagtggggatgagaaaagaaaagccttctcccttcaggaagtggggagagatggtcacctgtgtgccctgccctgggaagcactgccctctgctggccacctggtgagttgcagttgcccaaaggtcatgtttattgagaccctactatgtgccaggcactgtttagagcactgatctccgaagcacttggatcgacacccatgtcaataaccaacatttaattaaaacccacaccccactgtgtgaatatttgtttgtaagtaatacacatatattactacattaatatcataataaagatagataaaatagaaattgatggagtagaaatgcaaagcaggtagaaaaagtaaacgtaagtagaagagctcatattttccccaggcacatggatgatctgatgtaccttactttggaggccactgctctagggactggggactcaagcacagtcccagtccatgaggagctgatgaaaatcaacaccaaggcttatataagacacttcccaattttcaaagggcttttatacatagcatgtacttatagctactatttatatacattattttatttgacttatgaaatagttggggcaagtcttattgtctccattttaccagggaagaaagtgaggctgagggaggctcagaccctgcccaggttcttcctgactcactgagaatctttcctcatcctcttggatgtgcttccctgggctgcgtggctgcgtgggcacatgcacctgtgtattctgagcaccacccaggacttcaaccccgctactaggagaaacaacctctcagcctcccaaacagcacctccaccctggcatccagctggtccccggcctccctcccttcccccacccagtccgcctctgctgtctttgcagatgccattggcctgcagccagatgcccgtggtgtggccacatctctggggctcaatgagcgtctctttgttgtcaacccacaggaagtgcatgagctggtagggaccaggcagggtgccagggcccagggaggagatctattttgagtgtggcagtggtggattctggggagggtcccagggagaagagggaggaggggcctggctctggctgctgctgggtcctcagcacacaaaggagtgggcctcagctgatgggggaattcccaagatagtgcagggcaggggctggtagcactggttgggagctcccaaggagaaagaggaggacctgccctagttaggggttccccaggagacaggagcccaaaaggaggggtctcagcactggggagccctatcctccagctgctatagcccctagagaccctctactccccactcctgccctcctaaccctcctcctaacacgagcatagagtccttgccccaaccctctccccctaccctgtgcctttccctggattcctcaggcagccccctgagcactctcccacccgcagatcccacaccctgaccagctggggcccactgtgggctctgctgaggggctggacctggtgagtgccaaggacctggcaggccagctgacggaccacgactggagcctcttcaacagtatccaccaggtatgggaggcagagctgggggaggagagcaggcggcggggcgcccggctcggctcagcactcgctgacctctcctgctgaccccacccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccagtgagtccctgtccagtgggtagggcgtggccagagtccccccggctaccttttcctaagcccccctctttgcttagtatgttgccaaatctgccaccctatttgttccctgggtcccctggagcctctgccttcccaccccatccagcttggatctctgcagaggctggcctggctgttgtctgggggcactgtaggggtggctgcttcccttaccctgagggtctctgggtcttctgctcacagcctcaaggagcagaagaatctcaattccttctttgccgtcatgtttggcctcagcaactcggccatcagccgcctagcccacacctgggaggtaagtgtggtctggagggccccctcctgaggtcaggcctcaggccctcctgggagtgctggatggggctgggcctcccccagagcagccgctcatctgcctccttttcacagcggctgcctcacaaagtccggaagctgtactccgccctcgagaggctgctggtgagtgctccaccctgcccggcctggctctgctaggatcagctgggctcggccctgccctccagacaccctcactcttggcttccctgcagcccctctactcgtcctttgtcactttcagggttcccaacctcggcccagggcctagctccagcctgtgagtttggggagctggctgaggaaggggtgttcagcactaggataggggttgcacggtgcatcctggccctcagtgtgtgcatgggggcaggagatcctgtgtgaagactgggctggagcatgtgggtgtccagtcctggggtctgaggtgccagggcagtgtcaggggctccagagcccaagggcctggcatggagcgcctgtgtgcaccagggcctgtctgcccctcaggaactccgaggggcttgcgggctagaccagtagaagaggcgaggatagagttgggggtggaacctcccacctccaggaacttttgaggattttgagggttttgactattctggagagaagcagagaagaggtacttcatcagcatagcctgggagctcttgagagaaaatccacctcgtggggctcaagggattcaaaggagtttactctgcagagagagagagggagggacacagaaagagacagggatagaaagggacagagaggtgacagtgacagacttttccaagaaacctggggcccctgtgactaactgctgtgaattttctcagtgctaatgggaggttggaagccccgtgttcgcctgtgacagagcctgggtgagacctggggctgaggagaggctgagttggggcctctgcacctgctgtgggatgggcatgtggcccctccttggttgggtggggtctgtggtggcttatggtgtgtgcaaccccctcagtgtggcttcttcccctaggatccctcatggaaccaccgggtataccgactggccctcgccaagctctcccctcctgtcatccccttcatgccccttcttctcaaaggtaacagggcttcctgcctccatccctccattccccccttcctgcctccatcccccatttcccccttcctgcctccatcccccatcccatgcctatctgtgtgtgcacccactctgttggagagattatacctcaagtgctgatgcctcagggagtgcagagatgaattaggagttcttagactggaagaatgaagacatccagacaaatacgggctgccttcagggcctaagagatacaaggaaatgctgctggggcttggagggggcagaggcaggggctctatggggtgaggtaggcccaagggagccgttatgcccttcaccttttctgggctacaggagggcagaagtttggggacctatgaacaaaacccatctctttgcagacatgaccttcattcatgagggaaaccacacactagtggagaatctcatcaactttgagaagatggtgagtccagggagagcaggcattcactactaacataggttggaggacatgactgtggcctgggaaggggcagggcttggaggcagcttaaacttgttatgaataatatgaggatgaatacttactgtgtaatagcccctgccttattccactgcaactgggtctgccagggtgccagcctcagacgtctcaccattcaacgagagcccttccagccctcttctctctaagcctttctctcctggcctctgccttctgtcctctgcctggtccccgctgggcctctgggtgtgctgaggcgaagtacacatgatgccacataaccaaggatcttacagtccctgatccttggttcagagggagcttggcctccctgctgctgcacagggcaggacagggtttctccctcaggcaagagcttatgccccggtgttgtccgcagagaatgatggccagagccgcgcggatgctgcaccactgccgaagccacaaccctggtgagagggcgggtccccggggtgggaggtcccccaccctacatcctctgtgaggctccagggtggccctgactccatgacccctccccacccccgcagtgcctctctcaccactcagaagccgagtttcccacctccacgaggacagccaggtggcgaggatttccacatgtaagtggtgggcgatggtgggtgggcagggagggggtgcttatggtagttacccatggctggcacatcctaggcacttgccatgtgccaggcacggagcccggcccttccatacatgatgttgataatgttcagcctctgtgctctgagccagggggctcttcggtcccctcacccgtggggtgggcagggacagccgtctttaggaattggtgatgggaagtggttggtgggtggtggagggcaagaaggcagatgtgatatggctccttggaggggaaaggttgggttccacaaaggggcatcagtgcctccctgactactctcctccaccaggctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttccagattctgtgcctctggctttgttgtccagccaggcctgcagtttattttcacagtggacagagagagagagagaggctgcatgtgtgtaccgtgtgtggcaagggcagggccttggcctggggcaggggccccctgctttctttccacagctttcttccaacagcaggcagtggggctgcgggcctgtgcggtggtccctgaggagctttattgttactgtcaacatagtagtatgttccaggccagcccagagtgggcgtggcagggaggctgaggccccgccctctgggaaggagctgtggaggagaagcagccccatgctgggcacgggccagactgggtccaagatcctgatgccacccagatgtgcctccagggctctggccaaagggcgggctggagcctggagcccctgtcagcagccagccagggtgaccatcagctccccgtggtggtccaataggactttacagtccagatgcaactgacagcttcttcccaactgcaatccccgcttttccacacttgagctcgtcctggcctgttgggccaggcttctggggtcttctgggggtggcttgtgatagaaacaatgctgaagcttccgcggagagcccgtcgcttgttgaggcccaacagacttccaggaaatcagggtttatcatcagtgttgagaatggtcccagcaagctctggtcatacgaagtcctctcttccctgccccttcagcacttcccctaggaaccagctactgccaggacgcctcttgcgaggcagagctcacccaggaagctccagggactccaccctcttgccttgctattgccctgagtcctggcagcaggaggcacttgtctggccagagagagaactcatggcccctggcatgactcctgagtaggtattgaggctgcagggccttgggcgtccagaggcagctggtatggcccctctgcacttcagccccatggatgtggatacacaggcctgctgcttccagaaagggtcagagcctttagcagggaggcagcacagctgggcttagacctcaggtcactaagtgaatctgagcaagtcagtgaacagttctcttccttcatttctccacctgtaagccaggtatgataaacgccatacagcgcttagtgacaaacacataaaactgtagctcctgcctctgtagcagaggtgacagccaagggcagtcctgtgctatccaggcctggtaggggggcagcctcgcctcagttgagggctgagggagagactgaggtgcagcagatggcagtggtaaccaaaccagttcccttgccgtgggtggggacacaggagaagcacggaagcatctggaactgagcaatcaggacaggaggctcaagcctgggtgagtcaggagtccgggggctttcttttcatccaacccattgtctgctggtgtctcggcaaaagccagccagccagccgtggcccttcaccgttcttcagactctagggtgagcccagcccagcgacacaacagaaaccaagtgccacgggggccggtgtcctccaccagcatttctcctctggtcacatctacgtcctgatgggacttctccctcctccttggaccatcagctttacagtccagaccaccctgcagccacccggtggtctcccagctgccccagtctcgggcaggatggcttttgagcctgttgggagagaccttgccaggagaatggtgcccagggcaggcaagaggacacagactctgggagctagaagagttgcggcccagggggccaggccactcccagaggacaggaggcccaaaagcggggaaaggctccatgttacggtggccccatgctgggagtttgtgctgccttctgtctccctgactgcccaagcgtggggtggtgtggggcaggaggcatcctctggtgttccctagcagcccaggctgtgtgcaggggctcccattttgtgtctcagctgcaagaaggccacaaagggaggaggggctcatgggactgctgagaagaaggtgtgcagaaagggagtgtggccctagatcagtcctttaaaaagcctctgttacctgaaaggaggtcaagcagagaggaatggctgcgtgtgtgtcctaccgggcaggacaggacagagggaggtcattgttacacacacatcccccctcctttcctccttcccctccacttccctgtgaaggcctgaggcaggctgtggccaggctcaggccctgactgtggggtacacaccagggagggccacgcctccccacagacggggtggagtggtcagtggagccagcaccctctgctgcttcagcatctccgcctggagccagctgtcccctctctctcaggctccatccgaacaaaaggaaggcagagcctgagatccggcaccccatccccctccactcagcactgagttagagctgggtgggggcatgtctgccttcacacgctgccttatggcttctgtgtctccaacagccctcagcctctggctgctctccttcccaatagtcacaagatttaccatgataataataggttaagacttg

SEQ ID NO: 394 - DNA, 105491 bp, Homo sapiens
gcgcggccggcccgaggggcggtccctgggctcccgctcgccgccgctgccgctcctcgttctgctcctcactccccagcggctggaggccggtaccggcgggcaggaggcgcccgaggatgtgctgctggccgctgctcctgctgtgggggctgctccccgggacggcggcggggggctcgggccgaacctatccgcaccggaccctcctggactcggagggcaagtactggctgggctggagccagcggggcagccagatcgccttccgcctccaggtgcgcactgcaggctacgtgggcttcggcttctcgcccaccggggccatggcgtccgccgacatcgtcgtgggcggggtggcccacgggcggccctacctccaggtaagcgcgtctcctcccggagcccgcccggccgagcccggtcccgtccggaccccagagagggcgcaggtgcgggtcgtccccggggcccgcagctctctctcacctggcgcagccccgcgcccccggccacgctcactctcgcctccgcgggcagcgcctgctctcccggagccccagaaggcgcgcggtagggaagccgagcacggatgaccccaggcaggtttccttctttgaacactttcctgtccccagcgccccacttaatagacgcccccccgcctacacacctgcaatacaccccgcttcatccctgatgggaagggagaaggacctaggctttggctttggggacctaatgggacagctctcagaggagggaagggacagagcgctttagtacgtcgcggacttgctgtctaggagtggaaatctcagaacttcccaaatcgtggctatttgggagcctccaggcgcggggctgatgtcagctacaccattctccagaagaatgaagggcccctaagaatcgcttagggactttcctattccgagagctgttcaggaagccacatttagagaccaaaatcgaaggtccccaggcaaaatatcctatgaagtgacaaaactttggcttactttaataaccaataaagttaatttgaccgctgctgatttactttgaaggagcctaagtaaccaccttgcctgttcatgggtgctttactaaatagaaagaaaaaaaaaaaggaagaagaagattgtgagatgaccagaatgattaggtggctaggtttcctggacatccttgcttgatcgtgaccaacgtttggatggcggtgaacgtacacgctttgttattataaaaattcatccgaacatactgccctttgctaaaagtcttgatccagatgaaaactccgaattgttctggcattgcattaaggctttgatagtatttaaatcagtgttctccgtggatttagagtgcgcttcttagtaattttatccccaggttcttttcgactgaaatatgccatcaaacttgaacgctgattctggcactgagctgttaactctggaaggaaataaagtgacaacaataaaaagttcaaaaccactctattatctattttttcataaattaatcgtttcttcccccaaataagtaactttacaactccaataaaataaagttttatgaggattgcattctgctgaagtcactgatgtataaatattctcctcctgcagcatctcagacattaactttatgaaccaagtatttgaccacaaatgcaggcctcactaggggaatgactcattctcctgtaatataaagtagacaataccttatttaaatacctatttaacgttttttaaaaaagaaattttaccgtttagggagaggagtatagtatgccccttaactatccttgcatgttctacaaaagggagcataactcttactatgctaatattataaaatgggacatactttgaatgttaactccatattattttccctcaaagagtagcatttctagaaagcccagccaattgtatgtcaaatgaaaagccgtgagtagaattctgattcaacatgccataataggcccaccacaaagataaacttggttaaactacagtgttttcaccctgtttgtggttcttcatagagattgcataggacttagttaagtactctttagattgattttgaaacatagaaattttcttaaagtaattagtgaatacacatcactatgagataaattatgactggctgcattctcaatacatttaatgagcaataaataggacttcccgtccatttttattcctaaggaaataaaatcatttttacatgtaaaggatgatcgttttcttacttggctgacatattttaccttccatttccataaacattctactcattttaggacatataaaatgcattaaaattatgctattcaattaaatggaaagacagttaacttaaaatctgtttaataagatgaaatacaccaaataatataaatgaaataaatgtatcaatttcagttttattattcaggctgaatgattccattctccaacgctcgaaattcagtctcctctctagaaactatttatttaaggttcttcatacactagtgtgagaagagtattttcagcaactataccaaaaagtgaataggattctcttttttttttttttttttttgacaaagtctctctttattgcccaggctagattgcactggtgcaatctcggctcactgcaacctcacctctcaggttcaagtgattctcgtgcctcagcctcccgagtagctgggattacaggcgcctgtcaccatgccaggctgatttttgtattttagtagggaccgggtttcaccaggctggccaggctggtctcaaactcctgacctcaggtgatccacctgcctcggcctcctaaagtgctgggattacaggcgtgagccaccacgccaggccataaataggattcttaaatgtagcatatttgattctattagtagacttcatgttttgtgtaattttgctcccggcgagaacaacatttatatagaacaatgacacaaaaaacattggctcccggggcatcaataaatgcacagcagccactaagagttggacaattacaccagggtgtatgataataacctaagttgctatcctagtcacctcatcatgtggctttttggcatgtattttattttatccttttaaatttaattttaaactaaaactttagtttttaaaaatttttctgacttttattttcctaattatattaaactcttctttcaaaagggtgttaactccttgagaactatgtaagtgtaaatttttatcgatcaggtagagaatcattggcttaatagatgtcacaagtccaaatgtctatagatgtcaggaaataaatctaagagtgactggaggccattaacttaagtgaaacaagctagatgcagaaagataaatactgcatgttctcacttataagtgggagataaataatgtgtacacaaggatgtggagtgtggaatgatagacaatagagactcaaaagggtgaaggagtgggaaggtgtggaggaatagaaattacttatttgttacaatgtatgttatttgggttatggatacactaaaagccctgacttcaccactatgcaatctctgtgtgtaaagaatctgcacttgtaacgcatacatttatataaattaaaaaatgagaaaaaagagtgatgagagcttgaatggaacaggcaggatgtaatgcaacagagaggagatggcactgagggaactgggggttttgtgagtgaattactgttaaaaaggaatgtaaattcagtattgccagatcttctgtttgttcttttattttgagagaagacaaaatttagattctctttactctttctttttctttctttctttctttctttctttctttctttctttctttctttctttctttctttctttctgtctctctctctctctctctctctgtgagtgtgtgtgtgtgtgtttaaataaaaatctaattactaaatactggcaacaattcaaccatcatatagtgtgcattcacacacactcacacacaatttcagctgggatatatcttatagacagcctaatctgggactcagagagaaagtctaatgttaataaagaatcaacccaaataatgaaaattcatgaaaggcagagaagcaagtcccatttctttttaggccagttctattctatgccaggaaatgggtccagtattgggggctttgcccattgttctggctgtctattcttggtaacaaaccatctccatacagagtagcttaacgcaatgacaaatttcttttgctcacaagtctgaaatttggtggggacaactccaaagtgggtggttggaagaatatgaagccttgtttccttgaagttatggctggcagttgatgttggctcttggcagggaccttgcctggtgctgtggtaggatcatagcctctctgtgtggctgcttgactttgtcacagcatggtggcaggtcccaagagggaaccaagaggccaggtggcaactgtacagccttttatgacttagtctttcactgtggtcacaagcccactagattcaagagggaatgtagactctatctgaacatcacgtaagaagacagtcacatgggaattcagcagtgaagccccaagtcttggactttctatgttgggggagactttttattactgattcaatctcattactgattgttggtctattcaggttttttagttcttcttgattcagtcttggtaggttgtatgagtcaaggaatttatctatttcctctaggttttctagtttgtgagtgtattgttgttcataatagtccctgataatctgttgcatttctttgatatcagttatacttgtctattttttcatttttgattttatgtgggtattctctttttttcttggttattctagcaagttgtttatcaagtttgttaatcttttcaaaaaactaacttccttttattgatcctttgtattttttttgtctctgttttgtttagtgttgctctgatctttattatttcttttctcctactaattttgggtgtggtttttcttgttcttctagttttttttaggtgaattattagatcatttatttgaaatctttctactttttgatgtaggtgtttgttgctataaactttcctgttagcactgcttttactgtaccctataggttttgatatgttatgtttccattttatttcagaatttttttttcctctttaatttctttcttgacccattggtcattcaggagtatgttgtttaattttcatgtatttgtgcagtttccaaagttcctcttgttattggtttccagttttatttcattgtggtctgagaagatacttgatatgatttcgattttttaaaatttgttgagacttgttttgtgtcctcacatatgggctgtcctaaggaatgtttcatgtgctgatgagaggaatgtatattctgtagctgttggatgaaatgttctgtaaatgtctgttaggtccatttagtctaatgtgtaatttaaatccaatgtttctttgttaattttctgtttagatgacctgtctaatgctgagagtgggctattaacgttcctattactgtgttggagtctatcactccctttagatctaataataattgctttatagatctgggtgttttggtgttgagtgcatatgtatttagaattgttgtatttctaaatatatatgcagctcttgctgagttgatccctttattattacataatgacattctttgtcactttttagtgttttatacttaaggtatgtttcacctgatataagcatagccactcatgctcacttttgatttttgtttgcatggaagttcttttcccatcctttaatttcagttagtatatggctttacaggtgagatgagtatggtaagcagtgtatagtcaggtcatgttttttaacccattcagccagtctgtatttttaagtgaaagttttaatttgtttacattccgggttattattgatatgtgagagcttattcttcttattttattaactgatttctagttgttttgtgtatcctctgttcctttcttactctcttattttttattattgtggttttgtggtttttctgtagtggtaaccttctagtcttttccttctttgtatgtttgctctagtagtttttatatttcatgtgttttaatgatattagatattgttctttcacttttgggtgtaggactcccttggcatttcttatagatctggtctagtggtgataaattccctcagcttttgcttgtctgggaaagacttcatttctctttcattttataaagaataacttttctgggtatggtatccttggttggcagttttttttcctttcagcatcttgaatatatcagcccattctttcctagtctataaggtttctgctgttagtctagtctgacagacgtacctttataagtgacttgatgcttttctcttgcttttttgagttttctctgtgtctttcacctctgatattttgactataatgtgctgagcagaagaactttttgaattgtatctatatggagaactttgagcctcttgtttctggatatctaaagttttttgcaagacttgggaagtttttatctattgttttgttaaataggttttctaactccttcattttctcttcaccttctcagatcctaaattcaaatacttggtcactttatgatgttatataggctttgctcattctttttttatccttttaatttatttttgtctgagttatttcaaaatacctctcttcaagttctgagattcttttgcttcatctagtctgttgttgaaactttagaatgtattttttatttaattcaatgaattcttcagttgtagaatttctgtttggtctctttttttatgacatctatctctttggtaaatttctcatttatttcctgaattgcttttctggtttctttgcattatttttcagtattctgttgtgtcttactgagcttctttaaaatcaatattttgaattcttttttggggggtatttcttaaatttctttttgatgagaatctgttgctggataattatggtgtgcctttggagataccatatttccttattttttcatgcttcttgtgtccttacattgatcatttgtgcatctgatataacagttgctccagttttttgaatttgctttcataggggatgacatttcttgaagatttatctacggtgttggctgggtagggcactttggccttgactctaggtgtgggtggttgtatagtctctgtgtaatttttccagctgtaaacagtgtcagtggtgtctgtgatttcctcagtggtttagggtgtgattattagtggaggttgtggtgaagttttgctgggaactaggacattaggtgggccagtctttgggcctcagtggtggcagcagtgggttgagcattagcctctccaggtgctgggaatatcatggtgggtcaggaggatgggcaggttatcatgcttctgggtagcaggtatgctgtggcaatggcagtagctgtggtgggacaactttctggaacccaagtggtcagtgctggtgttggtgatgtccatgatgaactgggcaagctggtcctcagtcctgcagatggcacatgaaaatgtatagctgcctttttgttggggtggcaaggtcacttccagtggctcctgcctcagcccaacagtggtgtctgtgggtgatgagtgtcagttgggctccagggatatggaggtgcaggggctcttgggcccccaggcagaacacattctggcaggggcggggctttcataatggcacagtgctgcagctgcttaggacttgggggtttgtaggactcagcatgagctccctgtctagaacaatgccattatgtgatctctaggcagttctctgtgagtctcagggcccatgagagtccaggggctctcctatggctagcattgtagaattctgtggcaggaatgtggaccacttggtgtctctcacttaccctttcctcacattaaggagcctctccgggctcccagctgatcccagctaagctggcttccttgcttccctctccttccttgctttcagtgcttcccatcacttctctgttgaattccagtattctctctcagatgatctattcaaaatgtgattatctaattgctattttagctcctctctctggaaaaggtgagtaccagatgcatttagtcagccatcttgaagcttcctgtctacatgcatcctttctctgttggcactactgaaattgggggcaatctttacttattctcctttccttttcccacccccttctctgtctgacacacacacacacacactcactccactcacaaggagttggaagcagttggtaatttttcaactgtcctcctattctataccctctccaccctagaaaaagacttctgaaattcagcaaccatatatttttcagtagctggcaatcattaattcagggttagatccaatgagactacctccagagggcagtgtgacatttacctgcagacctgtggagttaagaaatcagattttacttaaggccacaggccctttaaaactatatccagggacctggcatatggaaatttgcgctgcccattttaacctttttgactccttctggagatatttccgcaaagaggatattaacaggtatgatcaagatgggaaagaaaagagagaaatgtggttgtaaagtgaagcctatctcaacataatctattggataaattgttctggagcagctcatgcttgtggaaacatttcccttgaatgctgccgaggtcagtttctacaccatctttcacagaagtgtcagggtgaggtgggaagccatctccttttgcactggcttttcaaaacctcactattttgtctcagtgaatcagttcagctctcattgccctgatggattcatgtcctttccttgttctttgcccctttttgacacagagcaactccacccccgcccgaatcatttagcaactgtgagtgcccatttgaggcaagtaatgcagccgatgaatgctgagtttgtgtgaattagagaagagagcaacgttgttgaatatgcctgttgaatttgcatgaaaattgattcacccttcttatgggggtataaatcgctggtgaatggaggctgaaacatatgttatcatttcttacagccttgcttgcttgtctcaaaaactgaggcctgtgatgcgaagtgtcttcagcagcagggtaattgctgccgggccacttgctgaggaagtgcttggaactgatttgaaatcacagaaaacagtgagcattctttgtggttaacgatgtgcttcttttaagcacaccccagccaacggcgacaaagaaatgtttggaaagcaaattgaaaggctgtaagggagagatgaagagagtgtgcaaccctgacacagctcagctggtgctttgttaagagatatttataagtcttcagattatgccccccaatttccaggcaacgaagagacttctccaagtgtcgtgctttgtgcattagtaataaggacacatgctccacagtaatgctggaacacaggatgatgctcttcagctgtgtgcttcttcctggcggagcagatgatttcataattagcctgaggaaacaggcagacctaacagccaaggaaacaatgcacctgaattgacaaacgaagttcaaggctttaggcaaccaatggcatatttctagagtgttggaaggagaggcaagagtctacttcaaagaaactgaatggtggtttattgatttttcatttgtaatagagccatattaaaataaagttactggtgaaggggatgaattcattacacattgtcatgtttctggaagtatttgatccatacgtaatacaaaaaaactgcgtatggatgactcacaatgctttttattgtaacttaaaaaaaactggtaaagaacttttaaacaggaaaaacatttctccaggaagcttcttctaaatctatttctttttaacttgttaaatttcagtagaaaaaaaaagctgttcataaggacaccatatagcatatacgcaaaaatgtctgcaaaaataatttcaaatggataatttttattaactgtaagctagggattgtatatctgagtatcatacaaataatgtatagatcagatttaatttattatgaaggtctatcttattcatctaatttagccaaacattgtgagaaaatcttgacgccattctttcttttatgagctaaatattgatttttgcatatttactcgctgcctcttaagagctcatatttcggttgattcccctcaaacctcctactcttccttgcctctcccctcaatgtttcaggtgagaaaactaaaccttaggtaactattaaatggcgtattgggccatacagatcagcagcctggatttattcctctgagtcccagtttggtactcttcttctcctgaaagcaaactgtagcttacataaaaacatatgttaattttcctcctaaatagtgaaagaacatgtataatcagatacattttaaacaaattgataaaatgaaatcatggcatttctcttactgcttttattccactataaatggcacactgacacatttccataatatgatttttatgatttttcattcatcatatgccataccttgtgataagtccttacagtgtgttctcatgcaattctcgtgatagtcctgtgaggtcaatatcttattactctcattttgtaggtgtataaatgtgggccttcatgtcacaaagcatggaaattgtctgtggctgtcatatgactgtttcaggaaagtactcagaatgttggaatgttcatttactgaatattcactgaatgtttattgaacacttcgagatgctggggacacaacattgaatgagataaaaccattggtatcacggagcccgtattgtggtggtgggggtagcattaaacaaataaataagcaagagaaacatcagaaagtactaagtgctaagtgctgtgcagataattaaaacggagtgatgtgataagcagtgtgtctgtgtggctatttgagatcaggatgctgatactcaaaacatgaaagaaaacaagtgtcccaagttttgaaggttgtctttcgacgttaaccatagtgtgtacaattcaaagcattatgtactatgaagaagatgatctggcataggcatcaaagaactcagtagaccttgaatacaggaaactacctacctggggaaaatataattaatgtttttttcaaatgtgtctgaaccgcatgagctctcttttctatttctgtggcattgttacacagatgtttagtaagctcagctagagtctttcaagctttgatctagagacttggtgattttatagaagtttctttcttaatactaggcgttgatgtatttctcttatattctgtattctttctcatcttcaataatattagagagctaaaggcctttgagaagacagatcaacaaaaatgtatgcctgaggaagatttccatctttcatgcaatttttaaactaaaactttgaaatctcaagtttcttaggaaaaactaaatgtctgccttttttttctatgaagtttatacattgaaacctcacttataaaaggaaactcatgacagatgtaaccaggtagacactaggcctcctggtacttggcagacccagatccttttggatagggccaagatgagttcatgctatggcagattgcagtccagtcatgagcaggccaagttaatagagaagtgagaactgggaaagatactttttattcctatgtcaaaatttcaagttcatctgcacattagaatcacttggagatgttttaataattccagtgcccaggcaaccccatcccccaccagtcaaagcacaatccttgggaggtggacacaggcattaatatatttttcaagtttctccattgattccaatgtgggccaagttgagtaactactgaccttatatggttaggttgtttgataggaatcaggcaattcaacctgcagaagcatggaaaattgcagacataggacatggggatacaaagcaagattccatacacagccattcagagtgaccatctgatgttttaaacaagggctagcatgtgcttgcacatttaagattattttttaagataggaaaataagcttggttttcctggcatggaaacccttctgggataagcttaatgagtaagtattttctctaatttatatagtgagggctgggcacagtggctcatgcttataatcctagctactcaggaggttgaggcaggaggatcacttgaagccaggagtttgaggctgtagtgagctatgattgcaccactgcactccagcctgggcaacagagcaagactctgtcccccaaataataataataataatttatggactgacacagcaatcgttgaactgagggtagaggtgtgtttcaaaattttctgaactaggagcctttctttcatcctcatagccctctcccattcctacacaccttttgtcaaccggtaccagctgctgtatttctaagcaacacgaataactgcacacacagagtttaaaatttaacagttgtgtgtggtcacagggcgtcaaagcaatgttatttcatttcattagtaaatgaaagtcctaggtaattctaggcttgtatttaagccaagagaagtattcttctccaaagtcttttattagaattaacagtaacaaaatggaccccctttttattctgaaaaattctccagcgtctttccagttatgtaaatagatatcccttcccttccctttcctctccattctccaaggttactaataagcagtgaaatgccctcaagctatagttgcagaagggaggaggaggaagagtaacagcagtggtggataattagtatcttattagagtatggaaggaacatttgcaagttgatgactgtgtcaatgctgccaaatcttctagaggtaccaggaatgattccatgtgcttggcagatattcaataaatatctgctgagcggtaaagagcaggaaatcttctagacggggtgtgaatcccagcactgcttgctgcttattcattgtgtggcccttggcaaactccttaacctaagtgacagtttctttctgtgaagaagggagatcatatttaatgcatgggcttttgtgaggattaaatgaaataggcatgtaaaattcttaggagagtatgtgacacactgaaaacacttaataaatacaagatataatgaatcaatcgcttagtgtaatgagacgatggtcagaagaccacatgaagacaaatattccagcttttgaacttaggggaaaggtctccactaaatatataggtgggagagattatagtaatttttgaaaaaacttcgaagtcaaacttgaagtaattggtttgtgaacaccttgtaatcattaatgactagagaccagtatggtttcagtacacaaattatacaagactgcattttcttttgcatttgatttgctggacctgtagattagggtattaaatataagtgcatctgagtaatagtaaggtattttgcagggtttctcactatatccttgtagaggatgcactaataaagttgaattagttataatcctaaatattttaaacctatacccaaactcttttttttttttttttttttttttagatggagtttcacttttttgccagactggagtgcagtggcgcgatcttggctcactacaacctccgttccccaggttaaaatgattctcctgcctcagcctccggagtagctaggattacaggcgtgcaccaccatacccggctaatttttgtatttttagtagagatggagtttcaccttgttggccaggctggtctcaaactcctgacctcaagcgatccacctgcctcggcctcccaaagtggtgaaattacaggtgtgagctaccgtgctccaccccaaactcattattaatagactggctacattaggttacataatgaggacttaaaagatagcgatattcttaaataataaaaggaaactaaaagttaaaaattcattgggaatacaagtaaagttcaacaactctgttaaaaaatgatctgtgcatgtacacagtataaaattgtacttaactggaattcataggaaaaagctctacgtattagctatattgtattagctcaatacaatgtggctgccaaacagataaatgcaacattagcctaaaattctactgttcatatcaaaggaagtaatattgacatagcaccctatcttaggctgaccacaccagaggactccttctggaaatagcttttaatggacatatggataaactggagcatatcaaagaattacaaggatggttgaaaccttgggaaatctgagtacctgaggaaaaaaaaacagctggcaatattttgcctggagaaagaacaatgagaaagacatgatcattgtctttggcgttgtagtgtacagtcttgctcaggaaaggtggattagtgcctacttattaagccccagaagaaagaagagaagacccaataaatataatgaaagagtagaagaatttagcttactataaggaatacatttctgacaagcagagatattaaaattgagtagattgccttgtaagattgtgagatcatgagcattgtcactggaagtattaaatactgtgtgatcatttcttaaaacatttttgagacaaattctcctttggtgggagctgggattaggtttccttcagcctgtcttccaacttacgtgtgatgctaaaattactttgcatttacactttcaggttattcaagaaatgaatggaagggaagacattagcaactataaaactgtctatattgctttttcacctgcctcaagaagtttgcctggtctctggatagatatgcattgaatcattatcatcacaatggttatgagattatttcatctcttttcccgttttttttttgttttttttttttgttttgttttgttttgttttgttttgttttttgagacggagtctcgctctgtcgcccaggctgaagtgcagtggcgcgatctcggctcactgcaagctccgcctcccgggttcacgccattctcctgcctcagcctcccaagtagctgggactacaggcgcccgccacgaagcccggctaattttttgtatttttagtagagacggggtttcaccgtgttagccaggatggtcttgatttcctgacctcgtgatccgcccgcctcggcctcccaaagcgctgggattacaggcgtgagccaccgcgcctggccttttctttttttttttttgagacgcagtcttgccctgtcgcccaggctggagtgcagtggcgcgatctcggctcactgcaagctacgcctcctgggttcacgccattctcctgccgcagcctcccgagtagctgggactacaggcgcccgccaccacgcccagctaattttttgtacttttagtagagatagggtttaaccgtgttagccaggatggtctcgatctcctgacctcgtgatccgcccgcctcagcctcccagagggctgggatttacaggcgtgagccacctcgcccggcctcttttcctgtttttaatttcagtatattggttgggctcagtggctcacgcctgtaatcccagcactttgggaggccaaggcaggcagatcgcttgaggtcaggagttccagagttcgagaccagcctggccaacatggtgaaaccctgcctctactaataatacaaaaattagccaggcatggtggcaggcacctgtaatcccagttacttgggaggctgaggcatgagaatcgcttgaacccaggagatggagattgcagggagccaagattgtgccactgaacttcagcctgggtaatggagtgaaactgtgtctctaataataataataataataataataataataataataatttcagtatattttgaattctctatagttgttatgtataagttttgaaatctgaaaaaataattaaaagagggaaaagaatgttttctgactggtatatactcaaaagaaggtggagggcttcaaaagcaaagctgagcgtgaagtttctgaggtcctgagcccctcccctggtggtacattactttgacctaagaacagtctacatgttctctgcctcctggccttccttctgggtaggcatcttaaacttaacctgactaaactccaacctgtttccttcccaggcttccccatctctacaaatggcacttcttgttagctttagctccagtcaaaaattagaagccatccttctttctgctccttccttcacccaatatataaaacccatcgtcaagttctattgactcttcctcgaaactaaatctaacacctgcccacctctctccagtgatactaccactcaagcttgaacctgcaggaccactgccaggctcctgagtgtcttccaactaccattcctattccttcttctcctcattcctcacatggaagccacagaaatacagagatacagatacagatacacattatgccacttgctgcttatagctccctacaatggcatgtaagttatcacagtgtttagggcctcatctgatctctgctgacctcagggacctctttgggcactgtaattcagtcccactggcttttatttgcttcatcccactggataacccaacctcctgtccaggcccttttcaatagctaatctcttcctggaaactactttctccacacattgcatggatggttcctaattgtggtttacttcttagcctaagtatcattgcctcagtggtgacttttctgatcactcaccctgaaatagccttctgatccccctgttatctctgttttatttttctgtaagtatttatctaaaaattgttggatattttattgtttaagtttctttagaaattgtctgtcccccccaactaaactataagttccattgtctactgtccagtatagtcatgtatcctcaaccctacataaggtctgaagaatagtaactcaataaagtatatgctggggaaagaaaggagagggaagaaggaggaaaaaaggaagaatgaaagggagggagggaggaaggaaggaggaaggaaggaaggaaggaaggaaggaaggaaggaaggaaggaaggaagagagggagggaggaaggaaggaggaaggaaggaagagagggagggaggaaggaagagaggaagggagagaggaagaaagggagggaaggataaaggaaagaactagttttaacttcaaaatttattccttgcaaaaaatagacataaccagttaagataattcatttttttttgagacagaatcttgctctgccgcccaggctggactgcagtggatgatctcggctcactgcaacctccacctcccgggttcaagtgattctccagcctcagcctcccgagtagctgggattacaggcgccagccaccacaaccggctaatttttgtatttttagtagagatggggtttcactattttggccaggcttgcctcaaactcctaacctcaggtgatctgcccgccttggcctcccaaagtgctggaattacaggtgcgagccactgcacccagccatcatccaaattttttaaaaattaaggtgatgggataggatgaaggcaaagtagtatcttattcagatggtgtagtctgaaattgttttttccactgaaatatattattccaaataaagagtcaaaattttgattttatgctgtatctttcatgattctataattatagcaaggtattacattatcctacgtgacaactgaaatgagacagttggcatgggagaaaattcaggatgttcatttttagaaggtgacacttaaagaacaaacaggttgctcaggtgggcctctttctcattggaacactagctacagggttcatattttggcattttagtaggtatttaacagatcccttattagacatagacagtttcagctttatctgaagtggtttctaaaaggtaagtgccttctattttgacattccacttaaatttctaagattactgaagaaataacttattaagatcagcttatattgaactctgaagattgtgtttatataatttgtttgtacagctctgtgattttttaggatcaaagattccctttaacacaaaatatttattattatactatcaatattattaaaccaccataacacttattgtagaaattgatattataaacaaatgtttgaagtaacgaggcttttgagatttagaaaaagaaaaactacaagcacctgttgaagaaaatgatgacagatggtaacatttttctcaagaatctccctgcagctgtgcttacattcagttttccaagctcaaccaaggtctattcatatcttttattatacccgtaagagtttttacttcctcctgtgtaacacagcaccagtcaaagattttatttgagagaaaaatagactgacaatgagtgagaaccaatttaacatctgtgtcatcatgcttttaaacaagaggtcatagcaaggtttttttggtatatgttatctcagtttgaaagtgacagcaagtactgaggctatcatgctaaataacagatgtcaacttactatcagcttctaatggcaatttctgttattgttgctacatagcattttgaaacctcaagtatatatttcatacatttttcaaagcacgaagtgttcaaaagaaaaaatatcttgtgacaacatgtttcaggagtaatagtctacggtacaactgaaaactagctttattattggaattgaattattaactcattttcaggtgtaacaagtaatttttatctaaaaatgtataaacaagctaaatacataatcaatataatccacaaaaccaaaaaaatcatacctcagtgatgattcatattgaaactgatctaaatcaaagtgtttgaattagaatatgactgagagccacataaagccatttatatagaataacattacctcaagtatatttcactttgcagatcattaatactgtataaatgtgagaatgacttctgtatatcagcttttatatttacattttaaaaaacatctacttttttccttaaattcttacaaaatttatacagaatcatgattctctgaatcctctctatccttcttacccacataaagtctaattttaatgattcttaattggagtgacttttatcaatattgtatatttatgatatgtgtatatgatatgttaaatacgtatattatacaattacatttttataatgactgtgatatcaggccatgacaacgagagtgcacagtgatcaatatttctatttttatttttcaaatcctggaatataaagcaccataggaagatagctgaggaatggcctttaccatgagtgcataatagagctgcatttgattctatttgctaaataaaatgaggagtgggtgaggatgtcatttggttctaattctaaaggtgaaatcagatgtagtgaaaatgatgtaggaagttttcttaagtatctgttaagtactatacagtatggttttgtgaatgtcaacttctaagtgactttacctgtattcaaactcttaattggtcaatgttttactgtgtctgtttcattctctagtatttttcctagaggatgatagtaacacaataacctatccattgattatccacttgaataacatttatccctttgtcagactgtcaggagacttaaattcatttaacactttttttcagtttaaccaatctgaatctcaagactgatggttttattgctgactgtgctttcagtggcttgctttttttttctccttctatttccctcttttcttttcggcttttcatcctctaggcaagaatagttgaatgctatgaagtttaggatcccaatttttttttgcctttttctcttcttttacttcatttaattgtgcttttaagattggccaatatgccacttctgttgtataatattgacagcattaaggctgtgtttgattacagtccatgtattttcttaatacagacagaagaaataaggtactactggggaatactttggtctcattaagttaaactatttctataccacaaagctgtgaatatcagatgataggttcttgtgttttatcttttattttcaaaattatctccttatttagatttaacagaaagaaaagcaggatgctccttttcaaatatatgcatgtatttcatgagcatcttcaatatgccagtcactttgttaggtactgaggatataaattaacatcagaaaaccttctgaaacatgacttctccctcttagatctatttttttcttatttatttaaaataggtaggggattatctccttgtgtaaaaggatttaaaatagttgttgcatgtataaacccttttttttctgaatactaatgtcggtctcctaagattcatgtgcgtgtaggggctaaaaggtcacaacaacattcccagatttcagtgccagatgtgtctgtatgacagatcatgcagacccaaactcattctagcatctggttaaacacaatccatatccggtcttaaccatgtgtaaatataattaagagcaaatgggaaaataattgtcttcccccctttttttgttccattgacaatgtaaataagtattctaaaggcacaaatttataactgaaatactaagattaacttttgaattctaggcaattatcacatggttgaaaagataaggcaatgcctaaaatagattgcatgctacatgggaatgtaaatagaggaataggaattcagagagggaatgatcacttctggttggaatgatcaaagaaaacttcataggggaaatagaatcatgagccttagcaggaaaaagagattcagtaggtggagttagtggagaagatatcttagttgaatgaagagagtagggggatagggaagaagaatgtgaacaaaagcaaagagctgggaaaaggcagagtaattgaagggagcaattagtacaggtcccgtggtgagattgataataggtaacctggaaagccaggttaggctcaatgtgaggaaacctggactctaaattatagactttgtactatatactgttgaataaaatgcaatgacacactgagggtgatttttcaaggaagactatgacagagtatgtaaacgtggagtgtgggagataggaacagtgaaaatgaaatagaactaaaaggtaggtttgttttcaaaggaagacttgatagaagcaggggctatgtgtggagatgtgagtcacaggaaagaagttaaagaaaactacaggccgggcatggtggcttacacctgtgatcccagaactgtgggaggctgaggcaggcagatcacttgagctcaagagtttgagaccagcctgggcaacgtggtgaaaactcatctctacaagaaataaaattgaacccaggaggatgaggctgcagtgagctgtgattccaccactgtactctagcctggatgacaaagtgagaccctgtctcaaaaaagaaaagaaaaataaagactacagttttgaatttagatagctaggagaatagtagtgtaattaaagaaattcaggaactcaagtaaaatatgaatacaattttggatccattgcatttgaaatgacaataagacttccaagtgaaaaatacttttgaatatgtgatactgaataaaggtgataatttgtaactattggagcagatgagattcccaaatggtgaaatatgaagacagaaatataattttaaggacagaactttgaagtccttagttagagaatgggaggtgaaaatagagtcagggaataacagaaataaactgttcaaggtggacaatcacctgtagggctttccacgtggagaatgtgccttgctttgtttcccggacttgttcctaaacttagggggaagaattcagtcttttatcattaagtatgttagctgtaggttttttataggtgccctttaaagggttgaagaagtgcccttctattgctagtttactgagggattctgcagtgaatgaatgttataaactgtttttttcttcatttattgggttcatcatatggtttttcttttttagacttttgatgtgctaaatcatattgattgattttctaatgttaagacaactctgcatgatcatgctatattattctttttttatgttgctggcttctatttgctaagaaatatttctatttctatttttaaggaaatacccatctaggtccatgagtgttgatggtgtgtagtttttttggtagtgtctttaattttggtaacaaagtaatgctggtataaaaaaaggaattaggaacccaggaggcggaggttgcagtaaactgagatcgcaccaagctgacatcatgccattgcactccagcctgggcaacaagagtgaaactctgtcgcaaaaaaaaaaaaaaaaaaaaaaaaaaaaaaaaaaaaaaagaggaagtgttctgtcctctttcattttccagaagaaattgtgaacagttggtattacctcttccttaaatatttggtaaaattccaagtgaaagcatcttggcctagaattttcttaggaaggtttttacccatgagtagattataaagctattcagagtacctctgtttttctgaatgactttggctggtttttgtcttgtaaggactttgtttctcatctaaaggatccaattatttggcttcaaggtaagcataatattattaaccttttagtgtctgtaggatctattgtgatgtttctccatttcatttacatctattttctatttattccatctttgctttttttaatctttttctgctttcttttacaatcagtatttttattttgattccataaagtagatattttttaggatagaaagaatgaaaatgggagctctcatgcatcataactgaaattctctcaataaactgagatgtgtgatcataagctgagggtggggaaatttcggaatcttgcatagagaaggtttagactatttgttttgggaggtgtcttcagaaaatagcaagagattaacatggatttccagccattagtgagggcccagctgaagtaaacatgttaaataataatattatttggatagctaaggtgtattatagtcaaatctgaagatctgcctccaaaataggacctcaaagttggaaaatatgaaaaaaaaattttttttttgagatggagtttctctcttgtcactcaggctggagtgcaatggcgcaaacttggttcactgcaacctccgcctcccaggttcaagcaattctcctgcctcagctcagcctcccgtgtagttgggattacaggcacctgccaccacgcgcggctagtttttgtatttttagtagagacggggtttcaccatgttggccaggctggtctcaaactcctaacctcaggtgatccaccccccttggcctcctaaattgctgggattacaggcatgagccactgcgcccagcctgtgaaaaaaattatagtggaattaccatggtggttaggttagttcatatttaaattttatttcaaataagatccaaccatattttccttcagtaaggttgaagatatgagcttcttttagacaactgcttcttttttccgggagttcagaactttgaaataattggcagctgtcttttctaaatattaagcactcacttggttacatagggcagatggcgcaaggggtcatcaacataagttgagtgaagtttctctcattttctaataactaagttatctgaaaagccagaaaaaggtggaatagctggaaggagttggtattgttgagtggaaatagaatgagtggaaaattggcaaaccagctggatattttgtggaaataatggttttggaaacatatttgcaagactcggataattattctactctttgaactgattacagtttgtattgtattgcaaaaactgcttggatcatgtaatgaaatatgagttcagtgaaaaggcacagttaactgatctaaatctctcattgtctacagacattgttatttcatttacatattgaaaatctatgtgatgaaaaatgggaaaatcacagactcacaggagtatttcatttaaattgctttcacaattgcaacccagttctcaaaataagaattttgacaaacctcaactttggcagaagaaaagtaacattttatgtgaaaaactgacatagctaatttctggagacagaaaaaaataaacaaaaataagcgtacccatcctatcccagcagtggccactacactgtagaagagtgaaaaaggatccagactctggggccagagtgccaaggtttgaatcctgcctttcggtttactagctgtaaatcctgggcaagtcgcttagcctctttgttctttgatgtcttcatctgtaaaatggaaaaatagttttatctgatagatgtgatttgaagattagtttagttaatacatgtaacaggtgtaaacagggcctggtgcatataagaagctgtagttggccgggcgcggtggctcacgcctgtaatcccagcactttgggaggccgaggcgggcggatcacgaggtcaggagatcgagaccatcctggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaagaagctgtagttattgttaccattgtcaagaaaggtgagttagactctgcattgccaacaatttggggttttaacatactaaagaaaatctagatgtggtaccctggatgggaaacatatgcacacttataattaccatacaaagatgcttggaataaaaatgccaaatgccatctatttgagtatgacttttatagacaatgggaggttttatcttatatattacattttctcagtcaaacatagctataaattcttcaaatacaattttactgttagcaaaagtaattataattatgtttcagcatgtatattctaaatcaactgtacaacttctcaaaaataaaatatcatcaggtactgaaaaaccagaaaggcagtaattaaggcaaattttgtgtcttttataagtgacaaaaattaatactttgatttggatgactcaacagagtaggcgaatggtaaaaggcataagaagatattttggggataaaaccaaactatggtgcaaaaaagaaaatatgtatcgaatgggcgctaaccatgtaggcagttatgaccccgcccaaaccatctcatttgtttatttttcaaaatctataaaataggtatgtattatccccattttagtaatgttaaaacttaagctttcagagttttacttcaacaattcttcaaggctgtttaggagtacagctgggagtcacatcctagtcattttcttccaaagcccatgttctctccactgcactggtctgcctcccagaagtgataggtacactggctgggcgcggtggctcacacctgtaatcccagcactttgggaggccgagatgggcagatcacgaggtcaggagatcgagaccatcctggctaacatggtgaaaccccatctctactaaaaatgcattagccaggcgtggcggtgggcacctgtggtcccaggtactcgggaggctgaggcaggagaatggcgtgaaccctgggaggtggagcttgtagtgagcagaggtcatgccattgcactccagcctgggcgacagagccagattccgtctcaaaaagaagtgataggtacaccgttgaacaaatttagtacaaaaattatggctaatcccccaaaacaaaacttccctagtttttcaatatcgtgtaattcaactagttttgtttctttgcatatttcccattgcattttattttaataaggatatgccattaaaagtcatattgaaacaacctataatccgcacttgcccacggatctctttgcttttatgaatggtgaagtggggctccaccaggagttgtaatggaaagagtgatgaccttagggctgattctggctttgctgctaactagttatcaaactttttttgtataaatgcaaactttgcggtaagacatttcatagtgctatagtccctcttttaatttttccaaggaaggaaaggcacacaatggtatcaaatgttcattcattccatctcttgatgctctacgatattatcagtctacactatgctttcctgaaaggccagaagttcaaagatggactagtttcccagggacctgattccccagttggaatactccagccccttggaaattcccgggatttataaaataactctagacaacaagactttgtctttaaaggtcctatgaattcttttctctctgtatttaggtatcctgatttttcttttccatattttccacaggattattttacaaatgcaaatagagagttgaaaaaagatgctcagcaagattaccatctagaatatgccatggaaaatagcacacacacaataattgaatttaccagagagctgcatacatgtgacataaatgacaagagtataacggtaaggcatctatgagtgaatgcatgcatgaacaaattgtatatttacacttgtgaagcactttaaagaataagagaaacaagtcatatagtcttttttctaatatttttgaaatcttttttgattttttttagttttttttttagttttttcttttttacttttttagaagccaaaaatgtgtaagaccaaaaatttcaataaaatccatttttgtgtgagtttaacattttgaagatccctttaaaatttgtatgatttagccataaatacattttactttcttctccataaagtttgaaaatacacaacagataaatgtttgaagaaatgtattacacaagaaagaattatgaatctgaatattaggatataattcatctgatttgtaatggactcatctttgtaaatttctaaaatcaagatgaataggtggctgattataattgcctattggtatattaaatgagatttcttattttcagacttcatgcaaaaattaatatctttatgtgcattcaaattaaatatttagaagatatgtaatacttcagaaatttccatgaattgtttggattaattttattttgtgtagaccaatacgattacctttttattttgtaaatcaaagcttcaaaaatgggaatgtaaaaaatatgaagcagttctgattaacattcagcataaagagtgaacgaggcagaaaaaatgcatgcaaagagagggattactttttaatgcaatatacagtgcaattatactttaattggaataataattatagtcatttgacttattaagaaagaatatagcaaagagaacatttaaaatacttttgcgttattatttattttcaaagttcttattacaaagatctggcaaaaacacctttatctgtgagaggattgaacaatttctttacaccccagcaaaccctccccaacccatagccctttgggcaatctctcctggttgctcaatggaaaccgatttcatctgacagtactttccatagttgtggtaaaccagtccctaggaaattcccaggattcataaaatgactgtagattaactgtagtatgatttaaaaactcagaatcagaaatccttctatatttatattttctgtaaatgtatacgtgtgactaggctagtgcctaggaaaacatctactgtaaaaggaaaagtattaggtaattttaatttttattgtattaatttttccctaaaatcttccatggcatttaattttccaaagtctctgctgctgaacaagaatatttgtttagaagctaccagttgcaaggttaaagttttggcgtgacaatgatttattgttgtcatatacttcaaagtgtaattactgagtcaattgtccttcagtatgttttggaacacataatcttgcatgctgagagatgattccttccaaaaagtaactcatatatttggatccttaatgacttaatcaaatttgtgcaattaatattagagaccatgttgataactccaaatgtcattattgtcttttcttcacttctatatcttgtttacaatagagttctttaaactcaactcagtggtaaggaaagtgctctcatgagacctaatcatgcccatgtctgatccccaggatagcactgtgagagtgatctgggcctaccaccatgaagatgcaggagaagctggtcccaagtaccatgactccaataggggcaccaagagtttgcggttattgaatcctgagaaaactagtgtgctatctacagccttaccatactttgatctggtaaatcaggacgtaagtgttttcaggttttatgattgtagggatgggcttattgaaagtgtatacgagcatttttgcttacattattgtattcaggagcatgttaagagaaggtgactttgtgtcttcctcccctttttattaagacaggtccccatcccaaacaaagatacaacatattggtgccaaatgtttaagattcctgtgttccaagaaaagcatcatgtaataaaggtatgtgactcattcataggctaaaattaattttcatgagtggaaaaataaattgatgttaatataatgaaaacagtaaaagtatagaaatgtttttcaattatttgaaagttttttagagaaaaaagaactggcttggctgacctgcatactttttcaagagtctgaaagcttggattatatctaatattttggttatctcctaattttacatgtcaaaggtacaagttttggtatgcacatgaacaccgctaattattattttaggcaacatttctacaattggaattactggaattgcaatttaaaatagtatgtttacgtattgataaattatacccatgaaggttacattcctcaccaatagtgtttgagaacatctgcttcattgaaaacactggatattgtcataaaaaaacagttataataattttttgaaaatagaaaaaagaaaattagtgaatttctacagaaataaagaaatacagaattgggtagtaaataaacccaatttgcctgtgcaatacaattattttccacccttctggaatgggcctcccagaacttttgcatctacttagcgaatgaacaaatatttttaaaaagttacaagtccttggctccgtgctagtaattgttaattccacagaggccaaaggtatgatccatgctctcaaagaacttacagtgagattggggagacatggccaagacacaagaaagaataagatagaattaaatagtgcatacagaatactgtaaacattcagaaggccagatgttgctgcctttctgtcagttcccagactatgtaatgaagcgatgtggataaggaatgaattgccagactctggaatctagagggaaatacatgggtttgagaatcataagtccaccctttaattaaactatgtgctctcaggtaagtcactctggggtaatgctgtagccttaggttttctcatctgtaaaagatggacagccataacacttttcctatcaacctcaagacattttagcagagatagaaacactgagcacattctataagtttattcgtggctaaaatttgttaatttctaatatatttccctagttttcttttgtttacaaatatttttgtttacagttctgcctttggtttacaaaatgattcataactacatacagaggcaaagggagtggctttagggaatgttattgagttaatatgtagtcctaaatatttataggttatttttgcaaacaggagactgtgactgcaggtgaatcatttacctctgtgcaataagttattttctactttgtgtatggaaaaggggaatgcaaattctaattttgtataattaataccatgcccaagtccttcccttgtaccaatgaaaagtattcctcaggaaagagaatgtttcatttatatgtactgtatgtcatttgcagtaaatttaactggaaccaggcttaagaggcaaatgtaaaactgtagattcagaaatagaaacaaatgtttcaaacaaccggtcctttatccactttctggcaaacattaattgtaaatttcttaaccacttactgtgaatgcatttttattcttgccattgttaatgctaataattgagttgaatgaaataaaataattatgtatgtttcagggaggtcagtgtatgtttcaaccctctatgtaggatatttgcttggtacctcatctttcttcactaactttcctatatgaagcatattaaatgatactcagataaactttcctataagaagcgtatcaagtaattctcagacacatgaacttagaattaagtacttttgggaatacatagctgtcttcactagacatttgcattaacatgaaaggcattggagcattttttgcaatgtttggaggtcttctagacaacaaaagttatttaccttgagcaaaagggatttgagggaaggacagtaggtcataagggagtgctcatacaaacttttgttgttacaggggacagaggtttggtggctagaatttaaaatcctattattatgtgagaataccacttataggatagattccttatcttgctaaaccttaaaatattttaaagtttattaagtattatgaaacattttccttgaaaattaactaaaataggatattattcaaaaaataaagaaaactctactgaaaaaataaattcaaaatatttagtaatatgtaagtggttttaaggcagcctttcaaaaccagttttcatttgcaacttattcaagatttcaacaaaattttaatgatgtagaattcataaatctaggacttgccttaagttgtctgatttccatgctcttttttctagtagagaggatttctaataatttaagaaaagtgtatattctttccataaaatcaaagactcctatgttttgaaaagccatcagttaagagcttctccttatttttcattttatgttccataaatcactgtatcaaaaagcctcagtccttttcttctgcaaacaaaaagtactttcacagaaatgagaagattgattttatatcatattgtgtggtgtgtcatttgcagtgagttttaagaatatcgatcacagttgaattgtgagaagtcagtttcattttctggtgtctaattcgcacaaagaatttgtttgtatttgcagtttaaatgttgatagtgcctagacccacttatctgtggttccatgggttaagttgcccatggtcaactgtgatctgaaaatattaaatggaagattccagaaataaacaattcataaattttaagttgcatgccattttgagtagcttgatgaaatcttgcactgtcctgcttcattccagctgggacgtgaatcattcctttgtccagcatattcacactggaaacgctgcccatccgttagtcacttagtagccatctcagttattagacttactcttgcagttatcagattgtcatggtatcagagttcttgtgttgaagtcacccttattttctttaacaatgcaccccaaagcacaagagtaatgatgctagctagcaattcagatatgcccgggagaagccatcaagtgcttctgtaagtgaaaaggagaaagctctcaacttcataaaaaaaaaatgataaggttgttaagacctatgctaagaatgaatcttctctctgtgaaattgtgaagaaggaaaaagaaattcatgccaattttgctgtctcacttcagactgcaaaagttatggccacagtgcatgataagtgcttagttgaaatggaaaaggcattaaatctgtgggtagaagacatgaacagaaacgttttccgattgacagcaacgtgccgcactagaaagcattgagcctatacaaagacttcaacaagggattgcctgaaatgagtgacaccaagccatttactgcaagtggggaatagttgcagagattcaggaatatagattctgatcagtagtagcctaatactatgtcacaatacctacgttattcattatgctccatctcattatgtagggattgtatcatctcgcatcacaggaagggtgagtacagtatgataagatattttgagagagagagagaccacattcacgtaactttaattacagcatattgttataattgttttgctttattattagttattgttattaagctcttacaagaaagtatttggaaatctcctaatttataaattaagctttaatgcatgtataggaagaagcatagtatgtgtagagtttgtagtttctgccatccactggggattttgcaatgttttcccctcagatgagggaagactactgcatacatttcatacttataataactataagactaagcaaagaaaatatatcagtagtttgataagaatgactaaatttaaaaatatttattacatttaaaatttaaattttaaccatgtaaaaattatttgcttctaaaattataaaataaggtaaataatctctaaaatgactaaaatataaaataaacataaatgattttatctctagaaaagataggattataatacaattattggctgttgaaactcgtttgtgatctcaatttattgatttgtattttgattcttaacaaaatgttgaaaattgtggcttgaaaatgtgggtattatcagatgacagcatatcacattgcaggtgaatatggaaattgtagaaaagaatattcttggtaatttatatttaaactgtacttctcatgtgaggtcatctctttgtcaggtactcgagaccactctgcagcccacctctccatatttcagcatgactctttttaagctttattttagatgtgactttaccgtaaatttaaaattttttaaagacggttgattctaccactctctttagtcaacagtaatggcattgccatgactattagtcgtggttggatatactttgctagaaatgggggttattgaattggcttaacacgctgctttttttgaggtgcttttattgtcctggaattctcatagatgaactacactcctaatatatctgtttaaatgtgatgtgtctcattccatttaatagaaaatttgctgatggcctattatggcaaaggggagaaaaaaagaaaaacagccagccaaaatcatcatcccttagtcctctctccttaaaggactagctccctaaatagggaggcagtacacctcatactacggtaggtgggttccgtgactggatggatagttcaggtttgaattccttctttccatttattagtcatgtaacttacagaaaagttgttagccacacacagttcagtattttcatttaaatggaaatggtgcctcctaatggaattgcttacattaaggatcaaacaggagttgttgttttttaagcacttagcacagtatctgacacttacaaaactattaataaactcaactattatgatcaggcaactatttattttcaatgttgctccctgaatgacttttcattgaaaactcccatttagtgagaaggcccggaaaaggatgcagtatcaggcttaaaggctgaccattgctgggttttaagagaggattatacttactagttgtgtgaccttaggcaaatcaatttacctctctgtgcctcagtttcctcctctggaaaatggtgataataatagttcttacctaacaagattgctatgagtattaagtgaatcaaatgagtttaatatttataaagtatttataacagtgctgggaacataatttctgttaaacaaggtaagtaaattcaataaaattttgtagatcactagcaacactcaattgctaatctgttgatcatcttgttaggtttctggattacagagggatcccaaacaagtcaaccctttctaggcagtcagagttccaaagaaaacctagtttgtccatcacttcatttagggaggtcaccttgaaaattttcagctttggagaaatgtgaagttgaggtaaaacactgtcatcatcctcttcatcatcaattgctacaggaagagaaatgctatgctttattacttgatactgaacagaacatcttttttctcccatgaaatatccatgcttctgttctcttctattggtagcactcataaatctcaatgatttcatttggggagtgtttcctagaacatgaaaatttaagaataattgacattgaatagccatggaatgtccttgaagccagattactgtagagccatgaaatagccactcgaaaattgattttcctatagtaggcacctaacatgaacgttaggcttaatacaacatgtcaaatggacattgctgcctgtttttctactgtgctcacttaaaaagacacagtcaaatggaaaaccttatcattaacacgtttctgaaatgttaagtgcgatagagggtttctattttctgagaatgtgtaagtctttggggttaaatttagtaaactgtgggaatttaagcattctcaatgtcaaactacatgcttttatggctgtcagaattagctcttctctgacagtatatctctttccttctttcctgaaataatatttcaagacatattttaattgatgcagtttttcccccgatggaaacagcattttggtttgttgtcagcctgcatttgcacagactgccccgtctagttctcattgtttttttatgtgttcaccttctgtttcactttttcatatgggagactaggtgtttgctgttaactactgacttaatggttatttgtgtttttaacccatatccattccaactctagaattttttcttcttacttattgatgtttcccttctatcttttcttatttaactctatttattttctaaaggcaaatctttggatttttagctagattcatgttgaaataaattaactttcataatctatcttacgtgaaaatactttccatttctcttaaatattttgcaacactctatttggttattaaattattaacaccaatggattacccctgcacctctgggttttgtcatcaattgataaaatagatgattcttgatcttctagagaaaaagttatgctataaaaatcaagaatcttttcctttaataatttgtgttacaatgtttatggatgccaaaaattattcctcatttctaagtgtattgtaagttttatctattttttatctactagacaagagatgaaaatactggggcatttactgtggctgaaactgtaactttgtacagaaaaaaagttggtaggaacacttcccctaaaagtaatgatttgactcaaattagtgcatttgaaagactgctgacttagattgttcaatgttgtaaagttcattcaagatcctcttgagttacatctacttcatggaaacactggagatcgtctagctacatgggtgttcttattagtcacttgagagtacaaggtaattaaatttgctttgaaagcatgtcttttcatggaagtgatttattgctaactctgtcactaattagctttctgaccctagagaaagtacttaaccttgcctggtcctcaaattccttgtctgtaagataaagggattggaccagatgacctcaataggctctttctacttctaaatatctgtgatttgacgaaaacaaaaagaaaagtctgtgctggggtttggctgctgctctgtggtctgagttcctgacatgcatgcttttcagtcacagggcatgctgaggtgaaaatactgagtacgccactgcctcccttgaagttaaaaggcccctttctttagcacctcgagcatggacttggaggataagtttggaggcatcttagtcctttctagagcatgccaaagtgccccagaatccccaggagaatccagaatgtctagagacatgtgtggctgcttggtctgttgacagaaatacttgattttttaaaaagaggctcatagactttcttatttctgggctatacaacactcacttttttatctttaaattcccatgcacttaactaaacttgttactgatattatttaatggctattaagttttgggaacagctggttctaaacacagaaaggctgcaaatgtaaagtattcacaacaaatcaaattctgaaaccacaaatctttataatatccgtattatctagtggttgtaccatggcctacagggtcagagcaactggtttgaatcttggctcctcagcctactagtgtggaatccagggcaagcaatttaacttccttgagccttaggttccgtctgtacatagggctgataaccgtatttgcctcgtatgttagctgtcatcaaatgaaggcagtatctgtagagtgcttatatgtttggcaatgtattagatagctcaataagtactggctatattcccaatttgcttcagttttcagatacctcttaagtcacagagataatgtcattttaaaataaagataaaaattaggagtgccagggtgagcaagactttactgagataagttggtgcagtgtacaagaattggctctggaggtagttagcagttgtgttcaaactctctttctcattcactggataaccttgggaagactaaatgctcatagcttgcatcttgacttgcaaagtgaggaaaataattttcagcaaagatgaaatgaaaacaagtgaaaacacctgttgcataataggctcgtcattgcttgttttcttcccttgaagggaattatagagatgaatgactaaaacttcatctagtgttttctcattcttggagtcagggctgcactgaaacaatggtaggcagtaagtctctattttattttgaagaaaagattccctgggaattagatttcatagcttgcttccattactctaacccaaatgaaatttaagctaatttcctcctgttcttgtctaagtaaggataaaaaccaactggtgactatcctctgggaaataatctttgacattcttaagtcacccattagtcttccattctatggccttaaaataatgccattttcaactgacatgaaacaatttttttttattttttaatttttcttctaccaaccaagtctactccaaccttgtatatctttttcaggtagtacaaaagtttagatgagaaaattgaatagcactagcacatttcttggtaattattcattataaaaattagtaaataatttaattaacagcactttattgaaagaatactaagatatttatgttgaattctagatgttgatagcacaatgggattaagaggtgtggtaacattaaattatgaatgacttttacttacatgcaaggaagtatgtaggtaaaatactttcttgtttttttgatactttaaatacattatttcactaggttttcacagcctcccacaaagtaagttgaataaccaccactttccatatgaacacactgagacacagcaagcttatgtagcttgctcaacattacacaaattaggtgaagtagagccaagacttgaatgcagatcttctgagcaatactaatggggctttttccatacaattttgctagccttctacttctaaatatctatccaggccttattatttttttcaagatgcataagttacaatgaaaaataatttgcgtggaagaagtctgatagcttatatccagccatgagttctttaagtaaacttgtcagaacctgagctactttttattttttgacagctttgttgaggtataacagatatacaaagaactgcacagttatagtgtgtaccatttgatgagcttggaaatatgcagacacttatagtgacatcaccaaccaaggtaatagacatattcatcacctcccttgtttccttgagtctctttggttttttttttttgttttttattgtggtaagaacatttgacatgagatctacactcaacaaatttggaagtgcaaaatactatattctgctggactacttttgagtcctacggaattaatgcatagacacaggacacaggactgtgtgagcagaccccaccagaatcttccagagacatcagtccagagatcctggaaagtgacttagatctagtcacatatgagtacacagagactgggtgatttcacccttggggattacaaatgctcattaacaatggatgacacatacgaagtttcatttgtgatttaggaagtctttaaagtaagattagagtaagatgattaggctaaagattatggctgcaaaaaggcttcatgttaaatcttggagatgatattagggagaaaggaattggaaataatttccgtggaaagaagttagtgagactgctaatcttattggacacgtcttgtagcataaagattgctggaagcaagccaaaagctttctgtttaagctgagctaagatcttctttggagttaagtgaaattaatggtaatggactgtttgattcccctttgctataacgatctgtaaaaagctactcatgagaagaaatactaacatttttcacttggcagttaaatttatgacaaaatacctaaagtgctctaaaacacgaagagatatatgttgttggagagaaaactagaagtgttggcatctcagaaaagacctaagaaccagactgacagtctgggttctaatcttactttaacctttggtcagctgaaaattaatgtgactgcaccacaatgcctctcaagagaccaaattcatgttaataacaactcaaagactataaatctgtataactgagaagttgttctaagtgatctttaacccttaaaattctgtgacttctttcattgtattattggaattgacaaagttggaaatttatagaataagtgtataaatatatacgaataaaattataataaaagattttcttaaaattttgaaaggaattcagataatttttgtgtgttgccataggatatcacaggtcaattttatttttttgttttctattttcaatggaaacaattgtatacttatcaaaacaggaagatatctgttgccctatgatacaacaatgaaatttttaatagtttttataaatggagcttttagtgattagcaggaaaaattatatgtggaaactcacttttgataagtgagatattttatattcaagtttataaaactcataaatcagaggatactttttcacacctttactgagttatcaataccttctttaaggtatcaagactttctttgggtcatttaacatgaatgtatttgtgcatcaaaaattcagattatatataagagcttaatagtatatctcttttatgaagaaaaatactacactaacatatcaaaaatgttatagttgagatttgcttcattgagctattattgtatttttcttgattcataacctagggtgcatgttagaatcagaatctttagggagggagtccaggcttttgtgatgatagtggttgttgctgtgttttgggaaaagttccccaagtgactctgatataaaccctctgtttgaaaataactgttttatatatattaaaatttcccaggagattgcatttgtcaagttacattttatggcacctagtaaaatgcccttcatattaagtagcagtaatacatcttattatagtaataaagtattttattcaacaaatattgtaaagggtgaacacatattgaatgtctatcgaaatatactatgttagttgcatgcacatgaagaagagttaagcagtttatggttttgagatagtttattccttgatgcattgcttgctgtttttttttttttggtgaaaatggagaggcaaaaacaccagctgtttcctgtaaccacagctgagttttatgaactaattcagatagaaggggtaatttcttctaagacagaaaaaagatttatgctctagtgaaatatatacatggaggttaatgctatacattcatgtttataatgtaatgggtccattttaggaaccatacactgaaaaccacctcactgactttaaaatgcatctcattaccaataaagagagatctttgcaccactgaaatctcactgaattgctctgtgtggaattataaaaattagtgaaggcaagaccatgtaagtaactgttaataatgctcccatagcctcttggtctttagcttgtcctgaggaaatgttgaaaatataggagagacactttggtttatggtatgtttcagaaatcagatgtatactcgatatgcccactatatattttaatcagctggaaacattccttcacactacacctgtaaatcgtgaggaagaatcagagtatctagtgagtgtctgctttggacagcattcagtgctatgtcttgtatatagagcaatataacacgtagtttttcagcccaaagacctcacagtctggatgggaggaagagatgtacacataaatattagagagcccccaaagctgccgaatgaacattcatgtcaagctatgtgatagtggcagtaaaggagaagaagaaaggagaaagcagtgattgtttgggcacagtcccatgccatatggaaagaataatttggggaaagcacagagtagatgaattttaggtaggtggaagtagtggtgtggtgagcatgactgcagaggcataaacagaggcaacctctgttgatgtgcttaagcatcaagataaaattagatgataagaaccaacatttattgagagaactgtccaatttggggattgtcagtcctcataaacaacctatgatgtaggcagtgttactatcttcattttacagatgaggaaactgacgcccagaaaggttaagtaatttgcccattgctggggaagatgatctatttaaaaagtaaacagacataaacacttttgctggtttagcctccaaacgtgactgttaggtctacagaaaacagcattcattgactaaaaaaataggacgctgacttcaacattaacattctgaagtattacacattggtccctgaggaagctccacttggtcccacatgtggcaaagaatacttgatacaaccaacatctgcccatactaaagccagctaacagctgctggctaaactttaaacccatagtctaatacatcaaattagaatgcagaatccctgcagttacttgttgtcaggataaatggattttttgatcagagaataccttaaccataccaaagtccccattttgtaatattgaagggaggactgaagtctgaggcctttaatacctaaatggggtcactaattttatcttgagtattactcctgtgtggctttaacaaattttatttattgttaaaactctgggccgggcgcggtggctcacgcctgtaatcccagcactttgggaggcagaggcgggcggattatgaggtcaggagatggagaccatcctggctaacacagtgaaaccccgcctctactaaaaatacaaaaaattagccgggcttcgtggcgggcgcctgtagtcccagctactcgggaggctgaggcaggagaatggtgtgaacccgggaggcggagcttgcagtgagccgagatcgcgccactgcactccagcctgggcgacagagcgagactccgtctcaaaaaaaaaaaaaaaagaaaaagaaaaaaaaaactctggcaatttgtatcatattctctaaaatagaaataaaaccagcctcttaattgcacacatgtgcatgtaaccatttagttctttaaagtgaagctaggcagatgcagtggctttcacctgtcatcccagcatcttgggaggagaattcgagaccaccctgggtaatggagggagttcttgtctctaaagaaaaatttaaaaaatttagctggtaccagctagttgggaggccgaaatgagaggatcacttgagcccaggagtttggggctgcagtgagccgttttctcaccactgcactccagtctgggagacagagcaagatcctgcctcagaaaaaaaaaaaaaaggaaagctgcaggcagttcctaagaggacgatggcctttcagttcttgtggaaatgacaaggtcttccctagagccagtgacttcacagtggagtttgttagagccatgtccatttccatcgctaatgtcagctgtgttttcttaataatttaaatgtatgtgatatatgtgggtttttttatagaaaaggtttgtctcattttgctttctattttactgaagcatgggcctaaagaaagttctcaaggaattatttatttatttaccaagctttgaaaaaatactgctttaaggtcatcctccaaagatgtatgtttgtttctcttagtcatcacaatcttccatagtctttataaaattacctttattaataaaattgggtattttctccataatagctgattttagcctcataccttcaatgtaaaattggtcctttaggatggaaactaaacacagggtttttgaatatgcccctttacttttcccttaacttttatgattttggtgttagtatatacccatatataacataaaaataacaattcatatcttctcaagattactttgaaaatgcttttaaaatattgaattttagaagacaagtatttatggattgctcatcatgtaccaaacactgtgctttacttactacctctgccattttctagatgagaaaacaggctcagaaaaatgtaatgtcatctctaatgtcatggagcgagatgtggtaaacatagagtgggaacctagccttgtttaattctaatgcctgagatctgaattactgtgttgaactcttttcagtgcaaatgtgctacacacataggtgttattagtacgtgtattatgaacaccatttatttagtctagtagggggagctttaacactttatttaacctatatgaacctaagcttgaagggcccttcctgtctttctggtcacatagacctgatttcaaatccgggctctaccatttaccacttatatgaccttgagtaatttacagaacttttctgaatccgttttcccattggcaaaatggagatatgacctatcacaatactactgtaaagttatttggaaaatgtttatggaacacctgaggcacaatagatgtgaaatattgtcattttatagtaatccttctttcctctaacagtctaaaccttctgtttgcttttgtcaacattttatttcatggttgcagaaaatgaagtccagaggaaaaaactgcctttctcatccagttaattaattgaaattgagattgaaatttaggtcataaatttttattacttatctctatctctccttcaaaatatgaaatataaaacaatttcaaagcaaaaaatacacctaagatttatatctccattttatcatctcttaactatctataattaaataatttttaaagcttttcaaaaagctctaaattacttggatattattatccagtaatttagaacagctggacactcactttgatttcattgacttttctgagacatttaaaagagggaaaaattgaaatatttatatttaactagatttttatatggtatattagttcctttataacttggaattcattacttttactatctttcctttttatttctatacttccttttaagataaagtttagttcctttaagaactggactgccagatgaacctgatttgtttagtaaggcaaactcttattgtaagtgtttgtaagattcacagttgaattacatttacaaggttagagaactaagttcttttttcagtggtaaacaggaaatgtcagtactctgagtaatattttccactcatatagcaaatagaattttccaaaagattgttagttcagtcacatttttttcaaactatatttactccaagtgctaagagatattttatgggataatttatttcttcttcagcttgaattaataatcagataaaattcatatgtgatatgatgtgcttctggactggcttttaacaatcttgcaaagaggtcacaactgttgagtttttatctctcatcatttgaaagattaaggagtttttttctctagagaacactttattttctaatatgagaatattttctaacgtgtatttgtttcatttccagtgtaatatatacttctcataataagtaaaaaagtaaaaaatatataaaataaaaagtagtagtgccctctttctccaaattctactttcctgaggtgactaatgctaacagatttatttgtatttttctaaaactttatgctgaagaaaacatttacaacatttatataggatttttttgggttaatctcttttatttgtaaacaaattaggatcactctatatctattactttgaattttgcttttcaaattaatgccctcatcattactggacaaaatattataacacattatttttaatgtttacataatttaatctcctattatgtataaaccataatttttgcagccatacacttttgatgcacattcaagatgttgtaagctttttgctaccataaacattgcttcagtaaatgttcttgtaagtatatcgttatgtattggtggtttcattcctatacgctagattgctaaatggattgaatcaagattacatgtatttcaaactttaatatatttgtcagattactttataaaattcacacactagctgtatgtgaatattttctcatcccttcttgagcactggatattttagtcttttaaatttattgcctgttaatggatgaaaactaatatttctgattgctttggcttgctttccttagactactagtgaggcttatgctctttttatgctctcttctgtcagtttgctgttcaaccctttaccgatttctttttaaaacattcttttattgaattgcctagataaaagtgcacaaacagtataaaactcattgaattttcataaggtgaactgactcatgaaaccagaatcaagatcaagaatagagtatcaactcagaagcgtcctttgcgtcccctcccaggtactgtctgtccccagaggtcaccagtttgctgacttaaatcactctttactaattttgcctgttgtgaattttttgtaggtagacagaaacgctagtgctcttctgtgtctggctttttttgccgaacgggatgtgcaagttggccatgttgtttgtagaaaataatgtgttcattttcatctttgaatttcattttctgaacataccagaattttttattcatttttattggttagctatttctgtgaaccaaaccaacccaaagttcaacaactttaaataagctttaaatgaagaagcacatgttatagtttacaagtcagcttggtggttcttctgtttgtagctgggctacaaacaggtatgtaaccagcttgggttgggtatgcagctttctaatagtgcctgggctctctcttcttgttgggagtcagctggttgtaagcaggtctaggaggcctcagctgaacaagtgggctctcctttatagtatcttgttctctagaagtctagactgggcttgttcaaatggtgatggcacagttccaaaagagagagtagaaactgtaaggccacttgaggcttggtttgggattagcacgccattgctcctgccataagaagcaggcccagcctacataccggagaatggtgatagactccaacccctgaaggtctagtttgtgggagaactttctgaccttacctggagttgagtcaatttagagagctgagcaaaatacagggatagaggaagcagtgggaaaggacctgggagctcactgggtccctaagcatgccatccctgcttggtaccacagggatcttttgggagggtgaccagaggcacagggtaaaatgccacagggagaaggaagtccccagctgaactttgtaacaatttgaatccagcaagaagcctcctggccagaacctggggaagggcacgaatctggtgtgcagactccacgggtgagggaagaaccaaatcctttttcttctgcacctgggaagtggctagtctggggcaagttctcaagccgtgctcatctactgcctggaaacaggatgttgggggaggggcatgatgggagggagaccagcccttcagattgtgtgggagctgagtgaggcctgtgactgttggttttcccctacttccctggcaacctgcatgactcagcagaagcagccatgatcctcctaggtagatgactccattgacctgggaacctcacccccattccccacagcagctgcagcaagacccttccaaggagagtctgagctcagacacacctagccctgcccccacctgatgggccttccctacccaccctggtagctgaagacaaacgctatatactcttgggagttctagggccccgcccaccaccacttcctcttcgtaccaccacagctgatgctctctggaaagtgccacctcctggcaggacgccaaccagcacaaaaatagaactttaaatcaccaaaggtaagaaccctcacagagcccatttcatctccctgccacctccactggaacaggtgctggtatcaatggctgagaggcccatagacagttcacatcacagggctctgtgcagacaaaccccagtaccagcctggagcctggtagacttgctgggtggctacacccagaagagatataacaatcactgcagcttatctcacaggaagccacatccatagaaaaaaggggagagtactatattaagggaacatcccctgggacaaaataatctgaacagtagccttcacccgtagacttttcctctgacagagcctacccaaatgagaaggaaccagaaaaccaactctggtgatatgacaaaacaaggctctttaacacccccaaaaaatcacactagctcaccagcaatcgatccaaaccaagaagaaatccctgattaacctgaagaagaattcaggaggttacttattaagctaatcagggagacaccagcgaaaggcaagaaaatccaaaaaacaatacaagaagtgaaggaagaaatatttaaggaaatagattgttaaagaacaaacaatcaaaacttcaggaaaccttggacactcttatagaaatgcaaaatgttctggaaagtctcagcaatagaattgaacaagtagaagaaagaaattcggagctcaaagacaaggtcttcaaattaacccaatccaacaaagacaaagaaaaaataagaaaatataaacaaggcctccaagaagtctggaattatggtaaatgaccaaacctaagaataaggaagaggtattcctgaggaagaaaaggaatctaaaagtttggaaacatatttggggagataatcaaggaaaatttccttggcctagctagagacctcgacatccaaatacaagaagcacaaagaagatctgggaaattcatcacagaaagataatcacctaggcacatcatcatcaggttatgatgaagttaagatgaaggaaagaagtgtaagacctacgagacaaaagcaccagttaacttataaaggaaaacctatgagattaacagcagatttctcagcagaaaccctacaagcgagaaggaattgaggctttatcttcagaatcctcaaacaaaacaattatcagccaagaattttgtatccagtgaaactgagcatcatatatgaaggaaagatatagtcttttttagacaaacaaatgctgagagaattcgccactattaaggaagcaccacaagagctgctataaggagctctaaatcttgaaacaaatccagaaacacatcaaaacagaacctcttgaaagcataaatcacataggacctataaaacaaaaatacaatttaaaaagcaaaaacaaaaaacaaaaaatccaaggtacacaggcaacaaatagcacaatgaatgcaatgataccttacatctcaatactacattgaatgtaaatcgcctaagtgctccacttaaaagatatagaactgcagaatggataagaacttaccaatcaactatctgctgccttcaggagactcacctaacacgtaaggactcacataaacttaaagtaaaggggtggagaaaggcatttcatgcaaatggacgtcaaaagcaagcaggggtagctattcttacatcagacaaaacagactttaaagcaacaagcaacagcagttaaaagagaaaaagagggatattaaataatgttaaaaggccttgtccagcaggaaaatatcacaatcctaaacatacatgcacgtaacattggagctctcaaaattgtaaaacagttactaatagaactaagaattgagatagacagcaacacaataataatgagggacttcaatactccactgacagcactagacaggtcatcaagacaaagtcaacaaagaaacaatggattaaaactataccatggaacaaatggacttaacagatatatacagaacatttcatccaacaactgcagaatgcacattcttttcaacagtgcatggaaccttctccaagacaggacacgtgataggccataaaacaagcctcaataaatttaagaaaattgaaattatatcaagcactttctcagaccacagtggaataaaactagaaatcaactctaaacagaaccttcaaaactatgcaaatacatggaaattaaataacctgctcctgagtgagcattgggtcaaaaatgaaatcaagatagaaatttaaaaattctttgaactgaatgacaataatgacacaacctatcaaaatctgtgggatacagcaaaggtggtgttaagaggaaagttcacggccctaaatgcctacatcaaaaggactgaaagagcacaaactgacattctaaggtcacacttcaaggaactagagaaacaagaacaaactaaaccgaaacccagcagaagaaaggaaataacccggatcagacctgaactaaaagaaatggaaacaaacaaacaaaaaacaatacaaaacattaatgaaacaaaaagctgattctttgaaaagataaataaagttgatagaccattaacaagattaacctagaagagagaaaatccaaataacctcattaagaaacaaaatgggagatattgcaactgataactgaaacacaaaagatcattcaaggctactttgaacacctttatacacataaactagaaaacctagaagagatggataaatttctggaaaaatacaactctcctagcttaaatcaggaaaaattagataccttgaacagaccaatagcaagcagtgagattgaaaggataattaaaaaattaccaacaataaaaaagtccggggccagacggattcacagcaggcattcaaagaagaattggtaccaatctttttgacattattccacaagatagagaaagggagaaccctccctaattcattctatgaaaccagcatcaccctaatacccaaaccaggaaagggcataaccaaaagagaaaactactgaccgatataaccaatgaacttagatgctaaaatccctaataaaatgctagctagccaaatccaacaacatatcaaaaagataatctaccatgatcaagtgggtttcataccagggatgcaggaatggttaagcataggcaagtcagtaaatgtgatacagcacataaacagaattaaaaacaaaaatcacctgatcatctcaatagatgcagaaaaagcatccaacaaaatctggcatccctttacgattaaaactcttagcaaagtcggcatacaaggaacatacctcaatataataaaagccatctacgacaaacccacaaccagcataataatgaatgaggaaaagttgcaagcattccctctgagaactggaacaagacaaggatgcccaatctcaccacccctcttcagcatagtactggaagtcctagccagagcaatcagacaagagaaagaaataaagggcatccaaatcagtaaagagaaagtcaaactgtccctgtttgctgttgatatcatttaccttgaaaaccccaaagacgactccagaaagctcctagaactgatagaagaatttggcaaagtttctggatacaatattaaggtatagaaatcagtagctcttctatacttcaacagtgaccaagcagagaatcaaatcaagaattcaaccccttttacaatagctgcaaacaaacaaacaaacaaaaacaaaaacaaaaaacttagaaatatacctaaccaaagaggccaaggacctctacaaggaaagctacaaaacactgctgaaagaaatcacagatgacacaaacaaatggaaacacatcccatgcttatggatgggtagaatcaatattgtgaaaatgactgtactgtcaaaagcaatctacaaattcaattcagtccccgtcaaaataccaccatcattctttcttcacagaattagaaaaaacaattctaaaattcatatggaaccaaaaaagagcctgcatagccaaagcaagactaagcaaaaagaacaaatctggaggcatcacaccacttgatttcaaactataagaccatagtcaccaaaacagcatggtactggtataaaaataggcacatagaccaatggaacagaatagagaacacagaaataaacccaaatacttacagccaactgttcttcgacaaagcaaacaaagacataaagtgggtaaatgacacccttttcaacaaatggtgctgagataataagctagccacatgtaggagagtgaaactggatcctcatctctcaccttatacaaaaattaattcaagatggattaaggacttaaatctaagacctgaagctataaaaattctagaagataacattggaaaaacttttctagacattggcttaggcaaggatttcatgaccaagaacccaaaagcaaatgcaataaaaacaaagataaatagttgggacctaattaaactaaagagcttttgcacctcaaaaggaatagtcagcagagtaaacagacaacccacagagtgggggaaaattttcacaatctatacgtctgacaaaggactaatatccagaattgacaacaaactcaaacaaatcagtaagaaaacaaacaaacaatcccatcaaaaagtaggctaaggacatgaatagacaattctcaaaggaagatatacaaatagccaacaagcatttgaaaaaacgctcaacatcactaatgatcagggaagtgcaaatcaaaaccacagtgcaataccaccttactcctgcaagaatggccataatcaaaaaatcaaaaaacaggagatgttggtgtggatgcggtgatcagggaacacttctacactgctggtgggaatgtaaactagtaaggccactatggcaaacagtgtggagattccttaaagaactaaaagtagaactaccatttgatctggtggtctcactactgggtatctacccagaggaaagtaagtcattatatgaaaaagatacttgcccacgaatgtttatagcggcacatttcgcaattgcaaaatcatggatccaacccaaatgcccatcaatcaatgagtggataaagaaactgtggtatatatatatatgtatatatatatatatgtatatatatatatgtatatatatatatatgtatatatatatatgtatatatatatatatgtatatatatgtgtatatatatatacatgtatatatatatatgatggaatatatctatatatatgatggaatactactaagccatgaaaaggaatgaattatcagcacttgtagcaacctggatgagactggagactattattctaagtcaagtaactcaggaatggaagaccaaatattgtatgttctcactgatatataggagctaagctatgaggacgcaaaggcataagaatgatacaatggactttggggacttgggggaaagggtgggggtgggcaagggataaaaagactacaaataaggtgcagtgtatactgctcaggtgatgggtgcaccaaagtctcacaaatcaccaccaaagaacttacttatgtaaccaaatactacctgtgcccccgtaacccttggaaaaataaaaaataaaataaaataaaaataaataaggagagaatacacacaagggttactgtgcaggtagaagatgaaagacttggcaccttctttgatgttaggggttaggactttagtaaaaatccaaaaagaaatgctggtttagcggggagtgaagacaatgcagtcttttttggaaccattatcataacttgatttatatgctcttttgttagatttcttcctttatctgccaagaaaagagattggccacattcctgaaactgtaaatttttctttgaaaacttatgcaggttgtgaattacaacatttagattaagtgtggtttttatacaatatggaataaatcacccgtgttttttatatgttttcttcatatgtacatccattttaatgtagtttttatggctgcatacctgagaatatttaaactctgacaaaaagtattaattgcaaaagttattttaggcttaacttaaaggagatgttgacaagtttagggaaaaaaacaaatcagacttgtaagactaatgacccttgcgtttgtccttgggacccaccttgatctttgagtttggcaggtcacttcaacatttgagtacccagtgggaacactgaagtgcactgaaatgtactggattaagttagggtgaagataaatagcaaagtaaaaattacagaatcctgggtggttgttatatgaatgatgttacattattttttctgttaactttgcaaattaaataaaatgcaaacaatcaaataaacccaaagattaataagacagttgccttcctctcaagaaacctacatctataggaaaatactttcttatgcagtatctggaaagcaacaggagatttaggacctttgaaaaagtgagttcagtgtgaacctctttactaagataaacagacttcctggagtcgggggtatctacctaggatggagattcacccacggacatgaaggccagtgtttatttaatgcagccatagcctgagtttagtttgttttctctttttcatggaactgttctataaatgagaactttttaaatgggggcctcatgttcaaacacatggagaataagaaaaaaaaaagagagaagagtgagaactaaaaaagtcatccactcctattcatttatttgtttaactttcatgacttataaaagactgtatttcttcattgtagcaatggttcaccacaaattctgcaagaagttaagcatagtcttttaaatatttttgctatcccttttccaactagagggcaacactccataaaataaatcaaataattttttttttttgagacaggatcacactctgtcgcacaggctggagtgcagtggtacaatcttggctcactacaacctccaccttcggagttcaagcgattctcctgcctcagcctctcaagtagctgggattacaggcacccaccaacacacctggctaatttttgtatttttggtagagatggggtttcactatgttggccaggctggtctctaacttctgacctcaagtgatctgtctgcctcggcctcccaaagtgctgggattacagatgtgagccactacacccagcccaaatgacattttgaaacagtcctacaaaattaaagtacaaaattattttgaaccttattttaattccttttctgaccatagctccctcccttgtatctccactgtatcctgtacagataagaaaggtagacaatcagtcacccggagaatgaaacttgaaccagttggaccagggtgcaaatctaagcctgccactaagaatacgtgttaatttcttcagtttacttaattgtgcctcaattttcttggttgcaaaatgaagacagtaataccagtctcagtgtcgtataaagattaaatgtgataacttgtgtaatgtccttggtacatataaacactcacaaacgatagctattattgtatattagcaccttttttagtggaatttatcttttacgtgatcataaaactttaactccttgacaattgatccaattgtggcttagatctgcagccttgggtacagtttcttatagcgtttagtaaatgcttgttggatgagagactcaaatctagactcaagccaataatggggagttgtaaacaatgttcaaaaaatttattttgttcctgggacaaatgcattttgaatgggtggcactgtggattatgcatctagttaatcaaaaaacagctctgctgtgctacttgcagatcgtacatggaaggggcaaaaaaatatgatttaaagacctggacttattatcggttctaaagcaaatttattttgtaccttagagaccacttatcataaatttctcctgctttcattaccagatagaacagaacttactttgcaggcatttaaaaggccagtgaattctagacctttggataaaaaccaacatagaattctgcatgaagcaatattattaatttgtattgcctacaattagatttagcctttagactatgctcagagaaataaaaaatgtcattgatgttattcccctgctgctagaaaaaaaagatgggccatttattacattttttcattaaataaaatccttaaattatgatgaataagtgctaaaataatatactttatttaaaattgccaaaaccatgacaaattacatataaacacaggtactagaagtttcaggatatgaaaacttttattaaaaggaagttagtttaaagacatgcatatttaaattggttatttttatatgtaagttatattttactaagtaaaaacctaagtttttttctttcttctaatttgggctctggtattttatcatgagaatcatgtgttagtaattaagttctgccctttcttggatagaattattaggccttgaaatcattaaaaaaaatccccccatcccccacaacaacaacacaacaacaaaaaaacagacccacaactataacttcaaaggagaccaaaaaagcaaaatgtaatccagagaaacagaaaatgtttgatacagaaccaaagaagggtcttggtgtctttgctgggatccccccatcaggagatgtaactggttggaggtaaagccacatgtactggcatctgtcatttggtctgtcaatcttgacagcagatttaggttaaagaaaaaaaaaagactcctttagttattctaaaggcctaaaaactcagaggatataattgggtttacagaagaaaactccgttgttctagaaacacagctcaaaatccttcctagtcagttattactctaaatacaaattttacattaaaaaataagaggagataaattatgttgcattgactcagtaatagggaagtaaatattttcaaaggcttttggagactattatctaattaagtatgatagcttaccacaaatataaaatgaatgtagttttcaaggaaatattatagacagataatggatggagattatgagaactaacattttgagaactaataggataaatgctttatatataccctgcactgtatggaattcttttcttttctattctttttttttagaagaggaagaaaaacttaccaatttattctgtgaggccagcattaagcagataatatagatagacaaaatcatcacaaaaaagaacctacagaccattattcctcataaatgtagacacagaaattctcaaaaacactataacactgaatccaacaacatgatagtatttttctatgttatctgctacaaatattattttaggcttttacatttaaacctaaaatttacctggaattgacattttatagtttatagtgtggggtaggaaatgacacaagatgtttttcgatgccactttgcaagccagaaaattctgtggccgatggaacctctgctcatttgttcccattgccccactctggaccgtggcccctgggttggcctggctctgctgctggttcctgtcacatagggcagctggttcctgtcacatagctccttttgcacctgctgtttggcgggtcctgggttcttgtcccatgtccaagaagaatgagattacttggacaactgaagagtcagcagggtggagagttttactgagtgatgaaacagctttcagcagagagtgagacacgagttgggcagcctatttacccaaagttgggtagtgctctcaactcaaaggtggtcagtcccccagtgtggctgagtctgggactttcatgagttcagaataggagaatgtgtgtggattggtttgtgagtatgcaaaaaaggctaaaataaagacaccactcaaaggtggtacaacagcgtaaaacaccaattagggaagggtagatatgtgttaaataggtgaagggtggggatcaatcaaaggaatgtgcgccaaatgggaacagaggttctcaatccagtctgtggatttatccaagacttgtggcttggttttcaggctttaaattgtctttagtttgaaggtcaggtttcaccagggacccgcccctatctgcctaggaatttgtctgcctcctgccgctatcagagtcaagattgatttttttccccccatatgaataaccagctgacctcaggtcatttactgagaagactttcttctcctgtgtgggattttttatctcatgcaatcctcatgatcaccttgtgtggtaggaaacagagactcatacagttaattaagttgtcaagttgtcatgggccattcagttagtaagcaatgaaaccagaatttttaaaaatacactgtaaaattaatatttgcttactgtaaaaactcaaatataaaagattgtaaagtgaaaagtaaaatgccctaacttctattaatactactcaagtgtcactgcttataaagccatcataaatgttttcttgtatttttctgaaattgtctatacatatgaaatcaatacctttatgtctatttctgtttatattttcattcctttctcttaatagatatagaaaaaacttcatatatcttatatgtatatatgactttcttgttttaacttttagatcctgataggataacactatgtattttgacacttgcttttaatatttgacagtaccttttgaaaaatgttccccttcagtatgtatagatccattttattattgtatgaatatctgaatttaatataatttaaataacaatattaaattatttccggttttatgctattatattctttctattcaaatcgcctattgacagactttttaaatgttgccaaactgataggtgaatattgccaatctgataggtatgtcattgttgttttcatttcagtatattgaattcaatatatttatttaacacctttttctctgtttgtaaccatgtggatctcttttccatggactttttttttttgatacagggtctcactctgttgaccaggctggagtgcagtggtgcaatttcggctcactgcaacctctgccttctgggttcaagtgactctcctgcctcagcctcctgagtagctgatattacaggtgtgcaccaccatgcccagctaatttttgtatttttagtagaaacggggtttcaccatgttagccaggctggtcttgaactcccaacctctggtggtccgcccacctcagtctcccaaagtgatgggattacaggcatgagccactgtgcccagacttccatgaagttttgattcatgtattttgcccattttcaccattttgttttttgacttgttttatcagaactttttatattaagggaattaagccttttgtttgatataagtgttgcaaataatttctccattattttggtaatttaatgtttacttatctttccttagtttaatgttgctttgaatttcttctgttaatctttacttccccaggataggaggatgggtcacataaaataaagttgtagtactcaagcatttttttagtgcatagttctgtctcctttgtcgttctgtgatgtggagttatgttcctgtatattgcccatttctgcagtttttcatcctccataaaacatgttagtacatgtgcatctatctatcctgcataggactggcagaaattcagatatactcacccctttgatgtattgctgaattgaagcgcatgtattgactgaaagaaacaaacgaaaccaccaaaaaactattggaaaagttctctgaatcattttttctgcagcatgaaaaagcaaaattatatatatctactctgtatgaactgtatgtgcatttgactctgtgaaatgctggaatttgaaatacaggttaaactaaaaaacaattcatgtatcatttaaaaacagctcatacctatagagatgtatgcaatagcatgtcaaagaatagcaagatctaatcttcatgttgtgttttcttaattacacacacacagacactcatacacaaataacaaaggctttaaaaaaagtcagccccatgtaatgaattggcagcaagtagtaaaacaatgaactgttactccaactaaggagaaaaaatttgcatatgaaataattgcattcagtaaaaaagttacatatgtgataaattgtacagaactgagtatagttttaaactaatgtttacaacaaattatgtgctagacacatttctcctttagtttttgtaatagattaaaagttgatttgggccaggcgtggtggctcacgcctgtaatcctggcactttgggaggctgaggcaggcagatcatgaggtcaggagtttgagaccagcctggccaacatggtgaaaccccatctctactaaaaatacaaaattagctgggtgttgtggcacatgcctctaatcccagctacttgagaggctgaggcaggagaattgcttgaatccgggaggtggagtttgcagtgagccgagatcacacctctgaactccagcttgggcaacagagcgagactccatctcaaagaaaaaaaaaaagctgatttgtatttctattttataactaaagtaactgagtttcagtaaggttaagtaatttgcctcaggtcacacaactagtaaggggcagaccttggattccaaaccaagtctttggctttaagctaccacatagtactgcctcctgaaagaagttctgagcaacagggcaaatgtgagccaaaataatcacataagcatccagggaaaacaaaacttgagctttcaaaaatgaataggatttaaataagcaaagttgcataagggggacttattggatggggaaaacagcacgaatgaaatcgtaagtgtaagaatgaacatagtgcataaagggaagggatttctatgactggaattcatgcatatgggaccatgggggtaacatgcagctaatgacagtgagccctgaatgtcagaaaaagaagtactgactttatcagctacaggacgggcagtgtggagccattgaatatgattggtcagattaacaaggtgaaaagtgcgatttgggaagatcatctgcttgggaaatagagtgttctccaaaaggcaagttactaaacatgtcttagtctgtgttgctataacaaaatactttagactgggcaatgtataaagaacacaaacgtatttcttacagttctggaggctgggaagttcaaggtcaaggcactgtcattggtgtctgctgtctggtgaaagctattgtccgattccaagatggcaccttgttgctgtgtcctcacatggtacaaagtagaagggcatgagaatgaacccagtctttcaaacccttttgtaatagccttaatcccatccatgtaatcacctcttaaagaccctacctcttaataccatcacattgatgattaaatttcaacatgagaatttttgggggacacattcagaccaatagcaacatccaagaagataagtagatgactattgttataactcctataggattaatgagagatgtggattaggatgatagctatgactaaaaagcaacttagaggacactttgaagatgaaaaatgggaaataagatgagtcttgccgggcgcagtggctcacgcctgtaatcccagcacgttgggaggccgaggcgggcggatcacgaggtcaggagatcgagaccattctggctaacacgatgaaaccccgtctctactaaaaatacaaaaaattagccgggcgcggtggcgggcgcctgtagtcccagctactccagaggctgaagcaggagaatggcgtgaacccgggaggcggagcttgcagtgagcagagatcgcgccactgcactccagcctgggtgacagagcgagactccggctcaaaaaaaaaaaaaaaaaaaaaaaaaatgagtcttgttgttttagcatgttgtaaatactcattgttctcttaaaaaagtgtttttcaagcacattatagaaccaggcttagctattagttattttgggaatgctttgttttatatgtatatttttccagatagccgaattaaaatttccaccttaacctatttcccatttagaaaaaaaaaaaaaaaaaaaaagaaagtgttgcttgctgccagtgctcatttctcagagcaaacaagaaatgggttaatccagatttgagtagtcacctcagccttcgttgcttgtctgaagacgggaagaaacaaataaagggtgattgaagaaaataattgtcattgacagttattatcatcatcaaacccatttttatttcaactgaatgttgcttggatttatttgaagcaaatcccttagcctagaggttcatgatatttcaagagctgtagctttggccaggcgcggtggctcgcacctgtaatcccaacactttgagaggctgaggcaggcggatcacaaggtcaggagtttgagaccagccagtttgagaccagcctggccaacacggtgaaaccccgtctctactaaaaatacaaaaattatccaggtgtggtggtgcatgcctgtaatcccagctattcggtaggctgagccaggagaattacttgaaccggggaggcaaaggttgcagtgagctgagatcataccactgcactctagcctgggtgacggagtgagactccatcacagaaaaaaaaaaaaaaaaaagagctgtagcttcattttgagcttgcccttaacattgtattatcttcatccttaggctattttgcctcatggtagagaaatggcagcacagacttctgatgtagcacagtttctctttcacatccaggggaaaggagaggatagcttttagctaccatgtaaaagtctacagattccttgtgattggatcaatttcagctcatatcaaggatgggattacataagtgggcttaggccacccaaggaagttggggatcattcttagccaaaagatgtagctcggaagttcaggattcctgataggaaaatattggggaattgatgctggaaagcaacagaaaatgattattatatagctttagcttctctactgttctagaatttgatccataagactgtcagattcatgtgtgatgcatcattatttcctccctcagcacctaacgaagagcacatagtatgtagatataggtggggcttttgttggtgggtggggagttgtcatttgagtccaagaatgaacattcattcataggaacatctcttgaacgaaaacatttttaaatcaaagtgataaggaaaatttatacttaaaactatatataaacatacacaagtgaatgtaaataagttgcctttgataaaagagggatgccatatttcagaaaaagatctctgtagagaaaatatagctaagtcttatacataaaaattagaaaatcaaatccttaatatattgagatggcactcacaaatatatatttcatgattacatagtttgcaatatcattaatatttatggaaatatttttgcctgaatatttgtgacatacaagccttaaaattagattttgaaatattggaacttgtgaatggattacttgtatagacttacttgttgtctgtgagtgtaaaatgttaaaattgcatttaaaaactcaggatccaacttaagatagtaatactagtactattgtttgagcacctacaaggtatttgttgcttcacatggaccagccattgaatgcttaaataatcttataagtaagcctcattatcactaatttactgctaaaggaaccgagttggtgagaagttaaacaaagaaatagagatagaaaataataaagcaagaatcaaacccaataaaatgtgttccaaaaaaatgttccaccattatgctgcttgtcttatttgaaatgtatccccttgagacatggatttatgtgcaattgatttactaaggaagtgccaggagaaaacactgggtcgggggttggctggtggggagagtaaggcaagggaagaagaagctgagcaagagtgtgattctgttgcagttccagcctcaacccaaacccatggagaacatgtcccatctgggcaaggttgctggacatccccatctccatacctttcacctgccccaggggaatgtatattttgtggcactagttctctgcaaggtagtcctccgaggaaagttgcagatacaagtgattagaaatgaggaacctagaacagaaccaggtggtaggtgcactgaaaaggctccagggatctgaagtgttcttggtagagcactgatgctgtcccatccgtgaccctgctaataaagatacgagtatatcacgtggtggtcaggagcacattcttgatccagaccgccagagtcaaatctgcgctgtgacacttgggcaagtttcttaacttatatgtgcttcatcttctgtatctgtaaaatgtggaataattcttttacctaaacacataaggttgctttgaggattaaatgaatatatatattcatctagtctgtacatagactagagctggattggaagcagagctattatcatgtgacttacttatggcatgtcccacagctggttagtcgcacagccaagatgggacctctgggacactcctacttcttgctggccatatacgtatgaatttaaaattaactacttcttgttggccatagatatgttaatttcaaattttcataaagttctaggtgatctctgctgtattgaatatctcaagtaattgataattactatatatgctaatataggtacagaaggtaccttacagttcatgagtaatctattaaaaattcaaacaacaatatatacactaagcatgctgtgttataaactgtcttaaaagtaatgttctgttttgtttgtttttatattcttgaagtgtttggccaaaggacctaattcattcatatttaaaaataaatgactgtaaatcataacatgttacctctttcatcaagtcaaatagccttaatcctaagtgcctaggtggaaattcagaaatcaataagcaagggagaaagatattggtatgtagtagaggtatgtagtagaggaagtgattctctcccaacatattactcttcaagggcatttactgaagtaactatttttaacttacgcaggtccaattaagaatagtaaataaactggaagagtaaaacaaaagcaaagtattttatgtggcaatgttccaatgtgaagaaaaaaatttcaggtagcacatgcatgattgcacatacatattaatgaattgatgatttatacttatttgtgtttgattattaatcaggacttttatttgcaagtaatagaaacccaagctgaactagtttcagaaaaagaaaggaatgtatcgattcatttattaagaggaaaacttgagtaaataaaccacagttggtagagatgcaactggtttcaggaacagcttcagtgaagtgttcgaactctgccaaacctgtcttatcttgtctctggtacctctctgtgtgcttgcttgatggtatctcactgaatgctggcttctttcatgtgctgagaaacatcatccctggaggttgctgaacctcacagctcatattcagcttctagagggggttgaattctttttcgtcgtttgaaaagttccaagataggctgggcacccttccctgaacttaccaattgtggctggcagggcaaggttgtgtttgaagatggtagacgcatgagaattcgggattacagtaaggggtgagttatttcccagaagcctcctcgccctcatttcttctctttttccttccttttcttcatctctttcccacttcatctcttcttgccatcacctcatgtgctttagctgacaggtccattcatgctgtggccccttgactgtggccccttgacaccacatcagcaagtcaggatttgcattgcacccttaccttcttcagagtggagtgtctgtggtgcaaagatgccatttccttgttaattctggttgtctctcatacctgggatacattgtcaggctaaaagagccgttcctgttagggatgaggatacggcaggagacatggagagagaggggcagatacctctgtgctcccattgtcacatgagcatgtcagcatgatcatatgctcatccatctacatggttagttctggctgaaatgttcccataggcagcatcactttaggagctagctgacctcttgataactttttccagagatggattacgggcttttatgtgggcagcaacttgtgcctcaggtgggtatgtaaagctgggtgccaggaacaagaacaggcaggaagaaaagtgatgggaatttacaaaatttccagctcattacagattacacccatcgcctctctccttttgttttagttttgaatttatcgagttgcaagttgtttttgaagagctgtgttccactcgtcctctcatgttttaacaagcaaggagccacaggttaaatgggtagagttggaagaatgagtacaggaaaattgttcaaaagggcgctagtaacctccctgtgtttctcacatattgctgagtataatcagacaagacaagaaaggtactttctcccgctttacccccaaaattaatagctaaagcatgacacacatatatttagctataaataaaaaaacctatttagcttcagtcatgtatgagaaatgtgtatttgtgatgagttgatgagttcgtgtcacaaacaatgacagggacaatcatgacctaggtagaaatgtacaaatctccaaatttttagtttgtggtagaaaattgaggatgtatgaatttcctagggctgctgtaataaatgactgcaagctggatagcttcaaacagcagaaatttattctctcacagctctggagatcaggagtctgaaatcaagatataggcagggccaggttccttccaaaaactccccttccttgcctcttccagcttctggtagcttctggcattcctgggcttgtggcagcatcactccaatctctgcctccatcttcatgcctccatcttctctctgtatgtatctatgtctgaatctctctctcctttctctcataaagacacatgtcattggatttagatcccaccttaatccagtatgatctcctctcaaccaattacatctgcaaaaaccctattttcaaataaggtccccttctgaggttcaaggtaaacatgaattttcaggagacgctgttcaacccagcacagggaaataaagcaaaaaaaaaaaatatgtttctttcagccagcattattgtttaggtaattggctatttgaagcctccaaaaccatacggatttttttttttccaatactcggtgtctttcacaaaaagccctttttgaactgaatctgttttcagggtaggtgctggtgaagagagatcagcaggtaggcacagttttgtcaaagatctcattctttcagtcactgaagggaaatatacatttcccctaagattttcttgcctcaaattctgaaacattttcttcgttctaagttctagggaattctgcaacacatagaattttttggtattatctctgtacccagtcacttggtcttaggttctctatgtctcatcccactctgtatagctcaagttaagtagaataagatgccaccaagtgtagattctttgaatcgtttcattactttctacattgtaaaaaatgaatatataaaatgggttcctgatatttaagattttttcaatcatattgtgtcctttgcatcaaattctatccccccagctctgccctcaggcagctacagagtggatagaaacgctttcctctctcatcaaaataatgaagacatttgctgagagctgattaggaggtgtgcataaattgggaaaggttttaggatagccacttcagggagctgaacagaatgcagagcaaaaccaaagaaagattgacgttctgaggcaaaagtgtgagttatgaactttgaagtctcatgcgaatacttgtataaagtttatctccagtgtccttagtggaggatgagaaggagcagatgacaggagtgattcaccatttgagcatttgggtcagttgtgagtgctggtgagtgatgagttcagtgaccttccaggagaaaatggctggctgagcaactggaaaagtgtgaaagagctaacaggaaaggaaagaggcacagaaagagaatttcagaggtagtgtactcatgggcagggtgtgacaatgggattcagtagctgaagtgggatgcagtatagtggagataatcaagaaactaagaggcaaatgaatttaatgattcagcctcattgatgttggcttcatggaaagggtagtattcattttatttcaattcaataaatagttattaagcactctttgtgctgcaggggctatgtgaggcatatttgacctggataaagtgcgtaagaagagatgatgagattaggaaaaacggtcgttgtcaaggtcagctttatggtcagtgttaatttccaccttggttttggctactcttgagcaactgtttattgttgttctctgcttttcttgctaagatatctcaagtgtatctgaaagctcccgttacttgatctaatggaagagactgttttcctctttcaggttgaagtctttccctttctgtctgtgttctggtttctgggctgttcctttaatacacacagtagttaataaataacccacggctgccaggccctccttgcctggtctgttttgccatcagaaggtaagctcacgggcctgtcaccattctgggtctgtacaccccacctttgtacaagaatgtgggatcaataacatagtttgatgtcatcaggggaatttccatgtttgtgtcttgcctccacttccatatgcactgctttgtatttctttttatttatttcttctgccatcatacagccaggctacaagcaagattaaattaaatgttcattccagtgtcaggaataccaatatatctatattcgtatactttctatggtcatgactttctttaataattcgtacaattttaatatttttgaatagaggcaactcttggcattccccctgtgattgtgataataatgtgaatgtgtgaagtaaccagaataaggaacactttttaaatgctactctgatacattacagggtcagtatttttttttttttttttttttgagacggagtctcactctgtagcccaggctggagtgcagtggggcgatctcagctcactgccagctctgcctcccgggttcacgccattctcctgcctcagtctcccgagtagctgggactacaggtgcccgctaccacgcctggctaattttttgtatttttagtagagacggggtttcaccttgttagccaggatggtctcgatctcctgaccttgtgatctgcccgcctcggcctcccaaagtgctgggattacaggcgtgagccacagcgcccggcccagcctcagtatttttaattaaaaaatgtataactctgtcatcattacaagtaatataataatgcaaaaacaaaagtcttgtcttttccgtggacagttacccagcacatcagaaagtcgggttaatgcagcattcagccaacaagcaggaaggggcatggagctctgtgtgtgcctcactctgcttcctcagatggtgccttggctaaagaagaatagcataacatagtttaaaacacaagtttgttgactgcttaaaatgtttgtagaacttgttgtgggagcagaaaataacgagcagcctccatcaggggattggtagcagtgccctggcttgatcaggctttgtaagcatggcgtgaagcattgtgggaaatcctatcctgtgctaagcatttgagccaatggccctgtcctgcactgatcaaagtactcccatttcctcaagttgtaccctccactaaacaagttatgtccatccttaaggaacattcttggtgtctcacttaatatccccatggtggtctgaaaatttcctctctagaaattattcttctatttttcaggagtttgatagtcaggtaattttttctcccatattatcagtttcttaatttatatttatccttacatgtcatttccaagcacttctttttctttctttttttccctgtctttgctcacatcctttctattttgccaagggcttgcttcttccaagcctttttatcctctcctcccgtgatcagtacccaagtttgcagcaaggttccttgttgttttatgggttggtgtttttgcttaggaaatcctcatgttttaggctgcaccctcaatctgtaatctgaaggtcagattacagtttaattcttcttgaagccctcatcaagtttcaaagagaagccttgttatttgccctttgtaagaaggaacaccttgaaaggccatgggtctgtcttctcatcctagaggccaaggggcactgggactggagtggcagggaggccatgagccccctccccaggtgtaagactcccagtctggcactgcacctctgagggcatctgcatgtggtggtccctgctagtggcttccagaagtaccttctggcattggctcctgaggtcatcacccttgttgatgacagctgtcggcaacttgccttactgaagcctttcatcctccctcccaccggcagcaacttccagggtccttgatgcatctccaacacgcttcctacaataatgtgtagccgtaggaaagtacagactttggggtcacactagcctggtttaaaatcccatcaccctttcccagctgtggtactttgggcttgttgtctaatctctgagtttcagtaaatctgtaagataaggattataacatctttcttatagatttgttgtaaatattaaatgaaatacatagaatgattcatatgtggctagtagatagtaggtctaaataaaagacagatgttattattattccagggataaattggtagctttgcagtttggtgttagttttagcacttcctatgaagacaaaaaaaaaagcacttgctcttaaaagtttctttcaagctgtttatttgaagctccccaaagtcaagcaccacccagcatcacacacccttcactccctcttcctctacttcaatgaaggccactagtttctgaaactgtcgtgacagtaaccaactctcctttgccctaatggcttcttcccaagatctaccttacagagctcagtacaaccttaaggttctgcctgaatttatgaggtatttagcaaaaatctcacatgtgcctgaatattttactgttgacatcttagcagtgccctgtcccccttggaggaccgaggaacccaaaaacgtcaagtctcagacagaagctcaaactagacataaaaatgaaattcttatagaaattctgggttttacttctgtgcaatcattgttactatgcaaccatgcttgaacgataactacccttttcaagcaaaatagaaaagtttctgccttcaggccacacgaccttttagagacaaaacaagtgcaaacaaaaccgtgtgcaatgttttttccatgaatgtgatgttgaaaatgtacctgaggcttaggtgtggcatgactcgctatgtaacacagaagaaaactggatttaaaaactggaatttcttggctgcccattcagacacgacccactacataccatttccccccttgcttagatttccctacagaaaagagaaaaactgtggagaaaatggaaaacaaagccataggagaaaagagctgaaaacacttcatgtaaatgtgcatgctgaaagtagagagcaagcaaggattttaaaatgcggtgcctgaatttgagtagttaggactaaacacagaagtgttgatgaactctaaggctaaactcttggatatttagcaacacgccagggctactttatcagctgaacaaagattccaagaactctgaggggaaagaaaaaagaaccctgtaactcagcggtctccagcctttttggtaacagggaactggtttcatggaagacagtttttccacggactggaggatgggggagatggttttgagatgaaactgttccacctcagatcatcaggcattagttagaatctcataaagagcacgcagcctagatctctcacatgcacagttagttcataataagattcgcactcctatgagaacctaatgccactgctgatctgacaggaggtggatctcaggaggtaatgtgagtgttggggagcagccataaatacagatgaagctttgctcacttgcccactgctcacctcctgctgtgcggcctagttcctaacaggccacggaccagtactggattggggacccctgctctaactgatgcaacacctacagcccacctacaccaagtacaaggctccatttggtctgcatatagaatctctgggatgctagggtgtgcttcactcattctgagttgattcctaggttcttggactaaagtgggcaagtgttatgaagggaactaacagagcaaacagtggaaggaccacattcatgtggatcacgctttccacattaggaccaatttcactgcccattctacttgtttctagttttcctcttttaatttgagcagtgtcacaagcgcacatagctaacaatgttttttttctcttccaaattctaataataaaattgttattggcttttgatcttaatcattaaaataaaaataaaatgtgcaaggaaacttgcagtaagtttccttgttgtttcatgggtggattttttttcttaggaaatcctcatattttaggctataccctcaatttgtaatctggaggtcagattacaatttaattcttcttgaatttcattgatgataaaatcaccagtaaaaatgattgagccctagccttcttctcagcaccatgcatttatagagataaatgagatctcacctctcaccactggtagggatgggtaaagataacattttgaggtggaagagagggagactaagagcgtttgtgcccacagccttgacttctttttttctatgtgaaaaaaaaatgctataaagacacatgcacatgtatgtttattccggcactgttcacaatagcaaagacttggaacaaacccaaatgtccatcagtgatagactggattaagaaaatgtggcacatatacaccatggaatactatgcagccataaaaacggatgagttcgtgttcgtgtcctttgtagggacatggatgaagctggaaaccaacattctcagcaaactatcgccaaggacagaaaaccaaacaccgcatgttctcactcataggtgggaattgaacaatgagaacacttggacacagggtggagaacatcacacaccagggcctgtcgtggggtggggagagtggggagggatagcattaggagatatacctcatgtaaatgacgagttaatgggtgcagcaaaccaacatggcacatgtatacatatgtaacaaacctccacgttgtgcacatgtaccctagaacttaaagtataataataaaaatttaaaaaaaagtgagaggcaggaggaggaagagcaaacctggaaaaaagcaagcaattttcaaaacaattgctctgcagaatgggcaaaggacaggacagtgaattaacaaccaaaaaaaaagccgattagtaaagtcctgtttcttggattaaatggttatctcatctttgttgttgccgttgtcatcatcatatctttaccattgtcactgtctccagaacaaattagacttgaactacacaaccttgacataattgagaagaatatccctttgagaaactgacagtaatttatgctagtttcacgtttgttgtgggatgttgtagggtggtcttatttattgtgtcctccctctcatttatgttcgtgtaggttgagccagtgatacagagaggccatgagagtctggtgcaccacatcctgctctatcagtgcagcaacaactttaacgacagcgttctggagtccggccacgagtgctatcaccccaacatgcccgatgcattcctcacctgtgaaactgtgatttttgcctgggctattggtggagaggtggggctaatgattactgagatgtaacacaattaactgatcatatttcccgccacaaatatgattctaattaatacttagaagtaaagctttaacgctacttttgatatgaaggtggcttaactccattttcgtaggaagggattctttctttaagtcatttttattttatttcatcaattgtagatgaatggggttccagagggttgaaatatccttgaagatggctggtttttgagtggaatagagctctcagggactttcataggacattgtctcatggcattttccatatttagggcttttcttatccacctcatgttggattatcccttggcactccattagatccgcattatgtgctcctagaagtccattatgataatcccacttatgaggaaggtgagtttattattcatatgttttacctatgatttttataaaaagttttgtaccttgtaagtctttaacagagttgaaacaaaatagcagccagtgttagaaggaattaacctatatatttgtcattcaaattaggatactttttaaagtgaaagtgggtactatttataattatactgtaacagcaggcattaaccagcaccaaaccaggtaaatgagcacacgcagtcactaatcttacaaaaaaaacacttgcatgctacctaccaggaagtagaataatagacttttcctttgtgatgtagattagtcccaatacatggtgtttatggaacattttctttctaactgcacgtaagaaaaagttaccatttattatactaaaaagtgtaagcattttgttgtgtggtaagcaaaccatagatgtactcaaaaagtacttatgcagtgacaccgtgtaatatgatattgaagtaaagaaatgtaaggatgtacattttgtttctgaaatcatttgtatgatattccaaatcctaacattgatagatttaacacgaaattatcaacagaagtaactccaagttattattttatattgactcatgcaatttttcagcaaatactgagctccaactatgtgccagatctgtgcttgaggatatagagtgagtgaaaaacagatgctgttctcacccttacagaaattatagcccaatgtgaaaaagaaacaatcaatttttcatagcaatcatatgaaattatatgtatgccaattggtccaaagaagatacctaacactatgagagtatttaattggtgacctaatccagccaggagtgtgtattggtggggatgggctaaaaagtcttcattaaagaatcaaactgttcatctgggtgactggagatgctgaagggttagggtgcagtgaagaaagatgctgatgaacctgcagaggaaggctgaagcagaccatctaagatcttgtaggacccattaaggatttttaccctgaagacaatgagaagcaattgaagagtttgatacagtggagtcaaatattgagatctgtattttgaaaagaccactctggctgcagcagcatgaataatagattttgaagagaggacacgtggtatgatatttaaagagtgatgtttctataaaagtaggtgtcaagctattctatttgtgagcaagccaataaagtatctttttttaccctaaagtaattaataggaaatagtttctctctgaattcactttaatttccacccaccaattatatcccatactctgaaccatgaatctatgttaaaagtttaaaactttcataaaccaagcaaaataacctattaataaattctaaaagttagattttccgtgaaatcatatgtgactataaaacataaaaattgtcatcacaataacaatgggattaattattgaatatgtcttatattgcaacttttaaaaattttttacatttttgattttaaattattaatagaataaatattctatacaatgtataatacttctccaattggaaattctatgtgaactacttcttccttttagtctttattacaaaagtagaaggcttaatttatttgccttctctgttgtcaattaagttgactttctcatagtttcaatgtaaaaatgaaacataagcttattttcctaacaggttaatagagaactcaggatttttagtactttctatttttattcatgtacataattagaccaaattttagattatagtaattttatttttataaatataacataatacgaatttgtttccagaaaagttttttaataatcattttatatgtgcttaagaaattattactttatttactagattatctattaatgctccaaacagctaatgcaactaatgaacctaactatacaaaatgcaactggaatttctacttatattttttccctgtcaaacttataaggaagtagatgccaaaaatataaaatacaaaacaaaattttgcaagatatgtccagagaaaattctaaggtcagtatagatattctacattatcatgcttatttgtatctgcactgataataacacaaaaggagaattgatttttatgatttatttgtttaacaattgattgaaaccctggtagatgtgtgaccactgtacgtgtgactagctgccatttattgagcacctcatttgtgccaaacactgttcttagaacttggtgtttaagccacacatcacacttatgaggtagtagtgctactattatggccattttccatactggaaaactgaagcacagattaggtaactttatgtcttcatctgttctgtgctgctataagagaataccacagactgggtaatttataatgaacagaaatttattcctcacagttctggatgctgagaagtacaagtacaaggtactggcatctgatgagggccttcttacgggtcataacatggcagtaggcttcacatggtggaagggtaaagacagcaagagagaacaaagccacttctgaaataatggcattaatcgattcacaggggccaagccctcatgacctagacacctcttaaagctctcaccattcaatatcatcacaatggccattaattttcaacaacattcaaacctactttttggaggagatagacatttaaccatagcatttgccccaggtgacataactcatatgcagcagagctgggatttgcatccaggttggtcagctccagagtcagtgtccttaattgtcacatcacagtgcttccttgtgatgaccctgaatatctgaagaagctggagtcaacaaacacatagcaaatattttatgttcacaattacaaactcatgaagcaggaaagtaaagcttggatttttttccaaggctgttagggaggttgagaggtaagaatttcctgggataattattgaaatacttaattttaacaacttattacatctgaaaaaaattaaaagtaatggatatcttctaagtatgtgtgtgtgtgtgtgtgtgtgtgtgtgtgtgtttgtgagtgaagggtatataacatgcaatgaggaatatttgatatagagaccttgtgtttaaaaatgattgactagaaatagattaagctgattgatttaaatgagacaagaaaggaaactgaggggaaggaatcaatctgttagttactgcagaaggaagtcaattaatttccaagttaatgaaatgaatttatgaaatgtttggggctcatactctccctccctgtaatgaatatttcataacgacaagtgtgtcttattcatctctcatccccacaatgcctaatggagtgccatttacataatggattcttaatgactgtgtgttgattgaatggctgttgaatgaagaagaaaatggtgacaaactttaaagaaataaagtgaatctttagtagtttttttcttcagcagatggtttctaaactaaggaggttttacctcaaagtaaatgttattgaacttcatctcgaaacaatataaaataaaagttttattaagttatttattctatattctaatgaatgactttagaatcttcattctgtcttcatgttagataattgtggaatataacagccagataacggaaacatttctcttgtagtatgctgtgtgagtccacaaaggttgcaggcaatatggctactcatcttttaactcttgtttgtgaaactgaatgttgtctgccactaatctctgcttgaatccctttccctcatgacagtttatggaaaataaataaacctatttcaacagaatatgaaaactttaaaaaattcaaaccaagaattttcttgggaatgaaaacattttaagaaccaaaaatcactttaattatgtgcttttgttctaggcttaatagataattctggactgaggttattttacacaatggatataaggaaatatgatgctggggtgattgaggctggcctctgggtgagcctcttccataccatccctccagggatgcctgagttccagtctgagggtcactgcactttggagtgcctggaagaggtatgcagcatctgagtctgagctgctctctgcagattcatcaatgctcttagaaactgtggtgtgaaaaattccgcacatgtttattatcgattcctttcttgttgacacactgtgaaacccttatcgcaattttagtaggacttttgactgcttttttaaatcttgaagctacaggagtagaactctaaagacagaagtagttggcagggtgtttttcttcttactcctaccttttttgtttgttgcatgttgcatgctgtatatcatcttttacaatttcaacctttgtttgtgtagtctttttcttttctctagtttaccttttatccatattgatttttccatcatttattttcatttttctctgccttatagtttccttccctttcttcaccacagagcaaaaataactaatataaaaaaatatataggatagaagaaaagtatatttagtaatgacaattttcacttcaagttttttaatgaaaatatttcaacatggatcatactctttatgaattatatgatattgtggttgaggacagtatggcagactggtgaagtggaaagattatgctcttctgagttatttaggccatagttcataattcaaattgccatgacctcatttacaagctgtaggaccatgggcgattcatttaattccattgacccactttcgctttcttatctggaaaagtgggaataatatttccttttaagaatttgggttttcaggttactaacatactggaatctttttgctaagaatgtttattgcctcttatcctcctaaaagaaggaaaaaggaggataacatgtagaaatggtctgggaggccccttataagcatcagctcccctacttttctcccggcaaatgttgcttcacaaggagaacactgaacaatccgaattcaaactctttttcagttcaagcattcatttaaattgctttagctttttatctcagttgtccctccaagtgtgtttgaatgtaaactgtctgaacatgcattaatgtgggctaatcgggtcttcctcggtgtctcctgtaggctctggaagccgaaaagccaagtggaattcatgtgtttgctgttcttctccatgctcacctggctggcagaggcatcaggctgcgtcattttcgaaaagggaaggaaatgaaattacttgcctatgatgatgattttgacttcaatttccaggagtttcagtatctaaaggaagaacaaacaatcttaccagtatgcatgtttttgttctttttcattgactgttatgaaagtcatgagacatatctgctgagatgtggcaaggtttctactagtgaaatgaatttttccttgcatctgtattcttaacaccacccactgtgggtgttgtacaacccagatggaatgtgtttgatctgttttccaaaattgaaactcatttttcttataattcccaggagcaattcaagttgttgactgaaaaataaaaacaaccccaaacaaaaatctcaggttctgaggactaaacattactctttttttatacttgacattccagttagtgattctttgggttgcaattcctgcagtggtaaaatagaggtgtctttatgctatgttgaagagataggatatttttagaagtttcattttagtaaaaaggaatgtaaggataattcttttatctgataaagctatgtgaatatagctaattaaactatgctgtgtgatccagcttgacataatacttggggttatggtgaaggagagaagagaatgaaggctttaaaaaggttataatgctttgttttctcaaatttttattccatgaccatcaagctcacttgtagtataattttctacccttattttacttttaaaagtcagatccctataccatttacgaaatgagagtaatggcaatatcttttctacgtgatgctggagacagggtttttagatgggatgaactgtcagggagaagacatggcacaataggatgtaaaaggaaagctgaaaaaacagaagaaagtgataaagaggaaagggatcttctttttactaatagctatcccttaaatccatagctttggatcttagaaattctttgatacatccggagagtagaaagaagtttgagaaatggtgatcttgtcaaggttcttaaggactacactctattttattatgatgtctctggggttttccaaacagtgttatctcagagtttcctaactgacgcaccatgattatggcataagtgcgatgagatactgttctctgggccctctgagtggcgtgcagggaggtcaaatttaagagcaaaagcccagagattacggcctcaggtctatgaatagcttcatctgcttaccttaaaggggaaacataaaaatgttatcattttccatatgtattgtaatgtacaaaaggatggaaaacactagaacaataaacttctattaatttgcctcacgattctattgtaaggaaataaaggcatgactagagacctttaaagaaaataatgtaaatgaagaggtgatcacaataactactatctatgtctgaggtttattaaatgttcatttgttgctaatgcctatgtgttatgtcatttaatctcctcgtaacagctgtgaaaaaaataaggactttttttttttgagatggagtctcactctgtcaccccggctggagtacagtggtgcgatctcggctcactgcaacctccacctcctgggttcaagcaattctctgcctcagcttcctgagaagctggaattaaaggtgcccgcaaccacgcctggctaatttttgtatttttagtagagacgcggtttcaccatcttggccaggctggtcttgaactcctgacctcgtgatccacctgccttgccctcccaaagtgctgggattacaggcgtgagccaccgtgccagggccaaaaataagaacaatttttatctttaggttttaaatgaacaaattgtgcctgggttatatgtagttcatccagctagaatgttgtggagtctggtggaaacacagagagtcctatttatttgcttgcttgttatatcagcaaacctagaattaaacagatcaggggtcttctgctgaatgaaattacttggcgcatccattcatacagcaaatattaactgttgacgtacaaatgtatttgataaataagccagcataaaacttcaatctgaaagcttttgcttttatgtttcagggagataacctaattactgagtgtcgctacaacacgaaagatagagctgagatgacttgggtaagaaaacttttattattattaaagttcatttatggagagaaagaaataaacttgattttagaagaaaaaggtaaaaaccatttccatttagaaagaaaagttctaaaaatcttgagtatcaagtatcataaaagtgacatcagagatgtttttagcattttctaagacttcaaattaactaatgatattatagtattaaataatacttggagtgtaattaattgactccttcatgaaaagctatccttagtcttttaatttttctcatctaatatttttaaaagaactgtggtcattaattgactgtctgcttgagtctggcttagataaatacagacttccaaatgaagaatgaatttcatgaccttgaggcctctgactcaaagagaaatctggtcccaacagatttactgggggaattccaccaagcattcaagaaatagataattcatgtcttactcaatctctttcaggaacactaaaagagggaacacctcccaccaagtcataaaatgtagttaacataatcttaaaactaaaacttcacaaggatagtataaaaggggccagtagtatgcacctgatggaaataacttggacaagagtttgacaaaccaaatccttttttatatacaaatctaatgataagaccaacttgagtttagctaaggaatataaaattgatttaaattagaaaatatatttattgaaagaaaaagatatataatcacctcaacagaggtagagaaagcattcattaaattcaagtttattgttgacaggggagacatttagcaagcctggaataacagggaattgtcttaactaggtagaagttagctatgaaaaagctatagcaaatattaaattaaatgaaataccgttttttttttcaagttaggaagaatataagggtatttgttatcactacttgtattcaacattgtactggaaaagaaatgaaaatgagatataaggatcagaaagaaagaagtgaagaagcaaaacacattactcacagatactgtaattttctgcatcaaaccctcctccaaattgatactatctaaaattaattgcatttgagtatataagaaattatctcaagaaaatacaatttaaaataaaaattaaacagaaataaaatctaacactagatgtgtttgatctctgtgaaaaaattataaatctttattgggaaacattaaaagaatgcctaaagacagtaagagataccgtgttcatggatagaaaggctcagtaaaataaagaaaatacttctattcatattggctcataaatttgatattattctagtaaaaaaatttcagagaaattttacgatttgaggttttggtattctagctaagaaatcttcaccagaccaaggctgcaaatattttcatgtattttttaatttatataaacattttgctgttttagctttcacatggagcaagttgattctaaaatttacacagaagagcaaaaggttaaaaataggcaggacaaaactgaaaagaacaagatagaaaacaatctactagataagaaggcttattttaaaactggcgattaatacaatatgctttgagtcccaagttagaagacttggagcagaagaggcatctcagaaacagacctacaaattctacagatggaaacttggtttatgatagacatagcatttagataaatggaaaaggataaactttttattaaaggatgctggcactaatggctatccatatgacataaataaaactgagtcttaatttcacacaatgcataaaaatcaatgccagatgtattaaatatttaaatgtgaacagcaaaaatttaaaaccgctggaagaaaaaatacctgaatatatcttcatgactttggagtagttaagaattttttaagcaaagcataaaagcacaaactgtaaattaaagattaacaaatttgactacgtcaaagcttttgcttaccaaaataaaacactatgaagaaactaagaagagttttaaactgggaaaaatatttgcaatacatagattaacaggacattagtatctagcttataaaacaaagtccataagtcagtaacagaagagaagcatacaataaaagaggataagacaaaagcatttcaaagaaataacaacccatataatagatactataaatatatgaaaagatgctcaattttgtttaaaaccaaatataaaccagagtgagatgttttgaactaaccagtttggcaaaattttaaatagcatttccgttatgctgaaactggaacacttatacactgttagtagtgacttaaatttgtaaaaccatcttggggaaaagtatggcattatctagtaaaattagagattcatatatactctactcaattccattcctatgtagatttaaccttggaattacttttgcagaatgtgtttcaggagagaaatatgtaaactattcatagtaacatataataatataggaaagaaaaaattctggaaatctctcaaatacccatcaaaaggagaacaaataaatgtggtattatttaatgaaacagtgtaaagttatgaaaattaatgaatgaaagctgcctatattaacttgagtgtatctgaagaacaaataatgttgattgaaaagagcaagcttgtagcagaatatatatagtgtgatattatgtatgtaaagttcaggaaaattaaacaatatattgtttagggatacatacttcaatatactgaatgtaaagtgtaatgaaaaacaacagaaagataaaatattaagatagtaatcacctttggttgaaatgggaagaagagggatagaagctggacacacatggagtagtcaatgtactggtgttggttttatttttttctcatgccttatgtataatttttgttgttgaaatattattttactaaagacataataaatgagttattattatagtgggtattttggtgcactgtcttgataccctcttcagggccaacacaaccaaacctcagccactgggaatgtcagatgataatatgatagctcacagctgtgtacctcactggacattccccttggtattagaaaataacttcttaaaattttactccctacagtaggagagccagcagtcaatgactagttgataagatgctgcaaaggcccagctttccttctacaatttggtacaactctgaacagccatcctaacttaaggataaattaaatacaatatttactgaggcatcaaatgcaacttcatttgcacatcagcatcttcctttgcctaatcctgccttgctcatcaagtgcaaaacatcatgtttttgcaattagtaaaatcattgtatattagcccctaggttaatttagaatataaacaatattaagtttttcacctttgttttcgaaagctggattttgctggatacagaattcttggttggcagttgctttgtttcctttgcaacacttgtgaatatataattcaatatctttttgttatttccatcatttatgatgaaatgtcagctgtcaattgtattcttgttcacctatatatgatgtgtcatttttctcttgctcctttcaagattttttcttatctttggttttcagcagtatgactgtgatgtgtctaggtatggctctttttgtatttacatttggtttttgttgagcttcttgggtctgtaagttaatgtttttcattaaattggggattatttcaggcattattcctttgaatattttttctacctttttgtcttcttcctctcattctagaactccagttacatgtatttaacatacatgaaaacatatatgttagacataaatgctagaacatttaatgttgtcccatagatctctgaagtattttcacttttctttagtcttttatctctctgttatttgaataggacaatttctattgattaatcttcaagttcactgatattttccttgctcatttgaaacttgctgttgagcttatcctgtgaagtttttatttcgttttggtacctctcagctctagaatttctatttttaaaattgttcttctttcctaatgtcattcctttttctgttcactcatttttgagacatttgcctttaactacttgagcatgtttttctttaactctttgaacactttgtaaaacggctttattgaacatatttttatctgttttcaagtcattgtctgataaatccagcacatcaatcttacaatccatttctactgacttttctccattgaaggtagataataatttcctgtttcttttcccacttaataatttttggttgaaattagacatattagataatatgttgtagtaactctggattctgttcttttgaaggtctttaatctttttccaaattttagtagataattaactacctagattcaaaatatgaaatctttctccccgtcgtatgcagctgctaatgtttatacacatgaagacaagattctagaaaattcaattaaatcagaaaaatttcctgcaaaaattcctgattgattggtattatgctaaccaaacatccttatgattctctgaaatgttcactgtgttgagaagtttacatcccatccgcagaatttattaggttatttaagaaaggcaaatttttaaagtggaaataattctattaatttttaattgtgtcactacctttctaaaaagccagttttttaacttttcagctttaagatgtattaaattttaatattggaaggaactgtatgacattaatgacttgtgtgctttaaatgtcaaagttggtagaacacatactttgctaaataaactatctgttttcagggaggactaagcaccaggagtgaaatgtgtctctcataccttctttattacccaagaattaatcttactcgatgtgcaagtattccagacattatggaacaacttcagttcattggggttaaggagatctacagaccagtcacgtaagtagtaaatgtattttatgatggggtaacgtatttcagagaaagatgggctttattgtcatactggatccattaccacattatagaaatttttatgcactgtttgttctatttgattacttttaactggggagaccaagtaacctttttgattactatgtccagagtccccaagaccaccctcaggttctgtgatttgcaaggagtacctacagtactcagcaaatagttgtattcatggaaaacatgaatatggtgaaagcatgcaaagcagaaagaacaaaaggaaaagctacatgaagcaaagtctagaggaaaccaggcgcaagcttccaagagccctcttccagtggagtcacacagaatgcaccaaattacaccatcatcaaattgtgacaacatgtatggaatgttgtctattggagaagctcatcacagattcagtgcccagagttttttggaggaactagtcatataggtggtctctgcctaccacttactaaaattccatacttccagatggaaagcagttgttcagcataaactgcattgtttgcacagtataggcacaatgagtcactcttatcattagagaaagtttatgtcaatataggaaatcgtttactatttaagtttccaggcacctgccaaggattatccttgcaagcaggcctttctgaggtgggcctattatgttaactctttaggtataattgttctctttcggtacaattataggagctatttaagatataataaacaagattcatattttccttgccctcttgagattgtattctggagtgagggagaggtaataaacaaaaaaagatattttaaatagtaatagatgttatgaagacaaaacagtgaaggaagtatgtagttgttgtcaacaggataaagaaagcctctctgggttggtgatatctgagcagcgacctccgtgataaggagccagctatagagatatgcaaattctgcacaggaaagagccagtgtaatgaatgaccctgtggttagtctgaacctaccgtgtttgtggagcagcaagagagtgcatttggctgcagaagagtgaagtatggtagagaataagtgaggacacatgagagcaggtgggaccagatgatttaggactttatgggcaacataaggccttggggctttaagtgcaaagggaagcaattaaaggatataaataaagtcaatttggctactatactgggaaaggactctaggagggctagactggaaggaatatcaatcaggaaactattgtgattgtctagttgagggatgaaggtcacttgtgccaaggtggtgacaccaagttgatgagacacattccattcaggttactttttgaaaggagcacccacaggcttgttgatcaatggcatctcatggaggcagtgagggatagagcagagtaaaggctcagtgatggtgtgaatggtgttaggggaacatgctgaggatgatattgagaattctgttttggatatattaaggttgatgtatctattcttactgatgtcagtgagaagaattagaatggctggtggaaatttggggatggctgaatttgttttaatatagagaagaattttctaatgatcactactattcaaaatgaaagggactgacgtaattatgtaattagagaaaatatacacatagaggttttgtttttgtttttgtttttgtttttttgagacagagtttcgctcttgtcacccaggctggagtgcagtgacgcgatctcagctcactgcaacctctgcctcctgggttcaagtgattctcctgcctcagcctcccaagtagctgggattacaggcgctcgccaccacgcccagctaatattttgtatttttagtagagacggggtttctccatgttgggcaggctggtctcgaactcctgacctcaggtgatccacccgcctcggcctcccaaagtgctgggattacaggcatgaaccaccatgcctagccacacatagagttttgagacatgtatttaaggagagagtgaaaaaacattcagtgaggatatggtaaaatgcagatgatgaaggagaatagaaatatggtcaagtttttgtgcctaaatattacaggattataaattatgaactgagacccactcctctttttgaattaaatttatgattcatagataggttttactgaatttttttgcaaacagcaaaatgaccactagaagaaatgcctatatctaataaaatacaaataacaaaatgcttacataaattggtttatagtttactaagtattttcatatgcatgattttataattcatttttacacaattccaacaggtagagcaagacatgcaatcccggttttataggggaggaaatagaaaccaagagattaagaaattattcaacattatatagtacataataaaagggagagttggggtttgcatctagtctctgatctctttctccccatacaacatgcacatataggccaatatataaatatacataaatatataacaagtaaataattacatatgtaaacaaattaaaacaacaaaaatccaagcatcacataaaatatcattttaaaaacactaggatgtagtcttggttttcaaatattgatgttatattgttccttacttagccttgagtagtctttttctcatttagaatattttttacatattgaatggaaattttctaatcgatggttaatttgagagaatgttaaaaacaaatggatattaaaagctgtatgtttgcaagatgatttaaatgcattctatggcctattttttttttttaagtttaaatggtatgaagcctctaaaaatgttcggctctcctgtttcccaatgagctccaccagtgtccatacctttggtctccctcaggaaatactcaagttgggttttcataatttggaaagacagggagaattgctttacagaacaaggctagttttgagatgtcattctcccctgccaaaaaaaagaaaaaagaaaaaaaaaaaggacaaaacccatttaacttcatggttaaatttattcctcaaaaatatgagcacaaaagagcctctatttaaaaatacatgtttagactttaaattagacattaaatctagttcatcaccacagtgacataagtgatagtgaaggccaaactaacaaggtgctggctcaaacatcagaacaaaaaatggcttaggtgctttttttctgttttgcttagaagaatattaccaattggtattcagcatataatactaaaaaggaatatcatataacatatgaacaaaactcttctattctgtgcttttcatataatgattaatcaggttctatattttattttaaacattctatagcaatcctaggaaggattgatagaaaaaatgagacaactatgtcttgtctcaattttattgtctgttctcgggggtgctatttctgtctgcctcctacagatctggcaagtcttaaggaaaaacaaaaaactcacaaagatcaaacaacaaaatagataatgagtttagataaattgtgtattccctgttgtaccataaatcaagactgaatatgcaggtctggtgagatgtaagtaatggatagttcctgtgttattggttctgttcctaaaaaagcatcaatagctgtttctcttcctctttgcagaaaaatcactttatgtttttcctatttaaaactcacacgtgcttattataaagagttcaggtaatgcagaacaagttgttataaagaaggcaaaagcaaccacctcaaattctactcaacataaacattgctaacatgttgaatgaatgttattataaacatcttaatatgtatatatttatataaaatgaattgattaaatactgttacaagattacaatttatgcactatttttgaaaaaccattgaattttaattttgttttaacttattagaaagaaactaaagtaaaactgaacatttgttgaagttcaaataaatgttgttggtgttgttttaagcacaagaaataatattttatgaagagggtctcgaatgttgacaaaatagatcataaaatcatcaagttgttagattcactgtatgtttcaattttaggtcatgaaagatggagacgtttatactttcatatttttcccacttctgctttctaaaccaccaagtatttattatttatattataattattatattttcaagatttttaatgtttacacttaattatgaaactataattcccagaatatttaacatgacttgattagataaatcaattcaatgataaccctaatctttatgatttctacattaatgagtttttaaatttgagtcattaggattttatcttcaagttgtttaatcagtaagggcttctgagtgccttatgcctcaagttctttcaatttgggaatttctactcttttatttggatagcagtttggctggatatgatattttagggtcatatttctttcccttgggagatctctctggacgaatggaggaatttttcctttacttgtaggattcataagttcaattgaatacactttagtgttgagcatctgaattaagttttcctggaacacaaagtgtttttatttatttatttattctaaacaaacaaacaaacaaaaaacgggatacatgtgcagaatgtgcagctttgttacataggtatacgagtgccatggtggtttgctgcacttattggcccatcttctatattccctcccttcaccccccatcccccaacaggccctggtgtgtgttgctcccctctctgtgtccgtgcgttctcattgttcaactcccacttacgagtgacagtatgtggtgtttggttttctgttcctgtgtcagttcactgaggacattggcttccatcttcatccatgtcccttcaaaggacatgatctcattcctttttgtggcatcatagtattccatagtgtatatgtaccacattttctgtatccagtctattactgatgggcatttgggttggttccatggctttgctattgtaaatagtgctgcaataaacatacaagtgcatgtgtctttatagtagaatgatttatattcttttgggtatataccaagaatgggatattgctgggtcaaatggtatttctggttctagatccttgaagaattgccatactgtcttccgtagtggtggaaataatttacattccgaccaacagtgtaaaagcattcctatttctccacagactcgccagcatctgttgttacctgactttttaataattgccattctgactggaatgagatggtatctctttgtggttttggtttgcatttctccgatgatcagtgatgttgagttttttcatatttcttggccacataaatgtcttcttttgagaagtgtctgttcatatcctttgctgactttttaatgggattgtttttttcttgtaaatttgtttaagttccttgtaagttctggatattagatctttgttggatgggtagattacaaaaattttctcccattctgtaggttgtctctttgatctgatgatagtttcttttgctgtgcagaagttctttagtttaattagatcccatttgtcaattttggcatttgttgcaattgcttttggcgtttttgtcatgaagtctttgcccatgcctatgtcctgaatggtattgcctaggttttcttctagggtttctatggtttgcagttttacacttaagtctttaatccatctgagttaatttgtgtataaggtgtaaggaaggggttcagttttggttttcagcctatggctaagcagttttcccagcaccatttagttaataggagatcctttccccattgcttgtttttgtcaagtttgttaatggttgtagatgtgtggtgttatttctgaggtctttgttctgctccatgtctgtttttgcaccagtatcatgctgttttagttactgtagccttgtagtatagtttgaagtcaggtagtgtgatgcctccagctttgttctttttgcttaggattgtcttagctatacagagtcttctttgattccatatgaaatttaaaatagttgttgctaattctgtaaagaatgtcaatggtagtttgatggaaatagcgttgaatctataaattacgttgggcagtatgaccattttcatgatattgattctacctatccatgaaaatggaatgtttttccatttatttttgtactcttttatttccttgagcagtggttgatagttctccttaaagaggtccttcacatcccttgttagctgtattcctaggtattttattctctttgtagcaattgtgaatggaagttcattcatgatttggctctctgcttgtctattgttggtgtaaaggaatgcttgtgatttttgcacattgattttgtatcctgagactttgctgaagatgcttatcagtttaagaagtcttggggctgagatgatggggttttctaaatataaaattatgtcatctgcaaacagagataatttgacttcctctcttcctatttaaatactctttgtttctttctattgcctgattgccctggccaaaatatccaatactatgttgaacaggagtggtgagagagggcatccttgtcttgtaccagttttcaaagggaatgcttccagcttttgcccattcaatatggtactggctgtggcattgacataaatagctcttattattttgagatatttccatcaataccttgtttattgagagttttcaacatgaagggatgttgaattttatcaaaggccttttgtgcgtctattgagataatcatgtggtttttgactttgattctgtttatgtgatggattatgtttattgatttgcatgggttgaacctgccttgtatcccagggatgaagccgacttgattgtggtggataagttttttgatgtgctgctggatttggtttgccagtattttattgtgtattttcgcatcgatgttcataaggaatattggcctgaagttttctttttttgttgtgtctcttcccggttttggtatcaagatgatgctggcttcataaaatgagttagggaggagtccctctttttcaattatttggaatagtttcagaaggaatggtaacagttcctctttgtatttctggtagaattcagctgtgaatccatctgttcctgggcttctttttgttagtaggctattaattactgcctcaacttcagaacttgttattggtctattcagggattcaacttcttcctggtttagtcttgggaaggtgtatgtgtccaggaacttacccatttcttctagattttctagtttatttgcatagaggtgtttatattctctgatggtagtttgtatttctgtggggccattggtgacatcccctttgtcatttttttattgtgtctatttgattcttctctcttttcctctttattttctagctagtgatctatctattttgttattttttttttttcaaaaaaccacttcctggattcattgatttttttgagagtttttcctgtttctatctccatcaattcttttctgattttagttatttcttgtcttctgctagcttttggattagttttctcttgcctctctatctcttttaactgtgatgttaaggtgttgatttgagatctttctagctttctgatgtggggatttagtgctataaatttccttcttgacactgctttagctgtgtcccagagattctggtacgttgtctctttgttctcattggtttcaaagaacttgatttctgtcttaatttcattatttactcaggagtcattcaggaccaggttgttcgatttccattaattgtatggttttgagtgagtttgttaatcctgagttctaatttgactgcactgtggtctgagagactgtttgtttaatgacttcagttcttttgcatttgccgagaagtgttttacttccaattatgtggtcgattttagaataagtgccatgtggcactgagaagaatgtatgttttgttgatttcaggtagacagttcggtagacgtctactaggtccacttgatccagagctgatttcaagtcctgaatatccttgttaattttctgtcttgtttttctgtctaatactgacattggggtgttaaagtctcccactattattgtgtgggagtctaagtctctttgtaggtctctaagaacttgttttatgaatctgggtgctcctgtattgagtgcatatatatttagaatagttagctcttcttgttgaatttttccccttaccattacgtaatgccattctttgtcttttttgatctctgttggtctaaagtctattttgtcagagactaggattgcaacccctgctttttttttctttcaatttgcttggtaaattttcttctatccctttattttgagcctatgtgtgtctctgcacgtgagatgcgtctcctgaatatagcacactgatgggtcttgactctatccagcttgccaatctgtgtcttttaattggggcctttagcccatttacatttaaggttagtattgttatgtgtgaatttgataatttgatcctgtcatcatgctgctatttgatgattttgcacactagttgatgcagtttcttcatagtgtcattggtctttacaatttggtatgtttttgcagtggctggtacgagtttttcctttccatatttagtgcttctttcaggagctcttccagggcaggcctggtagtatcaaaatccctcagcatttgcttgtctgaaaaggattttatttctccttcacttaaaaagcttagttttgctggatatgaaattctgggttgaaaattcttttctttaagaatgttgaatattggcccccaatctcttctggcttgtagagtttctgctgagaggtccactgttagtctgatgggcttccctttgtaggtgacctggcctttctctctggctgcccttaacagtttgtcctccattttgaccttggagaatctgattattatgtgtcttggggttgatcttctcgtggagtatcttaatggtgttctctgtatttcctgatttgcatgttggcctgtcttttaggttggggaagttctcccggataatatcccgaagcatgttttccagcttgtttccattttccccatctccttctggtactccaatgagtcataggttaggtctttttatgaagtcctatatttcttggaggctttgttcattccttttcattcttttttctctagtcttgtctgcatgccttatttcagcaaggtggccttcaaactctgatatcttttcttctgcttggttgattcggctgttgatatttgtgtatgcttcatgaaattctcgtgctgtatttttcagcttcatcaagtcattaatattcctctctaaactgattattcttgttagcagttcctcaaccttttatgaaggttcttagcttctttgcattgggttagaacatgcttctttagcccagcatagtttttattacccatcttctgaagcctgcttctgtcaattcatccatctgatcctccatctagttctgcacccttgatggagcgatgttgcaatcatttggaggagaagaggcactctgaccttttggattttcagcatatttttattgattctttctcatcttcatgagtttgtccagttttggtattcaaggctgctgacccttggatggggtttttgtgagtgctttttttgttgtcattgatgctgttgttgttgcttcctgcttgtttttctttcaacagtcaggtccctcttctgtagggctgctgcactttgctgggtgttcacttcaggccctattcatctgattatttcccacacctggagatgacactccaggaggctagagaacagcaaagatgagtgcctactccttcttctgggacctctgacctcaaggagcaccaacctgatgctagtaggattattcctgtacaacccctattgaagggtctcacccatttggctggcatagggaacaggactcattttacaaagcactttgtcccttggtggagggtgtgtgccttgttgggagaaaacccactcatctgggctgcctggattcctcagagctaccaggaggaaaggcgaagcctgctggtccacagaggctgcagccacccctccccttaggggcttaggactagggagatccagcttctgtccctgagcctctagttggagtcattggagttcctccagggaagccccacccagtgaggaaggatgggtcagggtcaagcctgaagaggcattctggtggaagactgccacagccagtgtgttgggctgtggggaacaagtcttgtgaccaagccatccagcctctctggctccagcaggggaaaagcacagtctggagctatagagatggatgctgcccttccctcgcccagggagcttagtacgttaggcagttgcgagtcctagtgctggctgctgctcctctcccaaggagctcaaacagcttagacagtaggcagctgcggtgctgatcgaccctgccctcgggagtttggtaggcttaagcagattccagttgagagactgttggctaagtttatgtttactccatagactctcaaaatgttcttaaaataatatatttttcattcttaccagtgatgtgtaagaactcctgttactcaatattcttggcagtattttgtattttcagtattttgcattttatccattttaatgtgtatctagtgatattttcttgtggctttattttccattttccttgtgactaatgatactgagcctctttcacatgtttattggttattgtaaagcaggttcgctgtgcaggttgtctgagtccagtaagaaaaatcatacttatacacaacaagttacattaaatgggtttattgcttacagataggcagcgaaaacaacagaatcctagaatttattgtaagccagttttccaaggctcaggaaatctgcctggaatagatggagcctctactgtacatgtcccagttgcatggcagctgaaagaccttgacaagcagcccattcttggttttatatcccagggcaatgtgagattcaaggctaaagcattgaaggactctctgtttccaggggagtctcttagttggcttggggtgggataacaaaatagcttagactgggtaatttataaactacagaaaattattgcttattgttgtgaagatggggaagtccaaaatcaaggcaccagcagtttcagtgtcttctgagggcttgctctccacttccaagatggcaccttcttgctgtgttctcacaagtagaaggtacaattggaaggttccctcaagtctcttttgtaagggtactaattccattcatgagcatggaaccctcttgacctaatcacctcctcaaggccccacctcttaatacactgcagtggagatgagatttcaacatgagttttggagggacatgaacattcaaaccctattgggggtactggaacagaacctgggctattccagtcagtcccttcctatctcaagattttctgtttccagcacattatatagttattcttgagaactacaagcaaaaatgagaatggattggattggtccagggccacccagagaattgtcctaaggttttatgtatatatgtatatatatatatatatatatatatatatatatatatatatatacacacacacacacacacacacacacacatgtgtgtgtatatatgtatatatgtgtatatatgtatgtatatatatatatatgtacatgtgtataaataaatgtgtgtgtgtgtgtgtgtgtgtgtgtatgtatacagtcagccctctgctttcccagatgcagaacatggattctgcatccatggattcaaccaacttcagataaaaaatgtttgaaaaaattgcatctatattgaacatgcacagaatatttttattgtcatcattccttaacaatacagcataataaccatctacatagcacttacattgtattaggtattataagtaatctggagataatttaaagtagctaggagcatgtgcataagttatatgtaactactacaccattttatataagtgtcttgaacatcacagattttgctatcctcagtcccccatggataccaaggggcaactgtgtatttctttttaattatttgttagaatttttgttcattgttcattgaattacttgttttcttattactgagttgtaagaattctttatactttggatgtaagttctctgttggatgcctgtttacagacaatttctcccagtctgtggcttgactttcattttataaaagctgtatttattgaagtttgtttcatcatttttttggtttgttttgtgcttttcatatcctgcttaaaaaatctttgcctactcaagggaagactttctcttgttttccccctgaaaagttcacagttttagcttttacatttaggtggatccattttgaacacatttttgtgtgtagtgtaaggtaaatccaacgttctttgtttttcatatagatatcaagttgtgcaagaaccatttgatgaaagaaaactacctttttactattgaattactttggaatatttgttggaaaatcatttgtccatatattggttctttctggattttctattctgtttcattgctctatatgtttagccttactctaaaaccacatttaattattatagttttataggaagtcttaaatgtaggtctccaaaactttgtcattttttcccaaaattattttgatagtctaggtttattctattttcatacatatatttaaatcaacttgtcaatttcatttttaaaaaggacctgctgggatttgattgggattatactgaatttctagacaatttgagagaattgataccttaacaatattgagtcttctaatctatgaacatggtatgcctcttcacttatttactgttctttcatttctctaagcacttttttgtggttttcaatatagaagttttgcgcatgttttgttaataatatgtttttttaagttttagttatccttgtctgctaattctttaatctctgtcatttcaagatcttggagtattgactgattttttcttctagtttagattcacatttacatacttgttgatgtgtttaataattttttgactagacatagacaacaggacattatgcacattctgttaattagtactaggttgtttttatttctttaaagaaccttgttagcgtgagtctagaatagatgtttactccgtgtagtcaacagagacattccactctggctagtttgagctcaaatgtctgctagctctatacaggctctgggaattgtttaggtcacaatcttctagttgttcattgcccagtcttgtggattttaccctaaatatagttggcttattgcttagttactgactcagaggatccttatacaaatttttcctctgcagtagtctaccttgaatatgtaagcttcttcagactcccttaactctggtcttcatctccttaacttattgagatcgtcattttctgtttcgaaattccctttcctgcattctggttcagagaatgcttctaggcagaaagctgggatgaacataatattcaaacaccttatttgtttccttccttttggggatcatagttctgtgctattttccaatgtccaaaccagctgtttcatatggtttgtcgaattttgagttttttacaggaagttagtgtcagttactccaacatggccaaaagtggaagtctgttaatgaatttttgttccttttgctagtttttgatcacatgtttacttgcttgatggatggagagtgtgtaatatagttcatttagctataagtacatggactttgtttcttggttaaatcttccatctctcttccttccttctccttctctaccccgagaaagacattagcaataaaacttttaaaacaggagtccagagaggctcagataagaaatgtaaccacagattatttttctccatctgcttttcaatttatatagaacagagggaccaagtataaaaatcattaaacttttaaaatttccattgatcagtttgaatttataagaataaatagctttatgttccacttaaaaatttaaaaaattactctaccatggtgtattgcagtcaactttgctatcttcttagaaaaacatgtctcagagtttagatggaatttacaaaggaaaattacccatcaatattaaagcataataataacactgttttttattgactacagtaatatatatatatatatatatatataataccattcgtttacatgtatgtatggagagacatttacacactgacaagatatgcagaaatgtaactttttatttctgtaacattcccaattatttccaactaatccctaatcccagtaaaagcagaaatacttgctactttaaggttacctggtttaaagcttagtctttttgaaaaaaagtattcaggataaatattcactttttctgtctgctcttttctctaggaaataatttggaagtgtgtaggataggctagaaaggttagagatgacaagtaggatgtttattagtataaagttattatagaacaggggcctaaaccaagttagtgggagtggaaaggagatgataaatatgagacaaagatgccatctcagaaaggttgatgaccacatccccaggtcacccagcctcagtcattctgtctccaacatacgcgccattgggcttggcctttctacatatctgttctaaaaactgacaaatggggttacacctcttctgtcactttatgttggacaatctcaataataggcaatttagtaaattattatagcagcaaagctttttaagatttcatctgtgtataatggtcacactattcactcttaacagcggggcaccagaggctttaggcaacctaagcaccatagtaaagctgtcgtgccaccttgtggtgtttcagatggttacagactgatgattttcccctagcatttatctggttataaaattgattttctctttttcaaattaggcattttatctttttgaaaagtaaattttatttttaataattgacttaaaatgatcaatagctgtagcttttagtgcttttaaaaggacattgtatgcaaatataataacttctttcaagtcaagtttttgcttgatactaattctggattgtgtctctacaaaattgtcacaatatgtttaattttcaaatgctatagattttaggccattgctaggtatgtttatgtaatgcaatgctgattgctcttactttatggggcttcactttaaggtctttgtataaaataatgcatttaaaactcaacaaagatatatattgattctaattaaaggaaattatgaaaaatgtaaagatctatatatattacctattttcctcattgtctcacttattagatatggaagaaatatttcaaatttagacataaaaaattatctttataactccaagaaattaataaggaacttttaatttacttaaaaagatgatattcaatgtgcctgagtgggttatgtatgttaagagagagagagagagagagagagggagagagaaatgacataaataaattttaaaaatatgaagattaatgtatattcttcagctgagattatttgataattatagaaattactgtaacatcttgggatgttatgagtgccagatactttctagtcaccatgataatttcctgcaaggtccatggattaatgtaaaattttgtgacatgccagcacttacacttttccctttttcaggaatcaataatataaaacttatatttaatgaaagacaacacctgaaaactatcttttcaagcaagttatgtcattcactttttcacttcactttttctgtcacttcttctgtctgctcatgtcattcttgtgatttctttttcctttcttgaatatttggcatgtgatttttggagtggcaggtgaaggcagagtgtattctatatagggtattttttttctcagtacatttttaaaatttcaacttttattttaggttcaagggatgcatgtttaggtttgttacaatggtatattgtgtgaaactgaggtttagagtatgaatgattccatcacccaggtagtgagccaggcacccaacaggtagttttttcattcttgtctccctctctccctctctctctagtagttcccagtgtctgtttttcccatctttatgtctatgtgtattcaatgattagatcccacttatatgtgagaacacgcggtttttggttttctgttcctgtgtaattcacttaggatgatggcctccagatgcacccatgctgctgcaaaggacatgatttctttctttttttgtgtggctacatagtattccatggtgtatatgtaccacattttctttatctagtccacctttgatggacaccttggttgattccatgtctttgctattgtgaatagtgctatgatgaacatacaaatgcatgtggtctttttggtagaactatttattttcctttgggtgtatagctagtaataggattactgggttgaatggtagttctgttttaagttctttgagaaatctacaaactgcttccacagttggctgaactaatttacatccccaccaacaatgtataagcattgtcttttctctgcaaccttgccaatatcagttgttgtttttttttgcattttaataatagcccttctgactggtgagatggtatctcactctggtttttatttgcatttttctgatgattattagtgatgtggagcattttttcatgttttttggccttatgtatgtcttcttttgagaaatgagtaaaatttttgaagcattgatcaaatcacattttttgttgtatttgtcttctcacttagctaagccaaaacagatcagccagcaggggtcaggcttttatagtgtatgggtttgaactttccatctctcacagtatcttttaggaacctgcaggtttcttgattacaccattagcattgtacttttcagaaatgaatgcttaccagttaattttttaactagaaccaaaccaaattaatgtagaattgtgagactctgtagaagctttctgagacaaaattatttgtttaaattttgaccgggcatggtggctcacacctataatcccagcactttgagtggtggaggtgggagggttgcttgcgcctgggagttccagaccaacctgggcaacatagcaagaccccatatctattaaaaaatataaaattaaaaataaaattaatgccaatctgctactaaaaaataaatatcattctttaaaaatcttttatttggtatttcttctagtaatcactgatgagctcatcaacattttgcattaggttatctatgtgtatgaaaatgaataagtgtgagatctattttaggatgctgaaaagtaaaggaaacatgtaatgcatttgttctgaatatgactaactgtgtcttttaaattcaggacctggcctttcattatcaaaagtcccaagcaatataaaaacctttctttcatggatgctatgaataagtttaaatggactaaaaaggaaggtctctccttcaacaagctggtcctcagcctgccagtgaatgtgagatgttccaagacagacaatgctgagtggtcggtaagctctttttaacctctgacaacccagatgacacattttatctgaatctattacaggaaaacctaaggagaagacaaatatccataaatccaggggtccagttgccttctaatgtctgataatttttgttcaatgattacttggattgactgaaaactcctcattctaccccctttcaagagaaaaattagttctaaaactaaggttgggatagagcaggaacaggccggaatgagtgctgcaaaaagcaatagagcctgctttgtattcttttccaaaggagtgcctggccctcttttctgtttcctccttaaccctaggtttctgactcccccagtgtgtgactcctttggtaaccactcctgccccctttatcccctgcagaagtgtgggcagctgagcggcctggtcactgtgctgccttaaatcagatgttcatttgcattgtttgtgcttccattttcagattcaaggaatgacagcattacctccagatatagaaagaccctataaagcagaacctttggtgtgtggcacgtcttcttcctcttccctgcacagagatttctccatcaacttgcttgtttgccttctgctactcagctgcacgctgagcaccaagagcttgtgatcaaaattctgttggacttgacaatgttttctatgatctgaacctgtcatttgaagtacaggttaaagactgtgtccactttgggcatgaagagtgtggagacttttcttccccattttccctccctcctttttcctttccatgttacatgagagacatcaatcaggttctcttctctttcttagaaatatctgatgttatatatacatggtcaataaaataaaactggcctgacttaagataaccattttaaaaaattgggctgtcatgtgggaataaaagaattctttctttcctactacattctgttttatttaaatactcattgttgctatttcactttttgacttgacttttatatttctttaaaaaattccttccttttaaaaaatataaaagggactactgttcattccagttttcttcttctttgttgttcttctagtgtgacttttcaagtgtaacagccattcttcctgactttaatattgtccagttctggtcttttctgtgaattaccactgggccccttacctcaatgctttttgttgatgcccactctggttcccttgtttatctgagtctgttggtaccccaaatgaccccacacccatcttaaagtactttttttcaccttccctgtttagtactggccagatgagttttttctagagctctgtcactatctgaaaagaaagaggctatgggaaacatagaaatggtatgtattaataactgatcataggctgaggagaaaaaatgtagctggctgcaaacccagtgctgtgaggtgacttatatgaggttccagatcaaagacaggccgtgtgagccagtccaggagggtgtaagttctgaatggttccttgctgactttgggtgacacatgtaccacatactggctcagtttaagtcatggttctattgtagatttatttttatattagttaataaatgactttaaattgtcaccaattgaaaatcttgtcactcttttggttttctttatatagctcagccaaatcttgttttatgtcctgtcctcatctcttaagctaaatctgtttggatcatattaataaactaaatgaaattaca

SEQ ID NO: 395 - DNA, 67992 bp, Homo sapiens
atatttcaggggatatgaatcccctacattaagtaaggattatgagggctacccagccccagcaatgccagattttcaacctggggataccacagtaagactagacaaaagaatgtctcttactgcaatatatgacaagaggagagagacagattatagtgacaaaggatataatttagcttttgtttctcaagatgaacaagaaaattcttcctttactatattatacgaagagccccttcaagaggaggacaagtatgcttccgcagaagcaagacaaacacagtctgtcttgtttcatgatacgtccgctgacagcatgcctgttctggcatgtgaaaggtctgagagtagaactgaccttgtccatcactttgaaaaaggtactaaattaggtgagacatttgatagtgatagttcagaaatgttcttatcagtggaggccaaaaggtacaaaatttatcctttagcattgtctcccatttatgaggatgacagctcacaggaggacattctatctagtgaggtttcacctggtcaccatggccccaggaaatcaagagacagtgaaaaccagtcctcttctgttttatcccttctccagtcagtgtcagaacgtttaaagatgaattttgatgaagatgacagagaggcagctgatgaggaagaagaggaggaggaggcagcagtattgcataaaggagatctgagagctggaagtggggagcgtgttaccttccagttgccagatccttccatcacattttaccctgatgaccaggagagcgttggaatttctaagaattcatatgtgatgccaaatgaacctactacctccaatctgcaagttggtctgtggccagaaaagacctcgtttctccagaaatctgaccttacttctaaactacattcttctttaaagagtgcttatcatcagtatctgcagacttcccaaagtcattcctcagaaaaaggagccagatttggtggaatttttcaggaaccagtgtcaaaatatttccgtgttcaagacagcccaggcagattgagcccatttatagaggtaagttattttgtttattgtattaataatagttattaaagctttgggtcacgaaattatctaaaggcttattaagaaaagtcaatgttttggccaagcatggtggctcatgcctgtaatcctggcactttgggaggccgaggcaggtggatcacgaggtcaggagttcaagaccagcctggccaagatggtgaaaccttgtctctactaaaaataaaaaataattagccgggcatggtggcgggcgcctgtaatcctagctactggggaggctgaggcagagaatggcttgaacctgggaggtagaggttgcagtgagccaagatcgcaccagtgcactccagtctgggctatagagtgagactccgtctcaaacaaacaaagcaaaaaagaaaatgttttgaggttgtagaagttgtataaagtttgtttcataaaaatatcagattctttggttgaaatatatcataactcatgtattttagctggactacttagaaaaaaaaattgcttggtcagaatttaaaaagcataatactgaagcaaggttattttgaagtcttttgctaatatttttcaaactaaattaagtgacaacattccaaatttctcaaggtactgtatgtgggaaaattgtcactttgcatttagcttattagtttcatgaaaaatctttctgttaagtaaaatttttaagtatttgacagcagcctcgcactacaacaactcatgttgttcatgcaacgcagggcagtgagcaacctaaatcaaacaaaagaactgaaaactttatagctggaaaatgttttaaattcaattacagttttctttgatttagaaatatttaaatatttaatgtagaatgcttattaaatatgggactttcctttctggcatttccaagatcatggtactttcaagataaagatacaggatgtccaaggcctgtatttttaccttaaacaatcttcatggcaaatagtaatactcaaagaccaaccaaaaccttgcaaagcaaagtcattttaaaagaaatgataggatttgaagaaatatttctttcatggttctccactgcctaccaaatcaagtggcacctcttaactctgcattataaggctcccaagttctgttttgccagccttgtctccccacactctgggtgcacactctgtgtttcctaccagtacacttttccccaggatggttctcttcctagaatttctttattcactatcccatcacaacctgccacattttccactcactgaaatattgtttttcaaggtccctcaatactacttcctcagaaatgcctctttgaacctctgtatgccctcacctccatgctggtgccatttccataacctagtgttttccttgtattttacctgtgaatgtaacttagtcccctggcttagtagagctatgcaaatatgatcatctgtttgacccattctaagctatgtacttcttgagggcagagacaatgtgttaatttcctatatatttgtatttatatcacttgtatcgagagaagcaccttgctcataatgatcactaactaaatatgtgataaattggatacaagactgctaagaaaatgaattatgcatcttttcaccgatgtttcttaaagcttacttttccacttttattatttcagaatgttgacaaacaaactctgagatgtaacccaagacctgggaaggtaaggataactttctcaaactaagataaaggttaaacattaggtaactttcaggcttgaggaatttaatataagtgacttagataatgattttattcaaggatttaacatctaaagtaacatttgcttttgtatatttaggatatttatttctatgttctaggacattttagaatttaaaatacattctaaaaattagttattgtaactacttactgctatttactgtgttgcagatggttatctatgatctccatgaaagtacatataaacaagaagtctactgtaatattcctgatgctacatcatggtcttttccaaatggagttctaataaaagttgtaaggggctggtaagaagtttcttaaaattttatagcatattttcttaaattaaatgtgtcttcttgctgttaatgcttttttttctattttttattgaagtcatattctccttcctctacttttcgacagaagattttgaaacattattattagtgtgttataacttaattgttctttttatttactatggcataaaatacaatctgtttttagtgcttaagccagtaagttgcaagacctaatctatacaatcaataccattctgtaactacattattagcaggatagatttggcaagtttgggtgaatgcttcagttgaatgaagcatagctttgaaaatgagttcagaatttgtgggatgctgaggaatgtgaaggccacatagttaaagttgtttgtatagctgacttgctcaagaagtgaaggaatctttgtatggtctaaaaatgaggggcaaccctatctatttattatggaccatgacccatggacatgctggagccagaatttatctgtccagtgtttaggctacccaggtcagcattcatgtcttaaatcatatggtgtaatctcgtcttcatataataaaatgggacatgtgtcctgtgttattcagcaacaagaaaattagaagtataatttggaattgttgcactattgttttttatgcaactgtatagtttcgtatagaccacatctataaagagcatacatacataaatatagacatagaaatatattgtggtactatgttcagaaagtatttttatttccaaggtatatgcacttttattttttctttactgttcgcctgtacttaaattagcatatatcattgtttcaaaaaatagggttatatgctaatagtggaagatatcccagcttaaaaaatttaagtagacaaaatggtctgtgacttatatgccttatttcttagaaaattaaatataactcatcattgcatttctctttgtttagctggattttatatgagaaaccacatttccgaggtcagaaatgtgtgctagaagaaggggaaaaggtgttaaatcgtgactggattcttcagaacagaaggcatccacaaagaaactttatattgggttctctcaaacgtgtcttaaaggtaacaactgtagatttttctattttttatttgattttatttatcatatagtaaacctgtgctgtggcctggcgatgtttacaaatcattgctaatttttgtgctgttattaatcttcattaccatattgataatcttttgaatttatgcaaatagagtgaatggcaattaaaaatattaaccagaggtaatgtagtttataaaatgttacatgggccgggcgtggtggctcatgcctgtaatcccagcactttgggaggctgaggtgggcagatgacctaagattgggagttcgagaccatcctggccaacatggtgaaaccctgtctctactaaaaatacaaaaattggccgggcgtggtggtgcaagtctgtaatcccagctactctggaggctgaggcacaagaatcacttgaactcgggacacggaggttgcagtcaatcaggatcacgccactgcactccagcctgggcgacagagtgagattcagtctcaaaaagtaataataaataaacatataaaatgttacatgatgtactatatatatattttataggattatactattgctattaaaataagctaataggaatagtattctcctataatagtatactatacactatactataatagtatactactatattagtatgctactgctcctactgtaatactcctagtaatatataatagtatagtattggctgggcactgtggctcacacctgtaatcccagcactttgggaggctgaggtgggtggatcacttgaggtcaggagttcaagaccagactggccaacatggtgaaaccctgtctctactaaaaatacaaaaattaaccagatgtcatggtgggcagctgtaatcccagcttcacaggaggctgaggcaggagaatcacttgaacctggagggcagaggttgcagtgagctgagatcatgccactgcactcagcctgggcgacagagcaagactctgtctaataataataataataataataatagcagcacagtattacagaatactcctaattagtatacactgttcctaattagaagtatactattcaggaatcttagagattccttattgatttccagatatatctttttctagtgtagattgctactacttagtatagacgtgtgtgcatgcatgtgtgtgtgttaggggaaataagggaggattggaataggaagggaaggtattttttacttttctgcttagaaaatattaatactaagatgagaagggtcttccaatataataaaatattttgtaagaagttctgtggtagtatagaggaggggttaattagtgataaggacatcttagataaggacagaattctcctcacatgtattcttaagatttccttcataatatgtgatacagtacagttactcatgtgacagtaatggatatatgtagttttcaagttatggagatttcatttatatacataaaaagtataaattgagatgaaaactatcatgatgacttggattgttattattaaactcttgacagtggtctatagcattcagagaaattaaatatagcctacagaaaaactctaagttataaaggtgtctgcacatattttatgtgaatcaatactgtctgcaaagctgtaggcaaacctatatttaacaatatttgtgtctgcttttgagccaatactgtggtgtgcacagggaatagaaatacaagtgagatatggttccttacttcaggttgcttaaagactcggggagagcagctgagtcacatgattatatgatgtgagaagcgttctccagggcacacagaagaaacaactcacctttgggaagaggcgtgtcacctggaggaggtggcacctgtttggaatgttgcaaggactaacaggagttaagcagtctgggagatatgagggagttcctggcagagccacttttgtcagatacagaggtgagctttggtggcctagtatactgcaaggagattaagatggctgaagtggagagagcaatgtccattttcactgaaagatttaactgtagtcagttcagttctgcagataaccatttgagtgctcactctattaactcaactagaaattccttgaaaaaatgactagttagttcgtaactgaactcttctaagatttatatcacttgtggttttgtgctttctttgtgaaatcaggcactatgccaaggcctagtgggaaaaaaatgagtaatatatggcaaacagccacctctctcaccccccccaccaaaatcaaacaataaaatcaaacagatttaatctggtgagcatagatatttgaatggatatttgcacgtccaccatttgcttagaatatattataagaaagagtaagtcaggcttgtactttttcttctagtgtttgttctcggaatcattttttttttagttgcagtgttagttcgtgtgtctcgaacaggttaacaacttttagtgaggaaggaaaataaaactattgagcattgaatggaagaggcatgagccttgtttaaatattttacaaagtaataattaggcatcaaactgcttcctttttccaacgttgtcagaattcttcctatcgttgcttcactttcatggtggttgtttccatgacggattcacttctccctattctatgccaactttatcttgttgaatcatctttatattagttgttatattggtgtagtcaagactttaatgtcctttaaagatagttatttcatgatgtcttcactttagagtacaccacccaaacattgtttgtacaacacaatgcagaggaaatttgtttgtgtgagacagttagttacgtattttgttactgtaactcagatccctggggggacattaatatggaaatatttgaaataatgttactagaactctattattaatagcatacaaaagagccttgaggattgacaggtatagcgaataacctcagtaatcagtaattgtagattccagttaagggttgtctttgtacccagggaaaataattgggggtgaaggtagtagtgtggtgaatcttgattcaagtgctttcatttataaaattagaataaatgaatattgcaaattactatgtttactgtgtatttaaggttttttttaaaagatatgacatctttcttatggtaagatctgttgttagatgcaggactgaggtatcttatataaggtagagacaaatatattttcttactgtgtttgtttactgtgattttgttaactataaaactgtcttcattcttactaattgccataatagtataagtttgcaaatttcactaatatatttgaaaagtgtagcaggactacgaaagtatacaaggaagccatataaacttaaattgttttttgtttctaggttactttaaagtggcttgcagttgctcgtgtttgactttctttgtccatcaagaattatacatatgttttgcaaagcatgctatttctgtgaatagccaccgtgaagatagaacttaacagtgaaatctttttcaatcaactagagcaaaaattagttttctagtgaagataacagcaaacatatgccttctcatttttgtttattttcattttttagtgattacacttttgctattatactgtttccatctgtgttgttgtagacttgaatgcttcttagcttttcccttttagagtacaccacccaaacattgtttgtacaacacaatgcagaggaaatttgtttgtgtgagacagttagttatgtattttgttactataactcagatccctggggggacattaatttggaagtatttgaaataatgttactagaactctattattaatagcatacaaaagagccttgaggattgacaggtgactgttctaaacatttctgcttatttttgaagtgaaactttagaacgaagtatacttttatactttaaaggatattttagattatgcttctttactattttgcattttagaaccaattttctgaaaatgagatgtataaacttgcttgcttttgtatattaataagaatgattgagaattcagtttggggaaaagttgaaaaatcagactattatacttttagaattgcaaaacttaagtagaattgttcagtctcttataaatgccacctctattattacatttacctattaaagcatatgcatttgaatctcacagtgtcataggggataattactaaaacttgagttgtatcgagttctatcattaaatactcatgagtattgagatagtgtgttaagacagaaatgtacctgtaatttcagagaagggaaaaaataattgtaattttgattccctaagaagggataaggtctttttttgagttagaacttgactattagaagagctttttgaaagtaagaatacaaagaattatttctttagttgagataggggaaacatctgcaaagcctacagaggctggagtggaagtggagatagcatgaagaccaatatgattgcagagttgtaggaagttagtgtggatcactagtttggtgtcctattatagaaagacaaacagaaacatgaatttgatgtgcttgggtctgaagccaatgagtttcttgaggaaagtgatgttctaacaagttcagctgtctaaagagtagtagctagtgcttgactagtggttgtaagtaggcctgtaatcaaagtttgggcctaaccaagggctgtgacagtggaaatatgtaagaagagatatgcatgagggaaatttttaaggaaggtctcacaggacaatgggtgcatgattttttaagactgtgatggagtaaagggtcaatttcataatgcttttcttcttcaaacctactgcactaggaaatggagtcctacagggaggaaaacagatttcctttaccctcacctctaatgactatttcttttgtcaatgtaaattagataaacactgaagagggtactgcttctctacttgtttttttatatccccgatgagatcagcttttatttaactctcttcctcccttatggttttattatactgctaagaaggaaggcttacagacatttggcactcaaatagtttggtaactctgaaatctgaactcaatttggtaactctaagcattgcttaatggaacgaatctttaaaaaacaaagcagaaacattgagacaataatttttccataaaatttatgattttcatgtcattaacagctttttagaaaaactttttaaaaaaaaaaagggtgaggagaaacaatatttcctttatgttttctttgtgaagaaattcaactcaataatgagaacagtgtaactgtatgtccaggacattgagaagactggactgtgtgactctagttgatttcaaagccaaattatttttttttttcaggactgcagcattccagaaatagagcttttcccacaatctgacccagcctgttgtcctgtctacatacagagagcagtccccaatttggaagaactgaatatctccaaatctgtgtccttcactgtgaagtcaggagtgtacgtatcagttcctttttattatagtgattgatggccaccaatttcatatttcaatagatgacatacatttttctaaagtttctagctaatgtttatactctcagtcacccaagaaagactgcaggggttaaaagattctttggatctaattagagctttgatatatgactcacaggagcaggtatagaattctgagatgtagttcttgatatatggatctattgtcttttcatccaacaaattctgtgattgagaaataaaagcatgtccctggcctaaaattttggagcctgaactatttctagagtgtctaagttctgatagtcactgactgcctctgtggtatcaggcacatatggcttttttgtttatgactcctctgttcctgaaaggcagatggtgttactctcatattatatatgagtgatttgtcccaggctactagccggtaagcatggatttgatactaggcctctctggttctagaggtatctgttaggactatgggtctaagttcagtcttagttcattcccagattgacttgactccaaaccctgtggatatctggctcaacatgaaaccctctgctccctcactgtttttgtttactttgatgatggttggtatacaattctggggacactgtaggacaacatttttgtctcccccacatgtgaattagaacttgtgggcaggctggccatgtgtggtggctcacgcctgtaatcccaacactttgggaggccaaggtgggtggatcacctgaggtcaggagttcgagaccagcctgaccaacatggagaaaccccatctctactaaaaaaatacaaaaaaattagctgggcatggtggcgcattcctgtaatcccagtaacttgggaggctgaggcaggagaatcgcttgaacccagaaggcaggggttgtggtgagctgagatagcaccattgcactccagcctgggcaacaagagcaaaactctgtctcaagaaaaaacaacaaaaacaaaaacaaaaaacaactttggggtaggccagtaattggctgtgtccatgaggaatgtctgtaattatcaagcttagctggaagatgggtcttttgggaatccaattgcaaatactgttccttaggcagccaatagaactgatattgattctgaaaacgtggctcaaaatgtaaaacaccttgtggaatccctacctctgattgttccagtttaaaaaagaatggaatatagtgaaattgtttttgattttctaattatttcccacttgaattaaaggtgccacgtgttttaggtatcagaaaaataaaagtaatgcctaatgattggaaaatgtatcagacttattataggacagatagcttattataggatggataatgtgtgaatgtaaataacatggtaactattatcgttatataatgtctggctctcactttgagtgtgttttactagtgtaattctgtgatggaggattttgtttttttattttggtagccctttttacttacagaaccagactaaagcagtactattatactttaactaactatctatttttatatagttggcttgcctacccagatattaattttaagggacaagctacagttctggaggaagaccatgggctctttgagatttctacagcagaaatgaaatcattacatccgcttcaaatggtaagcaaatttaaaaagaagcattccttttcccaagtacccatgaatccaaaattaaataaccatgatgtttgctcatgcatctcaatctcaagtgaatatgtgtactactgaattggcaaactattgtactgtagtgccttcagtatttacagtatttcttttttgttacaaacatttacttgagtggcagactgttcaattaaacattggctatgtgataaaccatttttggttagtccatgccccttaaaaacatagccactaggacaaactaaaacattttaagaaatatcacaacgtggagtagcacttgaaacaaaaaaaactacagaattggggtttttgtaaggaaagagttgctttttatgctgtacaactttgaggtcacaaagacagtgcatgtgagaaaaagtgttggtagaacttggaaaggttagtgtggttagctcagtgctctaatttaaaaagcccaaataattgtagggaagacctttggattagctggctaagaaatctactctgctgaatgagatttctaagtttactagcaataccacttttctttttgggacactctgaagtgggattaaatcttaattggtcatgtgtactcaaggactaaagctcagtttccttcctcatagtagttgtaatctggaaagtgtatccttaagatttcttgccccatctacattgatgaggaacactataacttggttttggctactatagagttctgtgcttaaagtttaaaatttagcacaatttgaatttgactggtgtgtaatcttcactggttagatttttatgtaacctacatatatcactttcagatattacattcaaatgttttaaatatttacctgtctaatattaaactatcttgtcatcttaagggtggactgaaagtggaaatgcccatgaacttaaaggtaagtcttggactgatttttgtagcaggctaaagagtctcaggattaatatttattccaataattttgaaacattggaataaaaagtacctccacatatgattatacttagctaatggattttggggaggtgggaagtgaatgcacaaaatgtttgatgagggcccaaccctatggctgtgaatggagagtgggatcagtctgcaaagatggaggtctgtaccaataaatcagtcagactcactacattctgctacagggtggaaaggtgataggtttgatttttgttttgagggaagggacttgagaaagcagctagttattgaagtggagatatctagcgggcatttgggagtgatgctcaggaacatgatcaaggctgatcaaaaggaagtgtaggtagctcttatcaggtagatggcagtttgtaagtatgagtatccaaagggaaaagtagcggcgaggcaatgaaaatgggtagcagtggtgccaggatcaagcaaattcagggaaagaaaggaggaaacagaattacaaagtatgtttagagagagagagaaggcaaaccagtacagtgataaaagatgcaaacaggcctgcttgtaattaggttacagcacctccagaggcaggtatggaagcagggattcattcgtcttcctcttctctaaagcaagatgcaactccttcaactctcccatttctgggctttctgatttatggaactgacttccattctctcagccacatagatgtagtcttttaaaacttctttatctgagtgtatctaatatactttgactgtatgttggaattatacatgttggagtttttaaaaatgcttgagcctgggctgcactcccagagatactgtattagtttgggccgtggtcaacagtttgcaaagagtcctaggtgattctatttgcagtcaagatgtaaaagatgtacaattagctgtgaagctgtctgaatgccttctgtctcagtctcctagtctggtcaatcaggacttcagttgtgacaggctggatcttccttggacatttgcagtttgacaggttgtaggtgtatatgaatggattggtaatcacaatttataagttgtttgatattaatttgtggctttcccatcaaagaatttgtatttcttactgagtttgaatgtggtcagcatatgtaacatgtattaaacccaaataaaactttgtcatctcaaatatagtaccctgtgcaaacctaacatggaaaagtgcaggattggtactatatattgtttccctaatattatcagtttttagtcgtaaggaagctataaccttttgatttagtgtttttaagcatggggtttatttggcaagatattgagttgacatttgtgcacaaattattccattacccacaaataggaccaagtgagagaatgtggataaatgctgttatcacttcctcatacttaatgcagctagtatttgagaagtgaaaaaacagcaaaatagtaaaggagaaatactattccaatccaaatttgaagtaaatgccaaaaatttgtttctgacaatatgtattgcatcccctcaatttgaatcaaatatccaatctttagaaataatatttttcagtaatttcttattttttaggaagttttgtatttaaattctagaatttgcatgtctgtttcttctcaatgaatagtaggccatagaagcagttagcattgtaagaaacagtatgtatttttaaagtcaatagataatttattgttataccctggaatctcaagagagttctttaggggaaattcagtaagtagaaggaaggtctatattaaaattccgaacacagggatatacttataaagataattcaagaatcagttagttataaggcagtttaccctatgagatgatcccagtatttgggtgacccaaacaatgtaatcacactcaagtatattattgtaatatgagagaaacttcttattaaataagctattttatccttatgatgataaagactcacatattctttgtgaatatccaacattgtgctatactgtaagtatacatgaggggacttcaaaaagttcatggaaaaaatggaattaaaatataaaaataactatagacgttatttttcatcataagcttcgtcactgtcaagacactttcgtaagcagtcataccagctatttagttcaccctaaagaactgagggtcttgcaaattaactatgtcaatgcagtcttttttatgttattaactgaaggaaaatgggtttcctttagagtttttgttaagattaggggaaaaaaagaagccagaaggaggcaactcaggagcgtaaggtggatgcctaatgatttcttatggaaactcttgggaaattgcccttgtttgaggagagaaatgaatgggagcattgccgtggtagagaatgactttctggtgaagcttccctgggtgtttttctgctaaagctttggctaactttttcaaaacactttcataataaacagatgttgttctttggccatccagaaaaccaacaagcaaaatgccttgaacatcccaaaaaactgttgccacgacccttgccattaactggcctgcttttgctttgacgggatcacttccaccttttggtagccattgctttgattgcgctgtgttttcaggatcatacgggtaaagccatgtttcatctcctgttataattctttgaagaaatgcttcaggatctttatcccatttgtttaaattttcagttgaaggctctgctcttatctgcagctgatcggagcataacggtcttggtacctatagaatgaaatgtttgctcaactttaatttttgagtcgaaattgtgcaggctgaaccaactgaggtatctgtggtgttggctattgtttctacggttaatcatcagtccttttcaattagggtgcaaacaagatgaattttttcctttcaaattgacgcggatggtctgccgattcttgcttcatcttcaacatcatatcgtcccttcttaaatgagttacctatatgtaaactgctgatttccttgggatattgtcaccataaacgttttgtaaatcattagtgatttcaccattcttctacccaagcttcaccataaatttgtttattcttgcatcatttttagcaaaatttgtgttgctctgataggggcttttttcaaactactgttttgttcttcttagcacctcgaagtagatccttttcagatgtgttataacaagttagtagaagttgattttggtgcaaaaaattttgcaatccctgcatagttttttgtaatacaccttttccatgaactttttgaaatctcctcatattaattaaaaaaaaatagatagtagtccctgtacattttgtggtctttggtgtcacttaagtaaatatgtgtctatattaaaatataaacatgttaaataatttttcaggttattatttatgaaaaacctcacttccatggacaggctaaagagtttagtgaacatatagattctgttcctaattttttgaaaaataatggagattttcacagaattggatcaattcgtgtcattggtggagtgtgagtatcatatttttaacatttgcacaagtagtctgtttttgaaggtcagcacaaaaatgtgctaagcaaagcaaaaatgatttgtttttaatctaaaaatatacattccttctgtaatatggaaagtaaaaaatattagttacttatggttttctgtggactcttgtttgtattaaatattttgagatatattaaatgtagaaaatagtttctgaaactgcagcaccttgtatttctgaacacaggatagactataagaattgcaagataaaattaggttttcacaagttatgaacgtgaatgacagccccagtttttatccactattttgttgatcatacttgacttatgtaccaaggaccttgccagtgagccttcccttgttaaaaaaggatctgggttatgtgtttccaaagtcaaggatttttgacattggttgccctccgggctctgaactgcttttgaggaagctctctaggaacccctggatataaacccaagtgtaaccatcattgctaccatcgcagtcttagtcagcagttcctggggcagaagccccccaaatctgtgatgggcctgggatgtacctttatattcgtatcctggtaggtgaaacaatgaagaagaaactgtcctcattgtttatttatcattgtcaacccaatgctggaatccctctagaaacattctgttgtctctctgttgatacattggttattttggaacgttagtttgttttaagtatcagtatctcttggtatttgcagtaacatcatataattttgctaatagctactctagtaaaagatgctactaaaatattttattcacagaagttaaatgaattgtttaagatcactcaagggcctatatttagagaactagactttgcagtttccggcagtaaattaagtaatagccatactagtcacaataaaaatgtaagagattatatatgctggatatgtagattatatcaattattagtctgacatattaatcacttacttccttgtccttcaatttaaaaaatttattagggtcttgaagaacaaatatggtttggataaacacatttttattgtgttcatttgtaatattgtctggtttgtgaacacacatgtttcttgataaccctgctgtaaaatatttttgccttttcctcactttgagatctaaatgtttttcctattaactaggttgacttaggttaaaaccaattttctactgcacagaaaattatctgctaaaattctgtgcaatgtgcattgttattctctaagtttttttttaaatagctattttgtaaaaatcctaagtaaacatgacttgtaatgcaggatacaaactttcatttgtctgtgacatctgcaagagaaagatgtgatgtccccatttaaagaggaatagctgattatttttttcacaacttctaccattttttggttttgttatttaattgtatctgtaggtagcatggactccatccctgtaccaccttgaggaatctggggaaagtaaaactaatgtttcttaacttttctcagataatacctatctttaaatataccagatggatatataaattgaatcttaatcaaaacttagtctattaagaaaaactgagtacatgcttattggactgtcatataataaatttgcgaatcttaattgatcctttaaggtcttttataccttttattttttttcccattcagatataaataaaagcgtgttttgagtagccacacttatataaaataaagcttagaatttaaaagttgttttgtgaaatttattttcatataattgtttaagaataaaataatgttggttcatttacatattacagatatactgagatgtataaataggtttataggtttattccaattcatgtggaccctctgccccaccgtcatacctatacttacaggaaggggagagggagtaacaatcaatggctgctattttgtgccctatgaaaacaattatttggaatactttctgtaccttcacaaccacagtaggagtgaagaaagaaaaagcagtagtaggcagccctcctaggctttattttgtcaagctcctgaatttcaaatttcccaaccctggagctcagaaatagtcatccttggaatctgcactattggagggcatctcagtctaactatgcagtgtggctaagggcggatttgagaaggccaacttgttttatgagccatctatgcccacattgcattagatactgtggattagtttataaaaaggtaagttttatggaggagcttaataactcatggtatttatcagtgtcttgtactgatagttttagattagaagtcaagaaagtagtgggaccaacatttcccacctgtaagtatttacagatgtccttgtatacatgtagggccctgaagctaataatagctcagtcgaatttcttggttcctctttgataaaccatcttgtattttgttttagaactgaagcctcgtgacagattcgctttatttaaaccctgaatcaatgtttcatgtaaaaatcattttgtcattccagaatggcttaattagtaaaataaaaatgactatctttggatctctatgtaaatttgtatcctttctcattggctatatgcactttgtattatatttacttgacacattgttctctgaccaacttgcgctgtagtatcaagtcacaccacaaacatttaaaaagcattgctttgttgcagttctataattaaccttttgttgggaaaagcctccaaattataaaaattattgatctatgaagcacacaccatttgtctatctttataaatgaaacaaaactaatgtgttgctttttacaatatggagatgaaccactatgagctttatcttgattgtctctgttttgctttcttgactacagttttattaatgggtcatttgggtgtcccctgtatttctaggtgggttgcctatgaaaaagaacattttaaaggccagcagtttctgcttgaagaaggagactttgaagacagtaatgcttgtggtgcattaagtagccctatcttgtctttccggtacttacaagctgtgagttagcttccttatccttaattttctaccttttaaaaaatctgttcacaaaaattggacatgactcctgatagaacatgagattataaaatatttctaacacccaagagtattaacctcaactgcttatgcaacttgcctgtttttctgaactgccatgattattatggaattttttttaacttttcatccattgtttccgtaatcatcttttgagtaccttctttgttagatgccaggagtggccagactcaacccccacatttacacagcaggcagtctggtaaggaagatagcacttatataaatgtttggtattgcttggctatgattgtattaagtacaaagtactcagggtccccagaaaaagatcagttggtcagttatccccacttgaatagagagggcttcatggaaaagatgacagctggctgaaatttcaagttcaaaaaagagttaaccaagtgaagaagttctagaaacagggtgaaggaaaaaggtaggtgcctgtttagcaagagattaacatgttaatgtgtaaagtcaaggttataacccattgattctcagctgggggtgattttaccccttagggggcctttggcagtgtctggagacattttggattgtcatatctggagcagtggtgctactgacatctagagggtagaggcaacggttgctgccaaacccttacaatgtgaaggacagcccccaacaacaaagaattacacggtccccagtattaatagtgctgagattgagaaaccctcctgtaagtgaaattttgccatgtttagggaaatgtggttaagtcgggatgttagggagaactttggaaagatgaatctaaagtgagataatgaagggccatattgagtagttatttttattttttttttaaggagaggaccaaaaggaatatagcagtatttaggctccagggactagggaatttttattccttgacttcctcaataacactttattggtgtccttgtttttccttagttctatactagattaattttatatttgcttttgttgcgattttcagactttacgcctcttttcagatctttgacattgagttggtatgcagcggagaccattgtttatcctaaattaatggatacataagatctccaccgatgtctcatatcacattgccctctggagattgtaatgcagggactcagttgagagattttatggaatttaaaagtaatcaaattactgatccttaagacttatctttgggcctgaagcaattgctcagtggtgttctcttagtagtagggagtactgtacctgagattctactaacttatgcaagtgctttaaaatataaaatggaatacagtttttaaggttgttcatcattgttccttattctcaagcagaagagctacatttaaatctaggtgactttggaagttacttaattgtgtagaaaagcagcgatggtagtaatctagtaatctcatagggcttaccctggactttattctgttagtttgttaaaaactcttaattatatttaatattccatcaagtaacagatgaagtaaaaggcttattaaaccatttttttggacatacttacattgtttataatttttcactattgtaaataatgcatttttgcatacaagtttctcaccatttagttcccttaggagacttttcttaattcaaaaaggaattacagggtcagagagtgtgaacagtttcttttaaaactattttttaagtcattttctaaaatagatgtttaatcttgtttccatgagcaatatgttttgacaaaacggaacttttagatctttctttaagaaatgaaagttttgggctgggcacggtggttcatgcctgtaatcccagcactttgggaggctgaggcgggtggatcacgaggtcaggagatcgatatcatcctggctaacacagtgaaaccccatctctactaaaaatagaaaaaattagccgggcatggtggtgggcacctgtagtcccaactactcgggaggctgaggcaggagaatggcggaaacctgggaggcagaggttgcagtgagctgagatcacaccattgcactccagcctgggcaacaagagcgaaactgcttcttgaaaaaaaaaaaaaagaaagaaagttttatctaattgttttagtttgaatttctttaatttactaatgaaattagacatttgcatatttgttattttctctttcatgagctgtctttgtcttttgccggtttatctgtttgagtcatagagattttctatctttgttttaaatgtgttgactcactataaattttttaaatttcctctcatcattttaaattttaatgagcattttttgttaagcaaattatatctatttttcctattacatttaagctcataaaatcctgtcacacattgccacagtacactatttacttttgtttcatatagtttttattccttaggcacaagtgagactagtttcctttgcaattaatgttgcttgtgatagcctataagtctcagcaatttactgttgacaactttctatttatacaaaaatgtaatatcttcccaattaaagtaaattcaggctgattttttcctttaaactatatggaagtaatagctataaaattgtttccagggccatctaaaattcttcctggagttatttgtgtaaaaattaccccatcagtatgtgatattttgctagataatagcagtccataaaacagaatatgtatgttttcctaaactttcctctttctccttttagaattttatagaatcttctgtcacactatttgaatctgacctagaaagtgggaagtttattgacattacaaatcaggaaatttctgatttggaagaaattggctttggcagtaaaacaagatccattcatgttaaaagtggagtgtaagttgcctcctctaagaaccttgagagtctttggtgtttaagattgttgtttgctcaattgtatatcacttgtttttatttttttgttttttcttttttccctactagatgggttgcctaccagcaaaagttcttctgtggagaacaatacattttagaaaaagggaaatacaaatgcttttttgactggggaggatcaaataatataatcatgtcgatacggccaatccaactggtgagtgaagtatgaacatagccagtgctgcatcatgtaatagtatgcaattaaatatgtggaaaacactttttaaaagtggagttgttgaatgatgtcatgtgtgtatatagaaagaaaatgcaatatcacttgaatttctatagactccatagacagtagtagatattaacacatgaatgagatggctttgtaatttgatcagttcattcacttaacagcatttatttagtgtctctgatgtgttggacactatgctaatcactggagataagaattgaataagactgtcctgatggttctgtctcccaggggaaatagatgtatggacaattaatgatagtatgattagtgagaaaatgaagtgtgtaggcagtgcaggggagcagggaaaaggaacaatcagtgcctggggaattgaagaccttgccacagaataggatgtgttggtgaattgagtgatagtttaaaggataaaaccaatttttctaggcagaaagggcatttcacaaagaaggaataatctccttgtatgcaaattcatgaagttgtagaagagtgtggccagtttggataataaaccctgtagaacaataagagtgcccatgagataatgttcagaaattcacactccttctttgtaatgggcactaggccatatttttcttccacctacaatattacttaatatgaattagttataaataccaaaattattataagagaattcagtaggttatttgagatccatagccagttcaaagagtctcataaataggtcaaaccatgaaaaaaatttttcaagctgggtgcagtggcacaggggtgcaatcctagcactttgggaggccaaggtaaaacatccctaaagcctagtagttcgacaccagcctgagcaacacagtgagacctcgtctttacaaaattaagcaaaattaactgggcatggtggcacatgactgtagtcccagctacttgggaggctgagttgggaggatcgcttgagccctgaagatcaagggtgcagtgagctgagactgtgccactgtaccccagcctggataacagaggaatactctgtctcaaaaaagaaaagaaaaaaaaatttttttcaaagggtattttcaaaactttcaaaaagacagattatgtgattacaattttgaaaatgttttaatatgtttttcaggaaccacttgggataaatgaacctccgcatttggtatgtttaaaaatattcttgtaattgttaaattgtttactaaaagcatttataccctttctctcaaatctttctcttttctgcagataacttttatgtgtctctctggcagagcagattacaattgcatttggtacctatgagcagaagaattcacatctttgtcagtggttgtattagactgggtttgtcacacttccttttgttttctcctgacagagcggtagctctgaccactttagggtcattttgaacttctggcactctttctttcccatcgtccattatttcttcagtgtcacattcttcatagaatattatatttatttctggaagagcaaacttaccatggagaagtcacgtcttggcatgcttattatgtacacgtatttctaatacctataatcaaatatttctgagctagtgaacttgaaaccctatattcatttctactgtattaatagtttgaaggggactggacaatactttggagcccaacatttgcttattttctattgagggctagaaattgtgcctatttaacacttctaattcagaagtccataaggtcagtattactcccatttatagacaataaatctgagattcagaatacaagtaagtgctatacacacaactagaagtagcaaaagagacatttctagtatggaccgcacttgacaaaaccacatgttcagggttttacatcaaagaaagacataatcatgatacgagcagtacaactatagaaggaagagggggtgagagacattgtttcgttttattttaaattacaaattcagaaaaattgttgtcaaaaagccaaatatagtaattacttttaaatatttggcatttgctgcctttacataatgctcagtgtttttctctgaatgtgtgtgtttttctctgaatgtgtatgtttttcatattcatgtcagtgtttatttcagaccagcttagttttaccaggtttgcattcacaatgctttcgggttttattattttctgattagctcaggcctattgggaacatttcctttctgaatataattgagttgttgtatttagagacacttcctgccagatttttatgttgaaattttgaaaactcccaactgtggatttttaaagtattttttcacatgaatcaaaataacatgagtagatagaagaaagagaagttatttcaaactgcacattttttgagttctaagtacagataaaaagcctcattttttaaatctctgtttctcctgctcctacctccttgttctttttttatggacttccttgtttggggcagattgctgggaggattttcttgatagtatttccagtctaacttgaagagaggaagcagcagaaaacgcccagtgaaatcagctccacttcatttttctgggtatggctaagttattgccttgtgaaataagcatttctgacaggtatatgatagctggatatttggtaacacatgaacaaaacattcttgctttacccagtatcaaaggtcttgttattttcagtggaccaattttcagacattcttcttgtttatgcttacttaaacaaacagatcttggctgacacgctggttccgttcaataactagaaagtattttcaacaggcagtagttacaaaagtcagattggcaatacagatgctgtgttcagatggggtactaattttccctgaggaataaggaggaagtttcatttcagagctcaagtcagagagggaatttttttatgctggtgattttaaagggaacctcaagcaacctaagaggggaaaagccagaaaatgtatgtgtgtagggattaatatacattatgagtgttatggtgattaaaaatattgttgctgacctggaaacattatgatgagatatggcttatttgagatattggtggaacatcactttttattttttaattttatttattttttgttttgggattaggaaagttttattttattttaattttttgtctttatttcttctaaaaaaaaaaagcgggatacatgtacagaacgtgcaggtttgttttataggtatacgtgtgccatggtggtttgctggacctattgaccagtcctctaagttccttcccctcgcccctcactccccagcaaatcctggtgtgtgttgttcccttctctgtgcccatatgttctcaatgttcaactcccatttatgagtgagaacatgcagagaacaccaccttttattgagaagatttttttttcctgaagactgaaggttggtcgctatgtctaattagcaactcaagatatacaggatcgctatagaattcttcaccattagcaagtgactttttttaatttttcccccaaacaaaacaaaaaccaaacagaatatgtattatctgcatgtcgtcatcatctctcttacagcaagtcctgaatatctgaaatctagcactagattaaatcttataacagtgaatttagttttcagaggaggttgtagttaggcatcattctctagaaattctaaccagttctcccctttgactcagccaagtaccttttgtttctagaatctttttaaagtccatttccagatataattaaatgtttggatttatttaaacattgagcccctgttccattttatgcatgattctcaccaagaaaagcaactaggcgttttcttatattggataatttagcctcactgaattttaaagtgatcacaggatctgtaataattgttgctactgttttcatgtatgggggataggaaaatcacagctttaggcaaatacagtaagattcacaagcagtaaagagaaaacacttctttgtggcactttaaccagatcatttttataggagccaaatcacagaaatacttaggaagaattatttcagtaaagaaagcctttatggttaataagggaaatgaaatcattgtagaatatataaccaatatgagaaatatataacactacaatatgagaaagatgtgatgtaatagaagaatggaaataagacttttccttaataatcaacatatttctatgagggaggctcaaagggctagagaaagtcttatttagacagggaagaaagtttctcatagaaactattttagtattggagtaactaaaattacattaaaaataatgctgatattgtagaataagtgagcacagctgtgttttgtcagtagttcattgcatttttagtttgtcatattaaagatatatattaccacatattgttagtatataagtgaaaattatgtagcaaaaagaatttctgtaaaatcttcataatatagtggagataatttctgctcaatactggtagttctaagaaagaaatacaataatacatgtgaaaagcaaaccagaggaatactttttttccttcgcttccatttccagttggggagctgttagggattgagccgtaccaacatggcacagaaggatgggtgtagtctggaaaacactcatctcttatttgtcaatttgcctcggttttaagcaacctgagttgttttgtatatttgttatcgattgttctgtaaaggtagccaacatggtcatttatccagctagtttttccaaggactgaatttctccaaggctctgtccttaatttcaccaacagtagaaaccacaagttaattattataatcagcaagctcagagttggtttctctatggacaatcctcagaacattattatgagaattgttctattttgaggattgataaggtgatcaaagtgaggcatatttttgtagaattggtctaattctgggtgaatcatataccatatctcatctagtcaactcagataagcatttaacccagtttttaaagtttggacaaagattattttaacccatcaaatcaagagatactttataacattatttctgcgtgtgtatatgaattttaattgatttttccgggtatgaagactgagacaaaaaactggaggtggctactgtatataccatctgaaatatgcttcactggcagtatcagtagtccaggatttgatgtttcatggcttcattgtgaaaatgttgaagtataaatcttcagctcagcagtatacaactaataaacaaactgggaatgtagttagtgaacaagacaacctgtctctcttctcatgcggcttttcttttatttttattttttttattttttatttttttatttttatttttttttaagtttctgagtcttttttttataatcttttttttattattattatactttaagttttagggtacatgtgcaccttgtgcaggttagttacatatgtatacatgtgccatgctggtgcactgcacccactaactcgtcatctagcattaggtatatctcccaatgctatccctccaccctccccccaccccatgacagtccccagagtgtgatattccccttcctgtgtccatgtgatctcattgttcagttcccacctatgagtgagaatatgcggtgtttggttttttgttcttgcgatagtatagtttactgagaatgatgatttccaatttcatccatgtccctacaaaggacatgaactcatcattttttatggctgcatagtattccgtggtatatatgtgacacattttcttaatccagtctatcattgttggacatttgggttggttccaagtctttgctattgtgaataatgccgcaataaatatacgtgtgcatgtgtctttatagcagcatgatttatagtcctttgggtatatacccagtaatgggatggctgggtcaaatgatatttccagttctagatccctgaggaatcgccacactgacttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtgatgatgagcattttttcatgtgtgttttggctgcataaatgtcttcttttgagaagtgtctgttcaagtcctttgcccactttttgatggggttgtttgcttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttattgccattgcttttggtgttttagacatgaagtccttgcccatgcctatgtcctgaatggtattgcctaggttttcttctagggtttttatggttttaggtctaacgtttaagtctttaatccatcttgaattgatttttgtataaggtataaggaagggatccagtttcagctttctgcatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatactgttttggttactgtagccttgtagtatcgtttgaagtcaggtagtgtgatgcctccagctttgttcttttggcttaggattgacttcgcaatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggttctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaactgaataccctttatttccttctcctgcctaattgccctggccagaacttccaacactgtgttgaataggagtggtgagagagggcatccctgtcatgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaacagccttgcatcccagggatgaagcccacttgatcatggtggataatctttttgatgtgctgctggattcggtttgccagtattttattgaggatttttgcatcaatgttcatcaaggatattggtctaaaattctctttttttattgtgtctctgcctggctttggtatcagaatgatgctgccctcataaaatgagttagggaggattccctctttttctattgattggaatagtttcaaaaggattggtaccagttcctccttgtacctctggtagaattcggctgtgaatccatctggtcctggactctttttggttggtaatctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggtgttttgtgtctctatttccttcagttctgctgtgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttcccgttggtttcaaagaacatctttatttctgccttcattttgttatgtacccagtagtcattcaggagcaggttgttcagtttccatgtagttgagaggttttgagtgagattcctaatcctgaggtctagtttgattgcactgtggtctgagagatagtttgttattatttctattcttttacatttgctgaggagagctttacttccaagtatgtggtcaattttggaataggtgtgttgtggtgctgaaaaaaatgtatattctgttgatttggggtggagagttctgtagatgtctattaggtccgcttggtgcagagctgagttcaattcctgggtatccttgttgactttcagtctcgttgatctgtctaatgttgacagtggggtgttaaagtctcccattattaatatgtgggagtctaagtctctttttaggtcactcaggacttgctttatgaatcttggtgctcctgtattgggtgcatatatatttaggacagttagctcttcttgttgaattgatccccttaccattatgtattggccttctttgtcttttttgatctttgttggtttaaagtctgttttatcagagactaggattgcaacccctgcctttttttgttttccatttgcttcatagatcttcctccatccttttattttgagcctatgtgtgtctctgcacatgagatgggtttcctgaatacagcacactgatgggtcttgactctttatccaatttgccagtctgtgtcttttaattggagcatttagtccatttatatttaaagttaatattgttatgtgtgaacttgatcctgtcattatgatgttagctggttattttgctcattagttgatgcagtttcttcctagtctggatggtcgttacattttggcatgattttgcagcggctggtactggttgttcctttccatgtttagcgcttccttcaggagctcttttagggcaggcctggtggtgacaaaatctctcagcatatgcttgtctgtaaagtattttatttctccttcacttatgaagcttagtttggctggatatgaaattctgggttgaaaattcttttctttaagaatgttgaatattggcccccactcccctctggcttgtagggtttctgccgagagatcctctgttagtctgatgggcttccctttgagggtaacccgacctttctctctggctgcccttaacattttttccttcatttcaactttggtgaatctgacaattatgtgtcttggagttgctcttctcaaggagtatctttgtggcgttctctgtatttcctgaatctgaacgttggcctgccttgctagattggggaagttctcctggataatatcctgcagagtgttttccaacttggttccattctccccatcactttcaggtacaccaatcagacatagatttggtcttttcacatagtcccatatttcttggaggctttgctcatttctttttattcttttttctctaaacttcccttctcgcttcatttcattcatttcatcttccatcgctgataccctttcttccagttgattgcattggctcctgaggcttctgcattcttcacgtagttctcgagccttggttttcagctccatcagctcctttaagcacttctctgtattggttattctagttatacattcttctaaatttttttcaaagttttcaacttctttgccttcagtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgcctgggggtgcctcccagttaggctgctcaggggtcaggggtcagggacccacttgaggaggcagtctgcccgttctcagatctccagctgcgtgctgagagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaatcaagcctgggcaatggcgggcacccctcccccagcctggctgccgccttgcagtttgttctcagactgctgtgctagcaatcagcgagactctgtgggcgtaggaccctccgagccaggtgcaggatataatctcgtggtgtaccgttttttaagcccgccggaaaagtgcagtattagggtgggagtgaaccgattttccaggtgctgtccgtcacccctttctttgactcagaaagggaactccctgaccccttgcgcttcccaagtgaggcaatgcctctccctgcttcggttcgcgcacggtgcacgcacccatgacctgggcccactgtctggcactccctagtgaggtgaacccggtacctcagatggaaatgcagaaatcaccgtcttctgcgtcactcacgctgggagctgtagaccggagctgttcctattcggccatcttggctcctcccccttcttttatttttttaaagatatttctatgcaggagaaatgtctctgcattttttggaggttaaaagtgatttgctttttagcctcacattttatacatctttaagttaaaaaacctaagtatgtcttggtttggacttcatttctttgctatcctctatatctgctaggactacagcagaaacttgctggatcacatctccttaaggcaagaagtcccttgatgttttaatcctccaaatacagtgtggtttcacagtaggaagtggtgttgtgcaagccacagatgatatggggaagtagttttctcacctccctgattttgactgatctttgataacagatcaagtaaggtcagagcagaatgagataaccaagaaacaattctaagtagaggcctttgggaagacgagggaggtgaacattagctgctcagaaaagccttatcctcgatgacagcatgagcagatggtttgttgtgatgttctgtgccctagtgcaggcctgtcagtgcagggtggacctgtgggccatgttgttccaagtctccagtgtgttatgaaatttttacgggctctttaatttttttcattcctattgtagattcaaggctactagagttgcagattattatatatctggtctaaagggaattatagttgagatttcatggatttttcttgacaaaattgactaaagtagacatgtagttgtatataactgtaagctgcacatttaaggtattcttatcagaaaaccgaagcctgtaagctgaaatacataacacagatatctttctttcttcaccagaaatcttccactaatcccgtcattattatctcctctgccatctgcttctgtgccctcctgggcactcttagtgcttgcttaagggcatgtgctcgtgctctcctcttcttatattaactgtggatcaggaagagctagggagagaagcagcataccatgtagcctcatactaatctaagcctctttcaggtttagcactaaattgcttcttattttatacatctagtctcaacatagggcataatgattttttgagagaataaaggaccacatgttagtggagggaggactctgatgtactcttctaggtagaattgatttctaggcctctcttcccacaatttggtggaagagaggcaagaaaatggtaaacaaacagtgacattccattcctgaatacatgtaagaaagcaagtttaaggagcatatcattatccctaacatgaattcattgataatagataaaacatgagtctgatattttgctgcattttataaattcatgaaattaaaggtttttatttgctcgtgatcatctaagaccattttttttctatttaactgttgtgttgttgttcttgtagctcaaagcattcagcaaaccagggttccaaggtgaatgtatagattttacagaagaaacttctgatttgacttcactcatgccatgttcttttaaagttcttcgaggttggtaagtatgcttacttagtggtttctgctgttatttaataactaatacttttaaatttacagagatatattttttgcatgcacagtgaatccttaaaatttatcttcaacaggcattttacctgctaactggtctatattaattttgcttaatttgtattttgagctgtgatggaatacagaaaaacagaatgctgattaaccaacttagggaacattttgatttttgtctctcactgtgatctcagattatttcctaaatattttgaatgtttatattgtatatttaccgtctcacatagtagaatgctataaaaatacctggtgtttttattcaagtaagacatattaatcctaatttttttaaccttttaacaaagtatttatcatccccatttcacagatgcagaaaccaggttcagagttaaggttttccaagatcacataccaaatttcagacccatgattcctttggtctttttttttctcatctctgaatctgatattcttccaatggcaacaatatactgtatatttttcacgtgtatatgaaactacatgtgattcccatggctaaaatatattctacaatttttttattgtgctaaaatatatgtaacataaaatttaccattttaactatctttaactgtacagttcattggcatctctatgtatcaaacatctacctaataacctatcaaagtctctcttttcttttaaaatatcttaggtttgtcagttttcctcctttctcccttgaatcattagagacctgggccttctatttttcacttgaaaaacttcagtctcttaattaccccctgcttcagtgtcatcttatttctagtgtttaccccaaacaaatcacagtacaattatgtgtcccaaaatccagtttaatatttttactaatgctttaattcccagccgttttctagtaccagtccgatcaagttcaagctctttcttttcttgaccttaccatcaactagcctcctttccctatccatttcccatcctattctcctctcttctaacatttgctttcctccgtacccactataccaggggtcagcaaactttaactataaagaatcagatagtgaatatttttgactttgtgggttccacaggctctgtcccagctactgtcaacactgctattagatgtagcacaaaagcagccatacacaatacacaaaccaataggcacagctgcgttccaatgaaacattatttatggacattgaaattttaattgtatgtaacatttacatgtcatgaaatagtcttcttttaaatttttaagccctctgaaaatgtgaaaaccagtcttagcttataggctgtttgaaaacaagcagtggggcagatttggcccacatgctgtagtttgctgacacctgtttcataccaaaggttggaggtctctggtaaatctagccagcaggtgtcatttgtttgggctatacactaagttaaaaaaattgtattaatacttacgtttaggatatttttcagaagaagctgttttccaccttctctttaaaaatcagaagattttacgacttggagaaagcttttgtctttgtcggtaattagctggtagtgagtagattgcatatgtgctttccagcataccataatcaccaccattcccaatttttttccacctggtacactactcatctgcattacctgtgtggtctcctgcaggtatataagcttgtgacccctgcttaataataattcagatatattctttaaggttcagtccactctattatttctgttcaccttcttgattaaccctaaatcaagcagtcctttccttctcctatttcctatagctgttctgccttgagcctccttgtatttgtttttgtttatatacttacctctgaaaaggaaatgagagttttacattaaaacacataaagtagggcagtataagttaaatagagatctgcaactctaataagaaatacacacacacacagcaaggacctgaaataattttgttactattatttggctctaagttccttctccactaagataaaagaaaatattttacaagatttaggatcattgttaatgagaagcattgaagtttttctggaggaaaatgtatttttcttgacactgaattctaggacaaactagtcacacatgtctcttcatgtaggaaacatacaacagcaggataaaagaatacaagaactatggccattgtgtaaacacctggaatgtgtgagagacctggatttgagcccagttccaccattttctagctatataactttaggcaaaatgagtcatcgctctgaacctcagcttcctcatctgtaaaggaggggtaataacggtacctacctcaaaggtttcttacaagggctaaataaaataatgcactagctttatgcctggcacactagaaacctttgataagtgttgattatgaaatgcttattacattagaagacatgacagtaaattataatgtcacacagcatttctacggttttccaaagttaaactggtctagcaagagtgcagttctggtgatcttaaaatacagggctagaacttaaccacaccaaaactaaattagtaacagccatttaatttttcccttgggctccttcttttcaaaaggctgtgtttagcaaacttttgatgaatgctgtattgaagataactcactattgaagattctaagggatttatttctttttaaaattttccattagttgtcagatttctaggtgacaggttttatatactcttgtgtgatttttaaaacaatctgtcttctatactcatctaaactgaatacaaacatttttaatttttcccaaaaagaacttataatctgttcaggtacttaataatcaccctaatctaatcccagagtgctatacttgaaggcactaaataaaaagaatgtctttagcttaaagcacacattgtcttatttcaaatttcatctctatcattgagtagtttgaggaaccatgggaaaatcaccttacctttctaatccttacttttgctgcctataaaaatgaggatgttcctaactcatagaattattaaggacaccatgaaatagtatatgtaaagtgcccagcctaatgcctggcgcatcataagcagttgaggaatgatagtggtagctgttgtgttttttgtttttttaaagctggtgtggtggtgctctgcaccactttctatgccctacccctaccccaattcccacagcatgataatgagcctatactgccaagtgaatgcaatttgattgaatgtcttactgcttggcttttagctggctcctctattaccaagaagacatgtttgttaatcactgtgtgttagaagaaggcctctatgctgaccttacttcctgcggttgcccagcatctaaagtcaaatctctcaagcccattgactatgtaagtactttgcaaaatgcatacttataagattctttttcttgtccagtttaattaccaccaatgataatgtgaagttggaagaaatgatacaaggagaaatataaaaatctgaaaaatatgaataattcatttgtcaatcgtaaaactgaggttcattcatgaactccaacaaaaatgtaatattctccttttttaaaaaaagcagaggtgtaaaactcaagaactagaataatgtaggcctcaactcccagtttgatactttaatcaatttgagtgacattggcaaagttacttgtttacccatctgtaaaaataaaaataaaataataacaatagcacttacaaggccattgggatattaaatgagatgatgcttataaagtgcacagcatatggtgagttctcatttaaatgttagctattagtaccatggttgttattcttatagctgcttaagtataaaaataacctgaccactttattattctactaggtaagtcacatgacagtttgtctgctactaaggttaactatgttactttaaggcatgggccaccacagatactaaattcaaacctgtttttgggaaccagggcctttctgtctggtgtgtgcagaatgatctgggtcacctctgaggcccatatttatagagtaagtaggttttcctttttaccacatttatttagaatttcaaatgtgagataaatgggatcacaactccaggacatcaattctgggcccctagtcaataggatctgtgcagaggaggtagtgaggatctgggatactttcaagatatctaattatgacaattccttggggatatgtttggtcaaagcttcagttttacacagagctgattagaaactctacataatagttgcagtaactcaaacctttctgtcagagctgactccaaggataatagccatactcaggatctttgatctcaacctaagcaatgtagtcctatttcacaaggcattcctggatagagtattcttggtatcagactaattatagagtcttggctgagaacaagaatataaatagtgttcttggtctctctcagtggctctgtagacaccaacatggaaagaataagtggctactaatacttcttgtctgttggaggaaaaatggtttaaaaaaaataatgtgatctggcaagtctctgcagtctttgataatgctggaaaagacattggaaggtagtccatgtttactggaaagcaattttttaaacaatttttagtggccaaatcagcagaaagatacttacttggtgttaactctaaaagcaaaagatagaggtctaaatttgaaagtactatcctgaaagggttttgtacaactcttaattcagtgaactaaaccaacaaaatttctagggagggcattttagaagcagggtcaaaattagtgttactatttttctttgaagggttataattcctttagattcatgaagtgtaaaatgaaaaatttgggatgaaaataaacagagatgttttcatgtaagttgtcatgtggagtggcatgtccctagttttggtcctgtttttggtcctagtttttatccaggcagcataagtgaaggtgcctattgggaagtacttgaaatctatagacttttcacttcaagaattggttaaagaatatattcagtttatgtaagggtagcatgttagttatcttaatgccattcataatatactgaaaatatttaaaacatcttttgcgaagatgtgttatagcagcaggtttgtgggaggaacatgagggagtttggatatcctacaaagatctgcaaagtgaccatgaagacacctcaacaggggtcccaaagccttaagttgatcagacctagggagattgctatgtaaaccagaaggtcaatttagtgttttgtaataagtggattctagtgactggaatgctcgaaaattctgtcctgggcactttttccccctctctggaagaacaagggaaactgaattagtcatcaggaggttatttgttgagcataagatttgggtaaaataaggtagataccttgagattagcctgtaggctaatgttcctcctaaaagagagtccttttactctctaggtcccagttgctcacaccctccagattctgtctcatttccctggacagtgctagatacactacctattctgcttctctgattcattctgattctttctgtgattctccccactatcttcgtagttaggaattgatatgccttttttcgtagatttcctaatactgctgcctatgccacaatccagtgtaattctggattcattccaggaaatgtttctgtgtaattaagttgacattatgtaagtatgaggtaatcctttgcttttgcttttgttagttaaaactgcagaattctagggatgttgcctgcagttggtattcccagacatgctatggcttggtgcttaagtgtcacaatggtataatattgagaagtcttaagatttcatcttcatagaagataagtatattttgaaaatgacagtgtgctccaggctaacttctgttggtacaggtgaaggttacattctagaggggcattgacacatagtttgcagtgttgcagtcattttatagtgaatggagctaggagtgtagttcatagttctgcttctaacgaatatgaccttaagcaaatctcttaatttatctgtatctcagttaattcttctgtaaagaaactgttagaacaggtattttcaaatcatggacagcctccagttctgttgcaaataagtatcctggtcatatttctaattggatatgaaaaagaatttatctggctttaggattcacaaggtcagaaggaataatatcatgtattagctttcacaacagtctccagaatcatagtggtttaaaacaaatgttcgtttcattttcatattttatctcaaaatggcaagacagttgcatggcctccactttaggcttgttagttggctttagatacacttttgatatatgctttgcattgggaccaggctaatgggagcacctccaattggggacatgactattttcatgacaggggaaagagggagcaaggtcacaatcacagagtcacatttgaagcttctgctcagattcattttgcctatgcacacatcattgtgtccactcacattctgtttccaaaagcaagtcataagaccaagcctgacataaattaggcaggggaatagactctcacttgggcagggatgaagttgacaaagtatattcaaacaataatacaatctatcagagatgtataaactcatagaggtgttctctgttactagattttggagaaaatgaaaggaggtgaaattttaataatttatctctgccactgtagcagagctaacttccttttaaaaacttgagattaatttttagtgacagtctggaggtggtttggtggctctcaaatgaagtatatggtagacaagtacaaaagtctgcctcagaatatggtccccagttctctttcaaaattcatttagaattctaaaatcatcaggtaatttaatatagggaaatttaatttaatcatactaagacagctctatgtaagcatctgggaaaaataataacaaattaggtggcctagaattaggaaagtgaactaaaacccagggttttcatcaggctcttctcagagatatatatctggaaaaattacatgactaataataggcctaaatatctatctcaaaacatggtgaatgggtttctattgtcttctctttaagtttttcagtagccttggtttggtaatggcttgattgcttaacagtgattacaagaagaccttttaagatgaaaaagattgaatatcatgcctaaggaagtttaagtgttttgtgggggctgaaaccaaagccttctatatttaggagtaatcatactgggtggaaaagggcaataaaatgattaaaaaaaaaaaaaaaaaggcttaggatgatgcttggggcgttggtgtagagttccatgaatgaaaaacacatctgattagtaattttgtagaagaaagtttaaaggtactccattttgctttgatcaaagaaaaatatttaaggtggctgaattctttctcccatctcagcctccgaagtagctgggactacaggtgtgcaccaccatgtctggctagtttttgtgtgtttttttggttgagatggggtttcaccgtgttgcccaggctggtctcaaactcctgggctcaagggatccacctgcctcagcctcccaaagtgctgggattacaggtacaaaccactgcaccgtccagctgaattctttatataaatatcacaaatgctgcacaataacaccattgctgaagatgcattttatatttattcaatctaaagtattgaacacctgctctttactaaatactgtgctaagtactgaatatgaattaaaaaagaattagatggcataacaaactcatcaaatctaagtgttatcttactcttggtctctcaagtgtagatgtttctcagatacctattcttggcctttcctctcctgtacttagaaattttcattatcataacatcagctcttacctccatcagtgtagaagatttgcagatatctagagtaagcagtactcagttattccctgagcttcattcccagattccacatgggtcttcagcatgttttgccagcatcccattttccttcatagacttgttcttcttttctgctctgtttctgttgaaagcaatcatcattacccccctccccccactttttttagatagagtctggctctgtcacctaggctggggtgcagtggcaccatcttggctcactgcaacctccgcctcccaagttcaaggaattctcatgcctcagcctcccaagtagctgggattacaggcacgtgccatcactcccagctaatgtttgtatttttagtagagacggggtttcaccatgttggccaggctgttctcaaactcctgacctcaagggatctgcctgcctcatcctcccaaagtgctgggattacaggtgtgagccatcacacccagccccatgatatgtcttaagcttttcctcttatctcctttccattgtcatgactaagtttagagcctcattctgtctttctaaaactgttgtgatgggtacataagtaattttcttcctttggcctctttctttttcagttctttttatttgcagcattgagcatgtagccttcccataaagcccagaccatgacattaggtcctacttttccaatattattgctcaatcattttcatgtatcctgtttacaagctttccctcccccctcccaataccttccttaaactttctctattttgtgtttttatgtggaaacatagaatgaagtttttctttcccctctctaaattctttgagatctaatttaaaggacctcaattctaggaagccttcagtgatcctcatttcttaaagtgacttttgtctgccttaatattctttctctgcatcttaagatgcttttcactttctccttttcatcacagttactgaaactgcaaagccattgaggggatgatttatatttattgtagctttgaattctgtcactcttatgtcccctctacttagcacaatgctataaaaatatcaagagtccattatgtaataagctgactaaataaactcattcattcatgcctaaaaatatataggcagtagttgtataaagttcattcttctacttcagagctcattccataagaggggttgtactttggacttactataggtttgtgtcttatccatttacaatattataataatagctttagaagttgggggatggtggggaacctaagttgaaaaaatggtaatttccagctgctagctattgatgaaatgctttaaagtcagactgggtattaaaagaataatagcatatatagacaggagcaagatacatgagaacctgttgattgatctaaggtggagttaactgcgacttttcagactattgcataaaacatttaagcgctggaccaggagtgtgtagggtaacctattttattgcatttccatgggagcagtagttagctggttgcttctctaatttccccactggggccttggaatggaagtttggctgcctttgaagtaataatccagccctggcagctccaaggaggcaaaaccaaagaaacattataacaagaggctgtagaaaaacttcagataaaattaagactgtgataacataaatgatcttaggaagtagaataagagttggcaagacaatgattcattctgtagaaggatactgaataagaggcacagctacaaatagagggagactataaatccagcctcagaatgaaaggaaggaatgagtttataaagtgtagaagacaaaaattaattcaagatggattaaagacttaaatgttagacctaaaaccataaaaaccctagaagaaaacctaagcaataccattcaggacataggcatgggcaaggacttcatgactaaaacaccaaaagcaatggcaacaaaagccaaaattgacaaatgggatctaattaaactaaagagcttctgcacagcaaaagaaactaccatcagagtgagcaggcaacctacagaatgggagaaaatttttgcaatctacctatctgacaaagggctaatatccagaatctacaaagaactcaaacaaattacaggaaaaaatcaaacaaccccatcaaaaagtgggcaaaggatatgaacagacacttctcaaaagaagacatttatgcagccaatagacaaatgaaaaaatgctcatcatcactggccatcagagaaatgcaaatcaaaaccacagtgagataccatctcacaccagttagaatgacgatcattaaaaagtcaggaaacaacaggtgctggagaggatgtggagaaataggaacacttttacactgttggtgggactgtaaactagttcagccattgtggaagacagtgtggcgattcctcaaggatctagaactagaaataccatttgacccagcaatctcattactgggtatatacccaaaggattataaatcatgctgctataaagacacatgcacacatatgtttattgtggcactattcacaatagcaaagacttggaaccaacccgaatgtccatcaatgatagacgggattaagaaaatgtggcacatatataccatggaatactatgcagccataaaaaaggatgagttcatgtcctttgtagggacatggatgaagctggaaaccatcattctaagcaaactgtcacaaggacagagaaccaaacaccacatgttctcactcataggtgggaattgaacaatgagaacacttggacacagggcagggaacatcacacaccaggacctgtcatggggttgggggagtcaggagggatagcattaggaggaatacctaatgtaaatgacaagttaatgggtgcagcacaccaccatgacacatgtatacatatgtaacaaacctgcatgttgtgcacatgtaccttagaacttaaagtataataataataaaaaaaagtgtagaagaatttggttactattaaactttttagctgaacctatatatatagttaatggtattaactattatgcacattttgaaaatgcaggccaacaaaaacttacagtaaacatcacacttcccagtgagatatctgaaacagcgctctttaaattcaggcagcaggcaaaggtctccctattaccactactattcggtattctgaagttctatctaataaaaaaaaatctaaaaaataaaataagattaaaacaaaaaaggagaaaacaaaactggcaagagcatctatggtgtaaatgataaattattagggctaaagcacatttttaaaagttgcagagtataagataaatagcaattaaaccatagaaattaagggtacttataaataaatctaacacaagggaataagtttttttcctaggaattttataaaaactcttgaaggaagtaaacattgagagatacaatcttttataggtaaaaggactcaatattgtaaagatatggtcttccccaaattaatattgtttcaggcaaaacacagtgttctctccttttagggggtagaggtggggagtaaaacatggcaagcttatcctatgattaatttggaaaagctattgggtcaaaaatcgccaagataatttttaagaacaacatgtagggtcacttatcctaccaagtatatattgctttatacagcagtaataattagtgggaatcagtacaaggagagacaaatgggacagaggaatagggtagcatggaaactgacctatatagtaatggaatttggaagataacagcattccaatggagctatgatgaactgttaaataaatggtgttgagacaattgacccattccatggaaaaagatagttagaatcctactttactccaaacacaaaaataagttccagatggattaataacaagctaaatgtgaaaagcaaactttacaacttagaagaaaatataggaatctaccctgatgatactgcagtaggatggatttcttcaaacagaaaaagcacaaatgaataagaaaaaggtgaaaggcaaatgtattagtgtcctattgctgatgtaacaaattactgtaaacttagtagcttaagatgacagatatttacagtcttgcagttccacaagtcagaagtctgaaattggtcttactgtggtaaaattaaggtgttggcagtcatttcatctgggaagctctaggggagaacccatttccttaccttttctagcttctagaggccaccagcattccttaactcatgaccttctttcatcttcaaagtgcatcactctagtctctgctctttatctgctgtctcttaaccctcctaccttcctcttacagggaccctggtggccactttgggcttacctgagtaatctagatgattgtgcctatctcaaggtccttaattactaatatctgtaaagtacctcttgaccatgttaggtaacatattcaacatattcaccatattcacaggttctaagaattaggatgtgaacatttgtggggtagggagaggaggcaggcattaattattcagactgccacagcaagccacagaatatatttgcagtccatataacctacaaaggtttagtgtaccgaatataagaagagctcttagctgggtgtggtggctcacatctgtaattccagtgctttgggaggctgacctgggaggactgcttgagttcagaagagcctggacatggctggtccctgtctctacaaataaataaataaataaaataattagaagagctctttcaaaccaattcagaaaaatccacttcaaaaaccaacagaggatataaataggcagtttatagaagagggaaaaatggctcaggacatccaaaggatgttaaccctcactactgatcaaggaaatacaaattaaaacaattataaataacattagcttactctagctacaggcattttaaaatctgaaaatactaaggtttggcttagttgcagggaagtaagattattcatatatagctagtggaagaagtgttaattacaatggtggggggaataagaatgtctgttgcagctatgatggatgaaacaaataaccacacattcctataagggaatgaaatatagtagttacaatgaattggacagctacacgtatgaagagtcaaatttcaaacacagtaggcaaggaaagcaggctactaaagatgttacaatagaatacattttctgtaaattttaaaaacaaaagatgcataaccattaatagaaacagaaaaacatgagctgaaaagatttacaacttgagcatagtggtcacctctgggggtggtgggagtttaaattcatctgtatttgctatgttttatttattttaaaatgtgatacaaatatagtaaaattaaaatgtaatacttctgggttttaggtatatggtcatctatgttattctttttaaaatgtatcataatttttttttaaataaggagaaaacaaagatcagtaagaaaggtaaatccatgttgaaactgactttctaaaccaaatgagagaggctctatgagaaggattatagtttactggtgaagagtttggtttgaatgtcttagagaccttcttggttcaagtcctgactctaccattaataactgttagctgagtgaccctgggcgtgtttctgaccactcattctatgaggccagcatcattctaataccaaaacctgacagaaacacatggagaaacaaaacttcaggcccatatgcctgatgaacaaagatgcaaaaatcctcaacaaagtactggcaaactgaatccagcaggacatcaaaaagttaatccaccacaatcaagtaggctttattcctgggatgtaaagttggttcaatatatacaaatcaataaatgtgatttattacataaacagaactaaaaacagaatcctcataattatctcaatagatgcagaaaaggctttcaataaaattcagtatcccttaatgataaaaacccttaacaaactaggcattgaaggaacatatcacaaaataataaagagacttatatgacaagcccattgccagcatcatactgaatgagtaaaagctggaagcattcccttgaaaactggaacaggagaaggatgcccactcttacctctgctgttcagtatagcactggaagacctagccagaacaagcccacaagagaaagaagtaaaaggcatccaaatagaaaaaaagggagtcaagctatctctctttacaaatgatatgattctatacttagagaaccccatagtctctgcccagagggtcctagatttgataattaacttcagtaatatttcaggatacaaaatcagtgtagaaaaatcagtagcatttctatacaccggtaacgtccaagctgagagccaaatcaagaatgcaattccattcacaatagacacaaagaataaaatatctagatatacagctcaccagggaggtgaaagatctctacaatgaaaattacagaacactgctgaaagaactcagagacaacacaaacaaagggaaacactccatgctcatggataggaaaaatcaatgtcattaaaatggccatactgcccgaagctatttacagattcaatactgttcctaccgaagtaccaacattttttcacagaattagaaaaaagctattctaaaattcacatgggaaccaaaaaagagcccaaatagccaaggcaatcctaagcaaaaagaacaaagctggaggcatcatgccacccgatttcaaactatattacaaggctacagtaaccaaaacagcatgatactggtacaaaaaacagacacagaggccaatggaaaaggttagagaactcagaaataaagcctcacacctacaaaaatttgatctttgacaaagttgacaagaataaacagtagggaaaggactccctattcagtaaatggtgctggaataattggctagccatatgcataatattgaaactgaaccccttgctttcaccatttgcaaaaaataactcaagatggattaaagactaaaatataaaacctaaaactgtaaaaaaccctagaagaaaatctaggaaataccattctggacgtgggccctggcaaagattttatgaggaagcccccaaaaggaattacaacaaaaacaaaaattgacaaatgggacctaacctaaagtgcttctgcacagcaaaagaaactatcaacagagtaaacagtcagcagaatgggagaagatattcacaaactatgcattcaacaaaggtctaatatccagaatctaaaaggaacaaatcaacaagcaaaaaacaaacaaccccattaaaaagggagcaaaggacatgaacagacacttctcaaaagaagatatgcatatggccaacaagcatatgaaaaaatgctcaacatccctaatcagtagagagatgcaaatcaaatacacagtgagataccatctcatacaagtccaaatggctgttattaaaaagtcaacaaataacagatgctagtgagattgtggagaaaagggaatgtttacactggttgtaggaatgtgcattagttcatccactgtggcaagcagtttggagatttctcaaagaatgtagaactaccatttgacctagcaattccattactgggtatatactcaaaggaatataaatcattctatcataaagacacatgcacatgtatattcagggcagcactattcacaatagcaaagacatggaatcaacctaggtacccatcaacgttggactggataaagaaaatgtggtacatagccaccatggaatactgtgcagccataaaaaaagcagaatatcgaatatgttctttgcagcaacatggatgcagctggaggccattatctgaagcttattaacacaagaacagaaaaccaaatatgtaatgttttcaattataagtagaagataaacattaaatacacatgggcactatgaagggaacaataaacaccagggcctgcttgagcagagagggtgggaggagagtgaggattgaaataccacctattgggtactatgcttattacctggcgatgaaataatctgtgcatgaaacccctgtgacatgcaatttatccatgtaacaaccctgcatatataccccagaacagaaaataaaagttgataggaaaaaaaatgaaaaaatacagttctgcaatccctaaactgaatgtattttgggatttaaagtttttcaaattttaaacagtaatatgattcatgtatggcctaaaaggaaacacacccagcagggttctggactgtacccctaattaaacatatttctgttcctatagtgaaatttatgcacagctacacaaattgggtagtattataaatagacttcaatttattcaggtagagttatgttgactaggaaaaaaatttttgattttaaagctttttggatttcagaacaatgaataaggtattgcacatatatatctatggatggatacagatataggtatataacttagaacaataattcccagcacatattaagtgctatatatgttagtttctactgttattatcacttaaattatttaaattattattttagttgatgggatgaggaggaacaatgagttttcttcttttgtattgaaattttcatttatacaatttggtcgagtattctttttctttgacaactacatcttccttttagaaactgtatcctctttgcatgatttagacttaatccggcaggaatgtcctgttaactgctgacatctaagaagagcctttagccacaaatggttggccagcttcaaagttaacatggactaaggcgaagacatttgtggagctcaaactgtaatcaaatatttttttttttatgcttggaaagttcggattactgtgtcatcttcagttttaaagattattaatagttgatctctcttcctattttcatgttagggaaatgtatcagaaaaatatgattttaaaatattaatagttcttcagtaccctttatttccaaaagattattaaccaccccccatcatcctgcccaggttagcactgtgttgactttcctaatcttcctaacctttaaatacatttataattcaagtatacttataaattaaatatttaaattaaaataaagtagaaaaaaatcaaagcttcaaaaacagtagatgttctcaaatgtaaaatttgatagttggaccacataatgatatccttttgttgtttatgagaggtgggatatttttccacgctggtttattagctatgtctcttctttggttaatgctattggcttaccttctttgcccatttgtccaataggtttcttagagtacccttactaatttatataagctgttaaaatgtttcaaatattttctgtcatcttgtacaatttttttctcaatatccctgcatcattatttttaaaaacatagatgtttacacattttttgttccctccatcaagctttttatcttttcttgagatacatttctagaggtagaattgctagaatgatgggattgaatttaatggcgtttcagtgacaataccagcgttttgaaaaatatctttgtaggcattctgcaaaaggaagaggaaaaatgtacacaggtcaatttttcttagaataatgcttagcatttaaattactttctcataataggcttctagattttttccccctctgggatataaaacagttaacatcatgtaaccagtaaatgcctttgatgtagatgtctgttgctcttaccccagccagctcttctctggggagagtgctgctgattgttgacttggagcactggccaggctccttgccatctgttcttcctcactaatcagtaactcaacaagtagatgtgtgtaaaaaggtaaagtggaatactttctaaaaatcttgagagtgaagatgttgaaaaaaatccaccaatatagtcagggctgtggatttttattgtctgcttactttcagtttattttataaactgttgggatgcttccaatttattttgcagatagcagaagaggtgcctaaccttgcctgtggccactcaataactcagtgattagagatgagtttttattcctggtgcagtcagtggtgtctactgagggaaaatcaatgctcctaggtagcctgtccatcttagcttatggtctcactgcacacagcaattgttacattctttgccagtatcctctaactcctaaatctgtactgtccaacaccatagcactagccacctgtggttatttaaattaattccatcccttgatcacacaagccacatgtggctagtggctgccatattggagagtccagatacataacatttctatcacttcaggaacttctggaagatgctttaaactttccttgatcagcagacagtgttggccacataacgtaaagagaaatttattcacacatttcctgattttaaatggacatttctgggcatcctttttatctttccttttatttcagaggtggagttcatcctttccaaagtgatctttttcctcatgaactgatgggaagcaatggattgtacctctccctccttccctggaacatcctttttgccttgcagtattcagcttctctctattccactaacgccttccacaaagcatgctcataggccactaccccgtttccctcctgctcttcaccaaatttttctaatagtctgtatacctttatagcctgtacagtttctcaccacttactcttcagcccttacaacctagattttaacttcatttctgacatggtgctgaaacagcattcatagggttactagctgccttctgattatcaaacccaaacagccatatctcagtcaccctctccctcgacatggaaagaatttgatgccatggggcaagtcttccttataattctcttcctccttcacttctacagtgtaaatgggttctgttttggctgtcttctcctgattcatttgttcagtcacttccacctcccatgtttcatcatcgcccacctgtgtatgtcagtgcagttctagtttccttgcatttccattttcttatccatggctctagttattacccagattctgagaattcccaaacccaacatctctaaacctggtctttccctggaactccagatcaaaaggtccagtatatgttggacatcactgttaagattatcctggctctatctcaacattaagatatctgggcatgctttcctcctgatttctttatatataaccgattataccagcatgtcccaagccatgacttttcacatttttcctcacttactgattccatttgtttgccttaactagcatgtctgttttatcactgtgatattaatagtcttcctggccatcctttactcctaaccttccccctaacccctgttttaggtctgggtctatttttctctgacctcatatattgcaccagtactgatgccgttacttccattctctctgttcttcacttatactgttgtcagacagattgcctgaaggccattaaaaaatacatatacacaatgccaacgtgtaataattaccaacttaaaattaataataccaatttaaaataaatattcccatggttcaaaagtcaaaatataccaaaaggcacttagtgaaaaactttgcttccacttgtgcacttgtgccctttatcttctcttacacagtcttcccaacaggcagccatggttaccagttttttttattttttagaaaaattttaatgtgtgtacaagcgcatacatatgtatgtgcacagaaattttccttctctgcaaatggtagtgtatgaaatacgtttttcataccatcctttgtgtttatttctaaacaatatatcttggtgatctttcataaagagctccccattcttttttacagctgtatatgattcttctgtgtatgaaccataatttatgtaaccagtcctctcctgatgggcgtttaaatcattccacacccttcactgttccaaacactgctgcaaagaaaaactatttcataattcatccttctcttatgcaagtataagcaggtcccttgtgagggtcactgtgagagcttgttattttctgcctgttcatttattgttctttgaccctccactgcccctgctgctagtgctttgcttcttatctaccgagttgcagttgcttcagcccactcatagtccttagttcagaagcttcaagaactttccactgggaatagatctgtctctgtcctgtcagtgtgggaggagaagcaagcagtgcaatgcaccataacaaactgtgggagcacttgccgctgtttcctgttgggctgatttgccgttcccccaacatgtcccatgtgtttctcttgtcttgctttgcacagaatgttttccctctgttcaccatcttctttccagatccactgcatcctttgagactgagctcacaagccaccacatccatgaagcttgattcctgctcccttctgctaaaaataatctagctttctactgaggactctgacacagcatatctttttctgcactggattacattacaatatctgtacagttttaatttaactatttgttagtaattccccagacacaaggatagatggtgccttgttttatcatccccccaaaagtctcttaacatggtgtcttgcatacattaatgaatgaaaaagcaatactgagtctattcttgtctgacatgatgggttgaagaaatacttttaatgcagaaatcaccaccattcttgtgcatttcagctttttttaaattaaaaatgcctttattcttcctcctaggaatatttttaagagcttaccaccacagagtcttacattcctagtgactgctcctgtgacctcctagaaattagggtgccattccattccatatttattctgttgccagctaaaagcattggcaggactaattatggtccatattacagtaccacaagaccttaatctgtgatttggaatcatgggtctctttattatggctgtttttattatgagattgattgcttttctgataacttgaattttagtttacaaaaaagtgaacaaaaattattaataaaatctaatctttccagtgcagttttgactatagcaaccttagagagtaaaacagtaaactccatgcatttaagaatacaatggattcagggtaccctgtgttcagactgggatgtcactgagatatggccactcctatggtgacgctttctttttctgctaataggtttttgaagaaccctccatcagcctttttgctctggagcattgtgagggaagagagttacatctagaagaggctgtgaactctgttctgaacaaggacctacacttctacacccagtctgtgtgggtaaaaagtggactgtaagtatgggaaaaaggcttggtctggttcagttactgttttaagacagagttgcagagttgcaaaccaagtccactgtgtagtagtacgcattcaagtggtcttgaggaagagccctttggaagagaagggctaccatatggtcacagcatgtgtcatagagtaggtcaatcaaatgactttacccagttgaactttcttttcagaagaaatttcaatatcccagcaactttggttaagacaatttcctgcttaaggcaagtgactgctggcaagaccaagttcgatgttgttttttgatttaatagccatgtattctagagcagttcctccagggtactcacttgcctgtggactacactggttggcctagcctgcctaccagtattgttgttcatttaggttatcagtcagtcagggtagacccaggggcctgtgcttttacaaattagaaagctgcctttaagaaaaaatttaaaattatgatagaaatattagatatcaatgtgaatacttaggacagaaatggtgagaagcctgtaagtgaggggccttgaagttgaagctctgtttgcttcctggaaaatctgcctctgaatccagttctgaagagtccggcatataaaccagcccctactcctgcactgttagtgttctggtagcaaaagtcaactaaaaaaacacacatagctcttgacggttaataaaaaaatggctttaaaagtttttctatggctttgaaattccgtgataatcaactgtgctggtttaaatatctggggataaagagaaagccaataatataagtggaggtgaaaattaagcaaactattataataaatggcttttatattatacacttgtataaatagcttaagttttcttctgcaaaacattttaaatggtttgatgtttattcagacaaattgatttattctatctaagcataagattccaatatattatttaccaattaactaaattttacatccctgtgatataggtctttcacaacattttaattcatttcttcccatttctgagtgaaattgatacttgactcacttctgaaaatttctcactttcttatttcatttttttctggaacactggtgccattttatcttgacattcttatttcttctctttggcttattagccacctactctcactattccaaattctctttaagagaattggaacatggagtaaggaacagtgaaggctgcctaaggattttcctaggttacagaatactacttaatgtacagccagcttcccttagttacaagttgggtttgttttaatccccatgctatgccacatctttgatctgtgatgatgacagccatgcttaaatgcaccatcccacacagttttccaactgtggaattcatttaaatcaatatataattaggtacattttcctaaaatcttacctagattttataactgaaacttccctgacagtttaaagaatctgcagcgggagaggcagctaagcctgtccgtggtcatgctgacctgcctctccaccagtctgattgattagatttgtgtaggaaggaggggtcaagaatgggccatccatctcattcatctctccataatttggtcaagtctgatcttggttgtggggagcaaggaggacttttcttagtggtggtcaggttgagtcagtcatccctacccaagctttcatagctgtaatacatcaagctttcctcagctctccccttctccccacaacttatgctcaagttggtatcttttcctgcattacctgaagaacaagtccctaaggaatattgcactttgtgaattttagaagtttttaatctggaaaatcgaggggctgaagttgctgccatagcagcacaagcaaccctctgtagcttgtgtcctaagccctggatgaccctgttcctgagctctggtccatctgataagcagactaccttgcctgctgctggtgctctttgcttcatccacaaggctttacctcccttggtgcaagccaggacaacccctgccacaattccaggtgctttatcaaaataaagcaaggcagccatctcatcctgcacacactttcttaaagcactgtgtacactgaccttgagtcctgctgagaatttcaggtgctcttagtgactccagcacattctctttagtcatcaagcttagtaatcacctaaggtggtgcttggcagactttttctgtaaagggccagatagtcttttcagtttgtgggtcatctgtctgtgtcatgactactgaagttgctatggtagtgcaagagcagccgtaggcaatccttaaagcaatgggcatgactgtgttccattaaataagtcttgagactccagtgtacttttacacactttaatgctgccaaagttgaaggcaagggtttcggggaggattctcaaaggagctgggccttgaagagggtgatggagaacttctgtgaacaattctaagaagtcttggtggctttggggaagctgtggagggaggagtggaagaagatatgtctggagagttcactggagccacacttagaggccctgaaggacatgtgatggtgactctaggggcaggagtgtgattttctgctggttaataggaggttatggtctgcctttaaatgttataatgctatgacaatgttatcaaagaaatataggatttcagagatggaggaaaccttgcattcattttggaagaaaggaaaccagcattgtaactggaacccaaatcttctgagtctaggccagtgggttttctcctatacctccctgatttttgttaggaaaaaatgtgcaattttaaaagtctgcaaacctagaagtttatgaaccctataaggcaaagtgcagatacttttgatgagggatttttttttgttttgaagtacactacttttttctttcttgttctcatagatggatagcttatgaaggatccaatttcttgggaagacaaatcctactcaggcctaatgagatcccaaactggacagcattcagcagatggaaaacaattggttccctccgtcctatgaagcaggtaaggagaaaagaaccataagattccaaatagcttgcttttgtggtagaaatgtcataaaccacagcatctgaaataatgatcatttaatttagtttgccatttacatagtagggggagtgaattaggatgcggatatcttgtacattttaaccaatttgtaagattgtatctaaagtcaacattggatttcagttttcagtccaaagcctcattggccatgttcacttttcgtggaaaactaagatactgtaagttctgtggcaaaccttggtaacaggaatgaactttgatactgtactagttttaatttctaagcatttggatattcccctccctacttatataatactcaggatggatcctggcaatttaattaaaataagtatttattgcacacctactgcttgtcagtcttctgttcaaaagcttcccactgcacttagaatacaatctacccgctaccccaccttgcttctccaacctcatctttcacatggttgtgtcacaggcatcaaagtacagagtggtttcccactaagacttttaacatgggctgcaccctctgtatcgtgttcttccctcattctttatttgactagtcatccctgtaaattctacttaagtgtcaggtcctcaagaatgcctcccccaccttctctcccaatctacattagatcataaaagacctgggggttctttttctacaaaaacactgtatgcagtttataaccctagcgttatggttggatcggggtctctcccactctatagaaaaccctgtgaagtcaaggactgtccatgttttgctcattgctctacccctagtgcctgaaacaatatctggaatattgtaggagctgaggaactatttatttaatgaaggaatgaatatatcagtggatggatcaatgatattatgcaaagtataatggaaaatataaagatagatgcgatttctgccaatattattaaagcttacatttttgttgggtaaaacatgtccaactcaaagcagtaacataaaatgcaaaacaatgcataattatccaaaagccacaggcagtccctggttcagagaaaggaagtatcaacatgtgtaggagtagtggggaggtttcatggaaggtggaaaacccaagtgaaactgtcaggggtgtgatggcccgtggatatggcattagtacctctctctaatctctttagaacactttcttgcttgattccaacaacagtcctttgaggtaggaattattatccccattttctagttggaataataaggctctgagagaagaataaggctccatctggaaaatggggataatgattcctacctgtgacaataaaagcacatcaagtgtcagaaccaggatttggacccaaatctactatgctttaaaatctgtgttcttaagcaaccacactctactttccatcagcctaagatcagcacttagagagtaccacctatttcaggcactgagctgaatatagcctagtggatctaaatgctgaggctctgatgttctgacctgacacttatttaacccttacttaagtgttaaataaatggtagccaataaaatattaacctaattggtcttctctcaccctcttcacatgcacacatgcacacatgcacacacaccattctcatcccaccactcatgagttctgttggttcaaatcctggctctgccatttgtaagcagtgcagcttggtgagtcacttcatttcttggcaccttaggtttctcactggtgaagcagtgatcacattgcttacatctcattgctgtgacggttgaataagataatgtatatgaacagtctgatatggctctggctcatattactatggtaatacacttattttgaaaattttttattattattattattcacaatgtcccttgagatgctcttttgagggatactgaaacattaatggctttcctggcacagagtgtgtggtagacgatctcatgacctttacatcttgcttattccccactcctatcatgtggaacagggagtaagcccactgaaaagccatcagaaaaagcaaagtagagataggaattcagtttagcttttactaactacataataatgctgaccctctgttgttagagactttagtagccaagttcaacaatgaaaatatgttcctcattttttaatggtggttccttgttggggaagaaggatgtccctgcctattgttcaagattgtctggtaaaggatagaacagccacctctacttttacaaggaagttttttttaacaagaatagtatgctattttctttcactgtgcgttaggagctacctgattcctattctgattaaacatttaatttcaaaataatattttaatagattatttttccttttgtttatttaggtcacagttttgaaatccaacaaaggaattctgagtttctaaaatagtagtttgtgggtcacatttaaatttgtggtaaggctgttggtactgctttggttcatattcttgtttagaaattcaggactaattaaaatgtgatcctctttgaggctgggaattaggaagtcactaaggtacttataatgtatatcagtgtttttaagtataattacagagcagtcagactacaaatgtgtaataagggtaattagtaccttgcctgagttaattgattaaaactgtgatgtctggtcctaaagtaattggaactctgtcatctgtgaaggtcacgcctgttttcttatatgtacaaggtaatgaaaatgtaataaagatatactgaagcctcaagaattaataattgcagtagatccggctgaattatagacatttaagtacactactgttgcattgttaatgttggaagtagggatttgaaacatttaaaacattttgccaagtagagagcttgttcgcctggtttaaatggccagataatttgtccttctattggcttaagtgctgagaatgtgtatttccttaggaaggtttaattaccaaaattcagttagcttcacgttgatctatcaagtttcaaaaacagtagactgttcattggttctcttaccatatgacctattgcatttacctaagcacttatgtttcttagcatgaaagtgctctcttaagagaccatttgttattactcagccagggttctaattgggatggcaatgagaagaaccaaaggtggggatgttgggtgtcatgttgggtgtcatttattacattaaggctggaggcctaagtcatagggctgaaataatggcttctgttgtgcttccattatgtgccctgctctttcattgtcctacactgccacctttggaattcgtctcttattccctgtgcctaagagcaactagtgcatttcaacataggtctgagagcatcctggttaagaggaacctggcttctttacatctgtgttcaccttatttgtaaaactagggtataattgtactttcttaataggtttttgtggttattctgacaaataacataatggcacagaatgcatttagcatgctgcttacacatactacgtgttcaataaatattagctattctccttagaggcaagtcccaggtttaatattttaaaactttttgtatgtatcttaaaacttccaggccaaggggatgaagtcctttgttacacaatttttgagtacctaagtatagtcattaaacatacatggtctctacttttgaagaaataaaggtcttatataaacaaataatcacagctactagtgccctcagctatctgggtttttcaagacctcccagggccaacttatggcatttagtcatagctccacagtatgtctttctgaagtttttagaaaatccttgtaggtaataactcccctacctccctcagcacagctgggacacactattgaatgaaactcatcaagtccctaattctttaccaccccactcctcaccacatggaattctagtgaaagaaacttttacttcatgctgttcaaaagggcacttttcacaaagtgtaatagagactgtacaatttaagctttatgctccacggcctaaggatttaccatattaatctatgcagatttactaaagggaataagagtgaaactgatataactaagatagttacctctcactttccctcccagctttcctcctctggaaggattcatttccagattcaaaagtttatttctaaatggctgtttctcctgtcatagcctgcagtgtacatcagaataaagaaccgtgcccagggtgaatatctgacagtcactggaagtctagcagacaccagggcaacatctgtgtgcatttctccctatagtggaaagaatactcagatctggtactactgccgaggactctttaaatccaaggtaagcaatcccactgatacagtatgccactttctggtctgttttttattttgaaaactagaatcctgtcaaatcaactggcatgataaaacaatgcaacttcttagaaacaggtgttgattataaaaatactgccatatattactaaaacatttatataaaattaacttaattttttgaacaagaaaatccagtttcaatttttaagtaaacacaaaggttatcacatattatggatatacctaagtgattttttacaaccaatggtataagtcaccagatctaagttggacaatgtgcttttgtaagatgttccttacttgatggcccagataaaatcagccatctctgtgattctaaatatgttgaaacctttcattttcaaagtatacaaagaagcagtagaagaagaaagctgttattggaagaagcttagaaaataaaatttagggttcttttctatgacccttccgttatgtttaatgcattgggaatagaacactactttaaaaacattcaaactgtgttttattgtatcaccaatggattatctactttttctcatgcttcaaaaatgaaaaacttttaaaagtaattattgtctggatatctttagcccatcatgcaatgttttcataagaaaaccaagctcaacataatacgttttaagcaaacagggatttaacatttaattccaattcaccaaatctttattgaacatctgttgtcagatgtagacatcctattaaaaacaagtacctctatttcagttggtttatttctgtaccatctcctacccacagccgtaaagaagacattaaaaaaggcttactgaaattatactatatagtatttttttagataagacacacacacacttcatgtctatgacttgtttacctaagataaaagggacctaattcaacttactttagcaaacatactactgccaattaatcatttcttaacccttttaggccagtgatacatgtcttgatgtgattggtggccgggacacacctggagctaaagtagctctatggactgaacatgggcaattcaggcagaagtggagactgaataaaaatggaactatcagctcttatctcagtgatcaacttgtccttgatgttaaaggtgggcctttgatgatacccaatgttgtgtccctggatattagtttcagttccaaatctcctcattttgggtaaaggacatccttatgtataagagaaatgttaagtcatttaaaattatgcttgaagaaaattaagataggcagttttacaaacaaaacaattagcagaaaaagccaaacaacaaagcttagggtttttgttcattagtacagttgtaaaactttcatttgctacgtgaactcagaacagttctaaatttcaagcaccataaaccatgaaatgaatgtcatctgtttcttagaaacatctctagctttttgccaggaattgccatggtccttaaaaaccctcaggtagaatttatggtaggtatcaattaaccttgtttttgaattcagcaaggtcagggccaatattattcatggctgttgctttaattgggttagtcacagttttgttggtgtagaaacaaaaacacagtacctgacattcagccagagttctctcaagagcactttgttctaaagaatcacattaaggcacgccacttatacaatcatgtattataccttttagtatttcaatttgagtcataataaggtccaatttgaggtgaataatggctaagcctgttcaaactcagcttcccatttcagacttctttgtaaatgacacattcatccaccgaaatggtgagctgaacagaagcttgtgaaaattgtgaaattgctaagcacctgcctgaacaaataatcttttcttttggaatttctattttaggaggaaattattgtgacaagactcatgtaattgtaaatcagcccctggagggagaagaaacacagaaatgggacattgaaatattgtgagagaatcaacatccctagaaagatccctagaaagagcaaagaaggaaacacatctgtcattgtcttgtggacgtggaaaggaagctactgtcctcacactcctggatcactgagcagaatgaacattttctccagcctctgagactatcgctcttaaccatggaaaagctcaaaatattcttgccattactcagtgttcctataaagaaaatattatgatatcttggaaaggttctattcctgatctccagctgtggtgagcaagtttcctgaagtgtttattttctctcatatccaccaaacgtgaatcctgttcctgatggcccgttattggacactggtgatgctattatcctgtattatttattaatatcctacctagatgcttgtatgagtacaaagcataaagaaacagatttctataggtcaagtcatacttttgcaaacagatgagtaattttttagcaacacctgaaaatatactaaactttcctagataaactttaaggtttctatactgaggcttttataatgaacgcacctcgttaagtatttatacttgtaactaaccccaggcagggacctcagctttgttaggaataaggcacaagaagtattttctgtagctattgtttcctcagtccttcaaactaaaaaagtacaaataaataacctatggccaaacttgcactgttacgtgttaaccaagacatccctttaggtgacaagactctataacagtggttacctgtctccatgttgacacttcatcctagatttaaggagaggcatcaatttttttttttttttgcctcaagagaaatttcaaatatccaaattaaaacacagtagcatttgaaccttgaccttaccatctctttaagtaaacgtggagttgatttctctactaaataacagaaacctcagtttttcactcccattgtaagtaacttttatttaagtaagtaaaatcaggtaggaaatcacctttgacttagcttccagtagtcattaccaccttttactgcacaattcacaagcatgttttcctggtgaattggactgaaaattacattttgacaactttttttccttttatccccaacttttgccagaaagcagaaaaatgctctatttttataaagaaagattaaattctccaatgatattttaaaaaatatcaacctacatgcactttagaatgtaaaataacaatgactattttaaactcgaagacccactattttgagtattttttatagactttaaatactgggtttttttcctccttcaatctcaggcttttctccatcttttaagcagcctctgtaactcccttttgtccataggtgttgcgtgcctctcatctgtggggaagtattatttaataaaatttatgttacaggataactttattttaatgggcatgggcttgtctatacacaaaggtatgtatattttcattataaaaaaccagtttaaaattttttcttattttaattgtttgaaatttttctagagccaaagaagctctttaaagaagttgtttcttccaaagaacaaagccaggttaatgacattcaattctaaatgatacattggaattgtgccttttctaccacactggattaaataaacttgtcaaaatatgg

SEQ ID NO: 396 - DNA, 101439 bp, Homo sapiens
cttcaagatgacagggcgctggagaaaaggctgctggaatcagctggtaggtacagtagtaacccgagccccacccaccggctgcctttgcttgctcaggtttctccggtcactcctgccaggggagaagacatgtaaacgtgcctccagaggaagggctgggggagctgggagtggcgggggcggcggaaggtgagcctgggaaggtggccgagcaccccttcttcttgggcccttcccagtgctcccttggggtgtcagccccagccccgtttgcccccactccgcctcccttttggaagggattgccttttttttcctctgcggcggcggaaatgacagtgtggtgctgccgtggtgtcatggtgctgcccctggactgaggggcgaaaactcttaagtttagctcgggaggcccagctgcggtagcatcgcggccgccgtgctgtcccctgcggggcgcgcgggctggcggatcccggctgctgcgcggcgtcggcgacggtagcggcagcggcggcgaaggcgggcggcggcctacagtggtagcggcggcggcggcgaccggggcccgggagctcgcgccggagcccgagccaacccgctgcggaggcagacgagagcccagcgccctcgagcgagcggaggagatggctggcacctgggaacgctatgggtaaaacgcgccccctcgccgcggccctggaggtcgagcgtcgtagccctcgcagggctagtctccggctccggccgcttttcaggtgccgccggggcccggcgttggccgagggctctccggctcggcgaggcagggtgatggggcccgcgaggctcgaaacggcgacgggggccccagctcagctccggctctcagtcatgctgttggggcccgggttcctgccactgccctcctgggacggagtttgcactccggggtgcggggcgggggcggccgaggcctctgcgcagcctggccgggcccggcgcgggcagtcgagcgaatcccccggcgcctgggcgcgagtctgggaaagggcacggccgccttcccacgctcccgcagccggcagcctcctcggcccaggcgtcgccccttggccggccgtctgccgggcggtgctgtcgcagcagccggcgtggctgcggacgccctgccggcggggaggcccggtgaaacttaatcccttttctgccagggagcgatcctcgagtctccgtctggatggttccttatttctggcctagctgtgaaatcagctctgtgggggagagggaaaacttacatatgtccacaggacagactgcgacgcaaccagggagagtggggattttccattcctgccttgtaagaattaagtaaataacggcggagtagatttacagaaacattactggtgatgataaggtttaggttacttagcacttcgtgtgttgcacattatttttcagaggtgtttcttcttagagcaggaaattgaaatcctgcagtcgttgtactctttactttctctcttccacggtcccctacccgttttcaggatcactcaccttcctatgtcacaacgcttacttgcctacccaaatcccccagcagagccccttggaccccagcctttccccatcaacgtgtgcactcccagcctcccagccatgcagcatcttacttctcaaccactttgcctttttgaggatttctgagtgtggggcggatagatggtgatggttgtgtgtctctgaggatgagcccttataaaggaatatattggaaactaaatagagaagtactgtgtgtgggttgatccctctgattctcaagttgggccagaagggctgcctttaaccccattctgctccgtcccagtactctaatcagttctctggcaatattccaatagaagggagttgctgaatagggagttctcctcccctacttttcttctgtttggggagtggtttcattgtaccccagatggttagcttccccctgcccacccccgaccctcacatccccctgtctgtctcctctcatgactgtactgagggagaaactgtctttgctatttttatatattcttgcccaatcaatgaacttaacatggatatgtaatgtgaattagatttttcctggttgctcctcacaacttgatttatgtgtttgttatagtttggatatttatccctgcccaaatcttatgtacaaatgtaatccccagtgttggaggtggggcctgatgggaggtgactgcgtcatgggaacagatttctcatgaatggtttagcaccatcaccttggttgactgtgagtccttgtgatagtgagtaatctctcctgagatctggtcgtttaaaagtgtgtggcacttccccccagctctctttctcccttgcttctgctcacaccgtgtgagaatctcctgctccccattcgcctccctccatgattgtaagcttcctgagtcctccctagaagcagatgctggcatcacacttcctgtacagcctgcagaaccatgacccaattaaacctcttttcttttcttttctttctttcttttctttttttttttttttttttgagacagggtcttgctttgttacccaggctggagtgcagtgtcacattcacagctcactgcagcctccacctctcgggcttaagcaatccttctccctcagcatctcaagtagttgggaacacaggtgcatgccaccacacccagctaatttttgtattttttgtagagatggcgttttgccatgttgcccaggttggtctggaactcctgaggtcaagctgtctgagggcctcgccaagtgctgggattacaggcgagagcgacaatgcccagcctacctcttttatttataaattacccagtttcaggtatttctttaaggcaatgcaagaatagctaatgtagtggttaaaacacaggtccaggagtcaagaagatcagagttcatcccaaatatgatgatacattggcttatggctttaggacattcctatgacttttctttcatagttggtgcacttgtgtaaaagctataatattgtgtactgggtattgttagtcttgacttggtcctttgaagatgaaagggttctgtaaaccctcagcattatactttttttttcctttgagacgaagtctcgctctgtcacccaggctggagtgcagtggtgtgatcatggcttgctgcagtcttgacctctctggctcaagcaatcctcccatctcagcttccttagtagctgggactataggcacacaccatcacacccggctaatttttgaatattttgtagagacaggattcaccatgtttcccagtctggtctcaaactcctgagcttaagggatccacctgccaagtccaagtgttgggattacaggtgtgagccaccacacccagccaacattatacttttcaaagaaagcacttcctttaccttttactgagttagtggattgactgggtgtaagcaggaatcttagcttactgaaaacctttagcttcccacccccagagccaaatcgtatcattgtacgtaggtcctaaatctggtttttctccaatacatgttcaactgaatgaaaacatacatgcaactaggcatacagagtaataatgatcaatttaagttgaggcttgaatcatttctaatgcactctaacctaacaatctgagtcagactaatttgaagacataacctcacccattttttagcctatatgggggcagtttgttagcttctaatgaaaagtgtcataaataatttggggtatggctatataagcatgattagcacctagtagcagagtcaacaatattaagcacctataatgtgcagaggacctctgctgattgggctgaggccccagatttagcccagtattttggcctcctgcttgttccacgccaaactccatacttgcaactccaggattaggtcagggaggggctgtgcaggacatgggtagaggctagggacatgaaagggtggttgtgtccctcttatttgttttcatgactactagaattctcgtctggcatgttgcaccctgcaaggccacctctgggaagtactcctgtaaatcagagtgacttgattgctttatgaacatatcatctgaatggtgcaaattgatttagataaaactgatttagttaatcccttccctaagagcagggaaacttgcttcaactcgcagatcctaaagtggtgccagtggagtctcacaattgcatccaaatattgctctgagtagtgagcctgtccattccttcatccctcctcccataaaatctgctgacaccacaataattgacaagggaactacacaaggagtatgtctgtcttcatcattcagcaaacctcattggcttggtgaagaggagagaatgttgtcttctcattctatcccatagaactcaagctctgtcttttcagacagggacacagagcccttaaaagggtgaagacagggctgtgggcacagaatatgtctcaaatggctgctcttggaaatacctgcttggtcttgtgtgtgtctgccattcaatctttatgaatcttggtaatatccttgctgttaggccatggggctcggctgctagtagaggccagggggtgctccatttccatttagcattaagtttttgtcctctctttggcacaaaagcgagaatgaagctctgtgttcatgaagcactccttactcattaagctgggtgtcttgacttagaacattgcatcatcaaaatatgagatgtaacatgttgatactggatatacaacagttttggataattcaaaattgtttacattttgataaatgaaattttggtaccaagatggtgttgcactaacatctgtacttcaggtctctcaaaaaatattgtgttcatcactaagcagtgtacagaagagactagaaaagtgtttctcaactggtgtgttgggtcatgctagcaagtgagaagaccagatgagtggtgttgagacaagaaattccagctgtaattatcttcttgtacagatagctaatctactttttatttacctcctcaatatattaaatatgttcctttctccactttcatgtattaaaactctgctaagagttttctgtgggcttaagtagtctgtggctgtttctatttgtttctctctttctgtcttccccttctttatgaccataggcagatataatccttttgatgatgaatctcccagatgctgagttttcttttagaaattctataaattactaagactactagatagtataagatgcttaaagtgtgggtggtggagggattttgagtaatgtgccagcatcccattatttccttttccttgtgggattcacctgaatacactctaggatgctggttcagcctaagtgggttggcaaagtatcatttgtaagcattatcctacttgggttctggcctccctgcagagctctggctgcctgaccttgggctttgtctcagcttccttcccgtaggtcagactccgctggttgatgaacggcatccccagtctctggatcatcgtcttactgagaccgaacaatctgataacaaacccatcatacaatctgaaatcgtcctgaaacatgaaatcccagtatttgcaatttgcctggataggagcataatgtatgggcatggcagacaatgctaattcatgacagtgaagtgtcttaatatatacagcacagagatagaaaaatggtttacgatccagatccttgatcactttgtgtatagccctttgttcagtgttgctaggatccatgtggttcccagggaagtagaagcttgatttcaaataggcctctgttctctgtcccttgtttctgacctgaacttggggtcctctcagcctaacattcaataacatgtcttacatacatatattgccatttttattgtgtagatgactgcctgtccaggtgaaccactgaacatttaaaaacttacaaatattttgttgggtaacagaggttaggaaaagcaatcctagaggagatggaaagctgtaccagtagtcataggtaaattaagtttgttttccatttgttcctcaaccctgcaactgccagtgtaatctgcattaagataaaggtgttatgaattgtatttaggattcctgtcaattatcatgtgttaccttggcaaatccatttgttggttacttggattaaccttttgggtttgtagcagatttaggacttctagttctgctattttgatactcattttaatgtttatatgatgactatcttgtataaaatactcaatgtttggatttaaaaactaattattgaaaagaacatacattaattccatgtactataaaatattaagtaggctttaataacctattagacaggagctggcactggtgctctctgccagtcggtaatcagcctccagttctgagttctccctgtgcaggatgaaagtttaagagaaaagaaaagagacagcccttcacttggagaggggtggggatcccagtctaaaagtgaagacatgagcataacaaataccatgatcagtcccatgatcttccagaagtcttgtggaggagtgtgattgtctgccattatgtcaaccatgtgtttgggatgaatttccaaacatttttggcttttcttaataacttgctttgtttctataatctatgaatgtatgatgagaatacctgtatttgtaaagtaaactaatacttttattttatcctcgtctgatcctcacaatagcccgtgagatgggcagggcaggtatttttcatctgatagatgaaaaagctgtggcccaaagagtttaaatgtacctaggattgctcggctaatttggtttagatccaggactacaaccaggctgtattatgagggtcaaatgagataatggctttgaaataatttgaaaagtataaattgatatacaaatgtaaggtggctattatcaattattattactgaccacctagcctcttctgtctaggtttctattttcagttcttatcctatagtgtgtgaattcgatgcattggttgccttttgtgttccaaaatgatctgctttgagcttcaaggggttcttttctaatcatggtgttctagaatttggattttggtttcttttacagcccccaaatatattctcattagtttatattcccatgggactcttctcccctttagttgtcctctggaacatccattatgtcttttttgagatacaacagacaaaaaccactgtactttgagcatcttagtaatgcattttgtttatgtcctgctccagtggctgtgatgtctatcacttgttagccttcctagtcacactaataaataaaagttgtgtttttaggagctagtttacaataatccaagctgtctttttatgtggtaacagatagcaagagctctataataatcggatgtcagagctggaaagcatcttaaagagatcgtctggtgattctagtttagcttgaacattttacagttgaggaaacatcagactaggccaggactcatttgctccttaccccaaggcagggagacagtttctaatactttaaggaagaactcatgggacattaattttaatatcctgaagaatgtttattttatatatatatatatatattttttttaaaaacctacagctcagctcatttctcaatctacagcccagagatcaggcttggtttcacactcatggattttctatgaagggaatactataactcctcaggaaggtagtgggagctcagatacatgctttgcagacccggaagaaaaaaaattagatggaataataattgttaattaagtgggcatttaattatgctcaagtaacctttgaaataatagaattatgcaaagtacagatcacgacttctctcttgatcagagttagctaaaggctagatttggaggacaatgctgaaatcagtcttttatttcataagtgtaggatgcattatttttacgtttttgaaatttattttttatttttatttattttgagacaaagtctcatgctgtcacccaggatggaatacagtggcacaattacggcttactgcagcttcgacctgctggactcaagcgattttcccacctcagcctctcaagtagctgggactacaggtgcatgccaccacaccccactaatttttgtatattttgtagatatggggtcttgccatgttgccctggctggtctcgaattcctaggctcaagcaatctgcctgcctctgcctcccaaagtgctgggactacaggtgtgagtcaccacgccagacccattattttttatcttaatcaccttcatcaaaactccttttgtatttctacccagttatacagcccaatggtaccttcttctagtttatgctcatcgacttcttttttcagaggtctcaccctgtagtaaggcacaaggtaaagaaaagccatacagaaacaaacatacatatctgactatatatggcagtaactaaatggtttggaagggaactaatcagggtgtgtggatgtggacatttgtttcttaatatggcaattgatcgtgccctctcaggtatttcatcaatgcgtttttatgacaaattgtaaaaactttcaagattacctgtcattgagttgcaccctatcagattcacatcctgtcttcatccttagcatactctctaactctgtatagattagtgattcacaaactttttgaaattgcaacagtttgccattgtttaatttttgtcatgccacttcctcctgctaaaagtatttcatgataataggagtcaaatatttttcaggagtcacttatatactttttaaagtgaataaaaattgggagctgagaattttgtaacactcattgatcactagagatatcccagggtattgcaaaacctagacagggaatcattgacctagaaaaacaattgaaaggaacaagcaatccaatagaatttataaatactatataatcacacagttgttagtatagtatagtgatttgctgtttacaccctggagtcagacagacctgggattgaatctcttctttaaaaaaattagatgtaattcacatgccataatattcactattttaaagtatacaattcagtggtttttggtatcttcacaaagttgtgcaatcatcgtcactatctaattttagaaccttttcatcatcccagaaagtaactccatatttgttagcaatcactcctcatcccccatcctcccctgccctgctcctggcaaccattaatctactttctgttcctttgggtttgcctattctggatatttcataaaaaaggaatcatacacaaaaggagccttttgtgactggcttcttttacttactgttttcaaagatcatccatgttgaagtatgtatcagaacttcattcctttttatagccaagtaatattccactgtgtctatcctttcatcagttgatggacatttgggcttttcccttttggctactatgaagactgctgctatgaacatttgtgtacaagtttttgagtgaacacattttccattcttttgggtatatacctaggagtggaattatatggtaactctacatttagccttttgaggaactgtcgaactatttcccaaaagcagctgcaccattttttatttctacctgcaatgtatgagggttctaacttctccaaatcctggctgacgtgctgttttccggtttttgtttgttttgttttattatattttagccttcttagtgtgaagtagtatctcaatgtggttttgatttgcattttcctactggctaattatgttgagcaccttttcatgtgattattggccatttgtatatctttggaaaaaatctattgaaatcctttgcctactattaaattgagttactcatcttttttaatcttgagttgtaagagtacatttctagagactagacctatatcagatataataatatgatttgcaaatatttgcgcctagtctgtgggttgtctttttacttcattgatggtgctttttgcagcactcaaattttaaattttgataaagtaccatttatgtatattttctttggttgcttatgcttttggtgtcatctgagaaactgttgcctgcctaacctaagttcacaaagatttatgcctatctttccttccaagagttttatagtttcagctcttacatttagatcattgatctgttgtgagttaatttttataaatgatatgaagtagaactccaacttcatcctcttgcatgtggatatccagttgtccaagcaccatttgttgaaaagagtattctttctccatcgaatggtcttggaacccttgttgaaaatcagttgaccatagatatatataggtttatttctaaagttttatcctaagtttgattcttagttttgccacttagaaacaagtgtgaccttgaacaagttactttttttttttttgagacggagcctcgctctgttgccaggctggagtgcaatgacacgatctcggctcaagcaacctccgcctcccgggttcaagcaattcccctgccttagcctcccgagtagctgggactacaggcatgcgccactacgcctgctaattttttgtattttagtagagacggggtttcaccatgttggccaggatggtctcgatctcctgaccttgtgatccgcctgcctcaacctctcaaagtgttgggattataggcgtgagccaccacgcccagcctacttttttttttttttaaataatgataatacctaccttttagagagttgttgtgaaaagtaaatgaggcaatgcgcataaagggtattgttcaggtgcttagataaccagaaaggtaggggaaatgggggataattgaaaggattctaaaatattaggagtacccagaacaagaaagcctcataaattagagatgattgaacacgtctgaagaagttgataaaagtattcagtacccgaaaattggctaaaacagttaatatatgataattaaaaatcaaacagattcgaaacagtctagaaaagctaaaataagcaagaggcagtaactatcttaaaatattctttacagagctgaaataagttaaggtaggttattttagagtactaatgattgggtttttttctttcaaagactcttgagaatcttttgaaagctatgggcaaccctttccccaggaaaaatgcatatatgacatacaaacacattctgcaaacagttctaggaagttcagaagtccccggttaataaatcctattttgaccttacccaaagcaatcctgacccatagcgtgctttcccaagcttaatttcataatgaggttcaagtgtcacactgacttggaaataaattttagatttccaaacaaaatttaagagcttttcctctgtacaggacaatttatatggcaccctcttaagccttaggaaagctgtggtactctaattgttgttatatagttttcagcatacatagacatggctttcagcaatacatgtgaccaacccaggtagcttccaacacagacattgaggaatgcaggcatacagttctagaagagatagtaatagaagtgcagtgtgaggtggagatgggcctagaagacagagatatgattctggaaggaactcagaatgaaataggcagattcagagaaagtaagagagacagagagagataaaaatagacgtagaaacatgctgtttaaaaaaaaaaaactctataaactatgttaaatataccaaagtaaagatttccagaattcaaaaaaaaaaaaaactgtcttgtaaatggtccagataaacctcagtgaaggaggtgagatgattgaaataaaggtaagggaaaagagcacaggcattggaattatactgacctgtgctctgggtatgtatgtttttggttgatttatttaatgattctaagccctagtttcctaactgtaaggtggatacagtaatagtaacttcctcacaagtttcctgaaagaattagtgaaataatgtgtaaagtgcttaacatagtactcagaatacaggagatgctcaatgaatgctagaccccttcttactcctagtttaagtgatacttcattaacaattattgaatacagtttgtgtgaagcacaaacttgtgctgtgaatgaaaatataaaatagttgatactctcaaggagaaggaagagttagctggaaatacagctatgtaagtgaaataaaacagaatgttctggaagccaccagtggttgaggtgataaaaacatgtagatgagagatctcttagatttctaggcttggatggtgatattcaccagacagggaaaatcagaagaggagcaggtgttttttgtttgttttgttttgtggaggtgaggaggagcacaacaagttcatttatagacatgttgagtttgagaatctgagtaatatatcaaatggagctctctaaggcaatattcctgctgtcagtggaagttggaatcttcatctctcaaaagtctcttccaattctaagattcaatgatgtatgtacattttaattgtttactttttcatctgtatgggtgaacgttgatagatgttataagctacaaaatactggccaacaactttcaagcacctgtaaattctaaaagaaaaataccttgtctcacttaaaaaaactggctgtacaaacatctgaatctactaaaccaactgagtgactgatttacaaaaagattcttcacttttataacctcatttcatatagattttcattaaataggtagttagttcagtgcatttaaaaggtttgatttagaaacagcttttaggtgtacatctattgtacttaggcataaagtataattgtactcagtacttatgtatcctgtgacaatatctgaacaaataccaatggcagagcaaaattttcaagctctgatgagagtctccaatgatgacaagataataaacaaaagctactcaaaagcaaacaatgcttttcttgggcttggctctgtggctcactcctgtaatcccagcactttgggaggctgtggtgggcagattgcttgagcccaggagttcaagatcagcctgggcaacatggcaaaaccacgtctctacaaaaaatataaacaaaaattagctgggcttggtggcatacccctggagttccaggaggcggagcccaggaggctgaagcaggaggatcgcttgagcccaggaggtggacgttgcagttagccaagattgtaccactgcactccaccctgaatgacagagggacaccttgttaaaaaaaaaagcaagaaagatgccctttttctttcctatacataggattaacattttcagtcagtaagatatgttttatatttttccttagttaaagacaacttagaatatttatgtgtgtgtattttaattaatggaagactctaggcaattaagaattaggtacctgtgtgttcagcacagaaatgcctgtggaaaaatagatagagttaccaagaggttggtttcttgtcagttgggtggctttttttgtttgttttgtttgttttttttttttttggcagtctcactctgtcacccaggcaagagtgcagtggcatgatctcggcttactgcaacctccacctcccaggttcaagcgatacttctggttcagcctcccgagtagctgggaccacaggcaagcgccaccacgcccagctaatttttgcatttttagtagagacagggtttcaccatattggccaggaaggtctggacctcctaacctcgtgatccacccaccttggcctcccaaagtgctgggattacaggcgtgagccactgtgcccggccgggtgacctcttttactcactgatgctcactaaattgaaggttaccagatcttaaaatttctggaactttgctaatttctatctagatattgatttgcatcctgttatgttttagaaagtatgaaaagacacatgggaggtgagcttcatagctggcttgtgctagttcagcaggtgtttagtaatgaaaccaaactgaagccacaaggcaatatgactttattattgatcagcaactattgctgagtaggttgaaaagtttgaaatcattccccattcagcttgatgaactgaaggggtttctgaaggtgagggaagaagatgaaagtgaaaactatcatcttttatctcaagtaactcagtttactaggaatagaatggaacggaaatttccatgtgtgataataagaagtaattcaagttcacactctgaggaaaaacttattatcctgcaccaagggctacatttttctaaagctctctcttttttatgcaggctttcagaatggaatcatttcaggaagtagagagttactttaaaatatggcattgttttccttacactggatgtcacatagaagcagccctacagtttaccttgaagtgaaatagagaacaatattggagaatagagattgggaattttgcagggtctcagccttatcttagtctaggaaaagagatgtcagtggagaatatgtgagagaatgatccatgcaaatattgtgagctggaatggtaatgttaatcagtctatcaggattcagaggtggccatttggttttatctatttgtgcatgaaaataaacataggcatttgtctaaaacaaggtttgaaggggaagaaagtcttcctgattagttcccaaattgcttttctattgcttaagcatctctggggaatccagcacgtaaacgcgcccattggttagtgtataattgtgttatatccattttcctttggaaatgcctaatgactcttgctttgtattccttgcaggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaactcaaggtaagggatctggggagcatcccctatacaactttgtcgcataaatgcagttagcaagttctctaataaaataggtgacttttcctatatgacaagtgagttaactttaagttgttctcatgaggaataacctgctctcctgcaagctcttcctggagcctatctcatctgttgcataaacattcttgcagtcacacacttctggctaacttttggggagtcagctcatggcctgcaacaccagtagttcatccagggaaacacaccctctatcttctgtcagtgacatattgcttattatatatctttgctatgatctttccacctcttcttttaagtatgtgagtacttgtgtacgtgtactacaattagcatatgtgtcgatttgcatatgtaggtatatggcaatgggaaggcagggtgtgtctctgtgtaggtgtgggtggaggtggctgagtgtatctaggtaggtgagagatttttgtggaggacattattgtatgtttgtgtttgtgtactcaatacactaaagaaacaaaagtttggcattggccattacaaattgccattaagcctttaacatagggctaattctaagcctgcctttaaaaacaaaacaaaacaaaacaaaacaaagaactgaagaaacttcagtataccacgaaattgggagggataattaaatatctgaatgaacaatttaaactgaaggcaataaatattttatccagtatcaaattttgtgacagtgctcactattatgggctacaaactgaagcatttgtttatagttcctgccttacaagttcctagtcatttatgtgtattcaatggacagagttttctaaagttgttgtgtcatataatatgtatgtacaagtctaagtgcccataaaaagtcctcctaccttacactgatgatccagcgaattgttttattcccattgcttgtctgctatgttgtataatttctcttaagaagggagctacttagcagatattctagaaaaataaaatgtttaaacggatagtaaaattaccactccaaatagaacctgagtacataagccaagctagaagaaagacccagataggataaaaggagggcaagaagggaatggagattttcctcctgccatgcagtggatgattcattgtaacttctgtaaaaagtataatgttggtgagagtagcagtactcagaataggatatatttgtcctgtaatttgttgcaaataatattgagagtagtcacaatgactatggtttgtgcctcttttggttattatttatacctgatatgtataaatgtgtagcaaattcaatttttttatttcactcaagttgatactctcattcatatcaaggctgcagagggaaataatcttgttaacttcagttcttagactcataagatattaggcctttgacttggtctagtcgaagcgctctactttaaagttgtataaacagaccttgatagatgaagtgacttggtcaaaatcaaagaaatgattagtaatgggaaagctagaactgggacttagcctctagattgagtaactatcctttgtactgtagccggctgccactttgttttggatctaagttttccccatgaaatgtgatttgaaacttaactttatgctcccacaactgtacatttcgtggtcatagataaatgattaatgacatcaaggaagggacagattgtataaacttacagctgtataatggcaaaagataggagcggggttataggaagagtgggggatgtgaagaggacagaacaatctctgccaaatatttgcaggtgttgggactataataagtcattggccttgagaaatattccaaacagaaaaatctgtgtccatatgcactgttgagataacaaaaagactggctagtgtaagcttgtattacagaaaactagctatttgaaaacatccgaaaacatgatgattgattagatatttggcatcatgaagctatagccctcatctccagggatggatggaacatggacatattttaccaagatatattttagtctgtgactaatcggtaatttttggagaaagaaagccagattttgaatagttcccctttcatattttaggaaatgtgcagaaaattctgattataaattaagtggaaactatttttactcatttttggatggagagtggaaaatgaatcattcccaactgtgtggttcgttatgttgtctgaaacatcttggactttggggaggtgagagaggtactggttgtgtgtgtgttgcgggggtggaggggtcactttggtttggtgccaagtgtaaaagaatattaattctccatgttaagcagagagaaagtctgacttttagtgtcacatatactcacttctttgggttaattttaaattggaaaatcatttaggattacccccttagtctgcttgattcttccccaaggagaaagggagaaagttggctggcaggagctatgggagagtctgcctgagtatattcccctggccctggccctgagagaagcacaggagtcctgtaggagatatatactataccctatcattcttccccatactatcattcttcccctgtatctaggaggttggctttttagccagtatctgataacagggtttatttttactttttggttctggaacttcactgttgacatttgtaactactttttatatacgaacctccctgattaggattagtggcttctaatatttatttgttcaataaagaataaataaaccattatgttatagatgaaaagtcagaataaccagaaactagcctgtctttttaacatgttctcaaagtggattagagggcttggggtacttagtttagtttcatgatcttatttagttgtccagtctaccaatagggttgagacgcaggacacatgtctttcagcaggctaccagtagttcaattaattattcaattttaaataatatttttattcacgacagttattagagcagtaagtcctatcagagtaattattttctccatcacctctcacttttcactcactagtcccaatatatatcttagttcatgatatatggggcatttctataaaacggcttcatattttagaattttcattatcacatgagtttccatccttataaaagattgttgttatcgttttaataaattttggcttcataaaagaggccaaatttcggtgactgtctattgctgatagacttcaactcaatattataagtcccatacaacttttttcttgtgctgcccatgtattttcccctctactcctctaaaacatgctaccttcatctaccccagtgagcctcctgtctgcaaaatataccattctcttttctgattcttaactgtcactagtgttcttctcttggcctgtttacaaatcctacgtattctttaatgcataattcaaaccccataagaccactccaaaacatcacagctacgtcataatctccttcaggtcagaaataatgtcttgtatttctttagtattctccttagtttctagtacacatagtattttctcaagaaatccaaatgaattcagtcttcataatggatttgcaggaaatataccagtgcctatagcttgctttggatctcatctaagaagatataaatctgtcttgccattatatataccctgaaagtctgaaaaaagatctcctgtgaactactgacaatgttcaaaaccagagtgctagcaaaagtatggcatgtccttaattttaattgcctattcattttgatcactggattttccaactgcctacccctatggtgacatctgtataaatcagatgtgattattataattctctttgagagtgatgtcttcacatttccatgcccacagcctgccaaaaatatagctgatgaaaaccagggggaatagaggaatttcctgaaaggaataaacaagcacattttctttttctcattacatttccacaaattcattactacaaataattcttaaatgcagttacatttacatatcagggatcttgttataaaatattacccagcactggagtaagccttttatcatgggaaagtaacacacacacacacacacacacacacacacacactctctctctctctctctctctctctctctctcagcaagactgggacagagaaagctaatgattgccagacaatgagaagggagatatgagacttggaggatgttcaaaggaacgccacaatgagagttaaaaggttggaaaatatagtgctctagaatcttatcacagttgattacttgtccttcttcctattcagtcactctgtcatccacccacccattctcactcagtcaccaccttctcccagtcatttatctactcacccacttgacacccactactgtctgccaagacagataccctctcaactaatgtactaatgggcatatgactttctcaaccagtgtaagtataaatataagggaaagaaagtgaagtatatttatgagagactaggttgagagtatatttgcatacacatgtatgcatcactgtatatgagtgtgtatattcctgcataaatatgtggctgagaatgactctgtgtctgtgtatgaaagtatatctataaaatgtgtatcattgtatgtgaagatgtgagagtgtgtaaatcttctgataatttgggtaggagggggccatgagtgtaaggtaagctttctgttgtcaccctagggagtgttagagcctcagcagaacccatcctgaggctaaggatcaatctaataaatgagccagatcaaacatatgcatgataagaaaaatcttcaatggaggccagggtgggttaccataggtgagggaaaagaaaaatgttgtttctcactctcagtcaggtactaaatcacagtagctaaatataataagaacaaaacatttgagaccagatttatgctctttaaggtctggtggtaatggtggtgaacatgtgtgtgtggggttggggacagtatctgacaggtttctcagctaaaccagccttcaactcaatgctcataaaatcattcttgcttgtagatctgccttctctgtggtctcttaactgttccagacttgctccccatcacatacaatatgtgtaaatctgtacatatttcatgtgtgtatgaggataaaacacatttcatttcatctctacccaaactgtgcactaagactcatttgaacccctattcttttctctgcaagacttatattgatttctctgtctctgaactcatttattattaacaggaccctgttttggaagatgttttccattgtttctttggtttgagagcaagtttagcaagtagatactcctattatctgtacccttatctttctgtttttctgttatttcttttggctcaagttttctcttcaccaatatttgaaaggagctaacaatcgtttgtttgagaacaatttacaaaatgttgacacagagattgttcttgggtggatagaaatcctgtctgttattgttgggcaaagaaacatattacagaaatataatataggtgaggaaagatcaaggaaacaagaattactgaacacaaagaagtgaggtttaaagggaaaaatgtgataatggccttcaagttcatgaaaggttgatataatgaggtaatgccttattctttgtctcacatgaagctagaactgacaataacttaaaccgtagcatcagggatttaggctagggattcattcattcatttaacaaacaattaatgaacattcactttgtttactaaacactttgaccactgtggtaggagctgggacacaggaaataaggcacaatcccagtcctaaagggactttgaacttagtaggggagatagacaagtgggaaattccagttcagtatggtaagtgccatgacagaggtttgcacaggatgctctgaagcacagtggaggggtcagggaaaggatatcattgagttcaaaaacagggaatcatgagtgaatttattggagaagaaggaccaaaccggagagagtccatgcggaaagaattgacaaaacttggtgaatgactatgatgattatacaccatgaagagaatgaattaaaaaggacttttgaggtggagatgtcttgaaggatggtggtattgaggaggacaaaaatgaaattaggaaggggtggcagttttttggggatgctttgactttagatttgagtctgatgtgattgtgggtcatttaacaatcattcattcatcaaacatttcttgaacatctattaggtggcaagcacccggataggtattagggttacagtgattaagaaagcacagcctcaaccctgatggagctctcaggttagtgtggggaggcagataattaaggacacagttatgagatggtgtggtaagtgcaatgacagtggaagaacaggggctgttacagaacataggaggaatagcaagatagaatttgggtgagtttttgaatgccctgttaggggacaggagttgaggcagggaaggggagtgctctagtcaggagaaaagagtttgttgaaacatctggaggacagagagcatgggggtttctcagaactgaaagggcaagtgtcctagaaagggttaaaatttaggctttaccagtggctgaaagattgggtctggagaaatagacttgggagtcctcagcgtggtggtagagccatgcagtagtgagctgagcaaaggccaaggattgagccttgcagaacactcgtggtctagaaattaggcatgaaggaatagaagttgaaagagaaagagggggatgtgtatgagaggcaggaagtgaagaggaatagtgcaagtggaatacaaccctgagtcctccaggaaagtagagttggctttggctcactagtctgagggttatcaaaataaacactagatttaagtttttagtacaggtttacttttagaatgtccaaataataatgtatccatttgagctagagatgtaatcatgctatgcacctgaagatgggggaaagaaaagaatatgggaaggtttgggcagcatttctgataaggagagtgggggaggtgtgggtctcagctggatgatcacagagccttttgaaaagatggcaagtctttcacctggcttgagggtcaggttattctttaacaaacctgaagtagagtagacctatatgatatacatccagtgtatcaccttcatctcattctgggacgtagcctgtgtctatacaacagcaaataaatgtttggggaaagaataaattctggcataagggtgtgggcttcagtttgtgaaccagatggcatgttctgttgttgagaggccatatgtaattgatacataaagtgacagactgaagcaaaagcaaagtaagtattttaagacaagcagttaaaaaaagaaagcagactgtgaccctaaaagcatgtgaagattctggcttctggcttttggaagagctgaaaatgtcggtgcatagacaggatgtcaaaaaagagcatgtcaaagaatagtaatggggccactggctcagattatttttaaagatgaagttgtcttctgtcaatcaggaagactcaggtttgggatgaattggcctttctgccctatttcacttctccccttcctatgctcaccccaaggttcaattcccacataaaagcagtcaggatcttgtctaggtttagataatattccccttgtaccttttagacagcaagagagaatacagacattctatgacagtgccatgtttcagtggaaatgatatgtttcaatagaactaatacagattacacccccttttaggcttcagtacttactgtgtcaggttgatgtgtgtaggagtgctcatatatgtgcgaatacatatgccttcatggagtatgacaaatggagatcatggtccagtttgtgccataatggggtaatctacctcgctttaataaagaggtggtgtcttgatgtacgcctagttttcttgagagagtcaatgagaaagttacctgaaataatctgtgtctagagaagtgaaaaaaaaaaaccagcaattatttgagggttgaagaagccatttctgttaatgggatgctgtctggaagaagaatagcctgtgcccagctttctcagatggcaaaacattttcctctttgggaagggaataagagagcacaaagaggcctaatctatacaacacaataaaacttgggtaaaaatggaatcagtgtagactgccaatttagctaactgaggccttttaaaatctgttatgcaaatcagccaaatctttcccttactttgtgctgtttagacacatgtacaattttgtgtgagctagcataatgtagtcatctggaggtgaagaaggtatcacagtttcataaactaaaatggcttctgtaacatccataaaagggaagcacacaaagacccagaggtaacctcttgcagcaggaaatgggagcttcatcctgccccctggctgccaacctcctgtcctgtttcctaccagcagatatctccattccaatctcccctgccactttggctctcttgctgtcacggtttaactgtcctgagaaagttgcactaaccgggcttgaacataaggaacctggcccagtcattaactacattgcacaggagcagagcaaaacacaccaatatttcaaaactgaacaacaacgaagagacatgtttacttttatatagagattttagacacacacatccacacacacacagacacacacacacacacacacacacacaccctctttgtttactcagccagagtacagacaagataattacttggccaaatcaatcaaattattcaaacctagagtggcccagaattttttgttctaaatgactcgtcagtgctaggcatgataaggaagagtgacttccttagattgcataatcgcttcaattctctgtttccctttgcatatgttcattattgagaataaattccaatttgagaggaggctttaattccttgtaaatgaataggaaatgagtaagtaaatgttcggtgttttcctcaaattatgtctcatattgtaagaaaacagtggcaaaaagccatcaacagatggtgttttcattagccaaagatttatttttcaaagcattttcatattaatgaagtaaggttgaaattagagtcatcttgtcagatctagctctgtgttgttaacatgtgctggcattctgcaaattgctaggggcaaactaaccatttgccataattttgtgatggtaactcaaggcgcatagtctaactagacctcaaattatgtgttcagccctaatttttgttttcagtggctttatagaagccatgagtctcagttctgggccacaaaagaggaacacatagcagagattttgctatgtcctgctctgtactgtgaattatttatgagatatcagttttgtgatcagtgttgcaacaggttgaggtacttgttaaaaacattattctcatggaatcccatgtttgaatggaaatgcattacagttggaaacacaaatttctaatattgtatttgcttggcgttcatcaatctacattatatttgcctaatatatcaatatattcgcctaatatatcaatatattcatttgtgatacatggaatttccattgataggaatttgggccactgctagagaaaattatcaactggattcactaccaattcccactgcctaactcaagctagaccctttcatcacactacagagttattatattcaccttatggccaaatttttgaagaggagtctagacttgcagcctctactttgtcactacaccatactctaacctcaggatttcacaaattcttccaaaaccctactgaaacaccttttcaaaaggtcatctgtgacctctaattaccaaatccagctgccttttatcaatcctcatatttcttgcattctccgcatatttgacagtgacaaatcctttcctgaaacacatttctttcaattatcctcagtttggcccagacttgcattaccctacggccttgaatagtgcagccttcttctaaccagtgtccttcccccatcccctgccctgggctttcctatttcagtctgccccacattttgctgctaggttaatctcctaaatgcagccctgattatgccattaccttgctcaacagcttttggtaagtcctcagtgcaaacaacaacaacaacaacaacaacaacaaaaacaaacaaacaaagaaactacaaactccttatctaggcacttaagacctttataacaggactttggtctccatttccagctgcgtcccccactactctctttctaccctctgttctagccaaaggaaactactagtccctgaatatgccatatattttatttctttatactttttatttatttatttatttatttatttatttatttatttatttattatttttttgagacagagtttcactctttttgcccaggctggagtgcaatagtacgatctcggctcactgcaacctccgcctctgcggttcaagtgattttcctgcctcagcctcccgagtagctgagattacatgtgtctaccgccatgcctggctaattttatatttttagtagagaagaggtttcaccatgttggccaggctggtcttgaactcctgacctcaggtgatccacccacctcggtctcccaaagtgctgggattacaggtatgagccacccactgctcatggtcttatttctttgtacttttctcattacattccttgtgcccggaacatcctgcccccatgcatctctgtctattaaaattctgtttatccttcaaggcccatcttaattttacttcctctttatctgtgaagtcactgtaccttgaacagagtaggtgttcaatacatttttgtattaaatttctgaactgccactttttttattcctctgacatcaatttagcttagagatcacgtccaaatcaatgattgcttcctgtattcttcttccttccccttttctttgccaagaagaccacagattgagatggtagtgggattaaaggaggccaggggagacattgtgccccaatacaagaaaaatagaataaatggtgaaaaatcacttccatgggaataaagccaaggaagccaagagagacctggcaggaagggtagcaagggttcagctggtcctcataatccagtttgagaaaatgtgaaatcacactacccagcctgcaaacacgtgtatctatgtgaatatatccatctattcatgggaacagtgccaaagatattaaggagctacaggtacttagcagacagaaaggggccaagtacacaaatctcttcttttccttcatgttccctctctcccccacatccccccatccactttttcaaaagcacgaactttgaactacaaaacataggaacaatggagatagcagcgtagcacttaacatgactgagggaaggactgctagcagaatgagggccagtaagttggggtattacatttggaacagactttatggggtattgggatagtgggtgagagagaagtagatattggggtgagtcttagaggaaaagcagctaccagggctgaaagacttgggagtggggagaaataaaaaagcccatgattaatctagagtgaaatgatactctttttcacataacgaatgggaaacagtagcttgctcaactgaaaacatgctagaattccggctactgttgtaacaacattatattcaacagatctgcaaagtacccctaatatgtacctgaaagaatctatgtaccagtaaatgatgatatgcaatggatatcttctctttttaaaatatttatttattgagatagggtctcactctgtcacccaggctggagtgcagtggtgtgatcctggctcactgcaacctctgcctcctggggtcaagtgatcctcccacctcagcctcctgagtcactggaactataggtgcatgccaccacgcccaactaaattttgcattttttgttgagatgtggttttgttgtgctgcccaagctggtcttgaactcctgggctcaagcgatctgcccacctcagcctcccaaagtgctgggattacaggcgtgaaccaccgtgcctggctgatgtcctctcttgatacagtcaggctttgcattttgaagccctgcctctcttgtgggtgaagcctcggtgccaaagaaggaaagctgtgagatacaatgctagattttgatgaattccacactcaaaatactctttttttcctgaaggaccctactgataaatataaaatattataatcaaaaacaaaaaaagtcatggaatactgcagcaaaactgtgactgagggctggatacatgggttccagtcctagttttgcacatgctagtaatatgactgtgcaaaatactttaactccactttgaagcttggtactcccatttgtaaaatactagcatcttctactttgtgagattgttatggtttttaaatagtatatatgaaattgcctggcatagtgtctggcaatcattcaataattacagatggtccctgacttaccatagttcaacttacgatttttcaatttgacagtggtgtgaaagtaatatgcgttcagtatgcttcttgacttatgttagggttacatctggataagtccatcataagttgaaaatttcttaagttgaaaatgctctctctggaacataacttcatcataagttgagggacatgtgtaatagttttcttagtctactcatctggaaaagagataataatatctgttcttcatatgctgtgggattactatgagggcgaaatgagatattgcctatgaaatactttgaaaagttaaagatattatctaaaacataaggtttctttaatgtcaataaattcctacatccacaaagtcatgaatgtcatattttccccaatagtgagcaaatgtgcagcattattaatttgtacgtagattagtgcttggctcatggcagatgctaaatgaatctttgaaacatttgtctactgactaaccgattttcacatgacattggttctcaagctcatggttcttttttcccctcttctcggttcccctctggattcataccctctgcgatgacagcaaactctggagatgaacctcaccaacctggttaagcgcaacagcgaactagaaaatcaaatggccaaactaatacagatctgccagcaggttgaggtatgtaacagaaacatttgtgatttttcagaggacctgaaatgggtgaccctttgggaggacttcagttttgtcagagtgtagcctagtcatttggaatgaaggattgaatggcagttttagaaagtctcattcctttaggatgcttgttccaaaaaaagtgtcagaaacctatggtttaaaaagaatagacggtgatgatggacagtggggggataatagttcaaggggcaacctattctcctttccaaacagcaggcaatatgaaaatcagacatgaagtgtgcttcatccatcatcaaactggacattatcactccttaaagagattactggagtgtcatagggaagttgggaatcctgggtccttggggtaaggtgaggttaattcagcacaatattgtttctgtaacaatattatcaggactgcttctcctctttcgagcctctccccctcttcatcccctgcccatggtcctatctataccatgcaccccacctggtcctcactcattacctttccacttattcttgtcatcaacaaatcatatctattttaaagttgtaaattgtaaagtgctgtaaagtgtgaggttttaatcaattgtcatctacatcaaatcttagagcagagcttagaggaagagctgacctcttcttaaatggacataataaaataaagatgttatttctctttctcaagagcatgaaacttataccatttggttttgtgttgattttgttgaagagctgatggtagggcttcaagtgtaaacagggttgggtaaaatattataggattcttcatgggcagtggttggataaaaatgtttctaattctatttagaacctgatagtctggttctaatcttacttgtatgacagacaaatgtaacagttcaagtttattttatttcaattttattaagatctcatctcttaatccaatctatagattcctatttaagagactgtggagaatcttcttgtaaggcaaagaatcctcttattatatgagtaaccttctgacccccaatcatttggatttcttaaagtattgagtttcttcaagtagagtgtacttgtatgatgagcataccatagaaatttaatccctgctgggcactccatttgtggaagagagtggtgctctacgtagggtccatagagtactggtcaaactcagatatgagactataaaatgaagtgggggattagggaagaagcataaggaatgaaaagaaagagcactagagtgtgatttggaaaactgtgctctagacttggctcttccatgaagtggtggtatgaatctaagtcatttagcttctcagtttcagtgttcttacctataaaatgaagagttgaactgataacatgaccttcgacttctttctaggtatcacaggtcatgatgctgtgaatggtaactttctttattctattctttttctctcctggcttattctttccaagaagggagaaacaaaatataaagtatttcaaagtggctttcagctaatcagaatccctctaatgttccactctgtcaaagtttctcattatgctgttagattacagtataagacatccacactggcaaagggacaagggagtattgtaagcaggagacaagataagagatcccttgatttagaatttgcatgattgaatatagagtaacagctaatagtgaataaaatgtggttagaaattataatcaccttccttgttctcatcaaaaagactattaagtacagaacaagttgtagtgaaaatagcaaagtaagcagtttatttttatagctcattcactttaggacctctctaaggtctcatcttgccactctgaagagcttatgaccctggccagcctcacccaaacatagcctgttccaacctttcccagcccatcctgccaatcaaacctttatgttcagggccctactctttttaagtgacaagtctcataaaactatccatcattgtgttaatagggaaggaaccactttggctttttaggtaacaagcagtgttttaacagttccgtcctgaagttagtattcttgcctgagtcttaatgaggtgacactagtgctgccacatgcaaatagagtaaggggaaagagtagcccatacagtagatattcaagaagtgttcttttatggatgcttgctaaatccgatcatgtaagccactgtcggctctggatacacaaaaggtctgcttttactaatccttttttatgcctggcattgtaccaggtataaagaaaacagcataggcacagtatctaccctctgagggcttacatgctgcaaaaatccaccctgatgtggatacacatgtgcaagaaatacagacaattgaatataaacattaattgagaactgggaaagaatagtgagatattgttgagagtgagaatgtattttgggatttaacttcatagtctattgggtttaggattctgtctttgatgacagggaccctacaggatggcttatggaaggccatttctgtcttctatgacatcatccattctgaaaggttagggatgtgcccttaacttcctctttttttttttttttttgagatggaatctcgctctgttgcccaggctagagtgcagtggcacaatctcggctcactgcaacctctgcctcctaggttcaagtgattctcccgtctcagcctcccgactagctgggattacaggcacacgccaccatgcccgcctaatttcttgtattttagtagagacgcggtttcaccgtgttgcccaggctggtcttgaactcctgagctcaggcaatccacccgccttggcctcccaaagtgctaggattacaggcgtgagccaccgggcccggccaacttcctcttaataataacaacggtgaatccaggttacttattatcctcattcaacacagagcctgtctctccaaaagccttcaggacaaacctcaggattagaaatctagttaatggagggacttgagacttcataaatgcttaaaaatacagtagaaaatgaaatgtatagtagaatactgtcagtcatgaaagtaagacactgatgggtgatttggaattttttcattatatgtaatccagattcatctatagggaatgactatattcacagtgtataccaggcatttcacattcggcgggggcggaggataccagctaaggcgcttctgagaaaactggaatagggtattttcctgtcaaacctgttccccttctttattgtctgtaaatgtttttgtcacaaattgccttttcataaaagggccataaatactgcctccctatcatggttctttctccctgttctctattctcctcagaaagtaaacaaagctgcagtcttcctattataacagaaacagagattaagatcactacagatttgttagctgacttctatggtaatgtagcttgttataattgctgctgaaggtttcagaattcagtagatgggtggttggaaaatgttttctgctgcggctggagagcatgggaaggaggtagaggcagctccaagactccctttaatctaattaaggaagggcatgctttgaccttgctatgataaccacttgatctctatatatagttctttgtcctggctcatcaggcatcctttgtttacatttccaaaggaaacctctgtataatgcatagccaagggaaaatgtataccaacagatgaatacttcctcttcgcttccaatactccatggttctgtgaataataggcattctaaaacatagcgaggggcaaatatagttaaatacttagtaatcagttggtcaacagcatttattgagcatacgctgtgtactctgtggtgggcgatttgggggctacaaaagaaatatatgtggttgatgacctccaggaactttcagtctagttagggaaaacagtatatagtgagaaagagtatttatagagcagcatgcagtgcagaaaatacaaatgaatgtagtatagccctttcaattttacttatttagtcttgttcttagcttttagggcactgagtaaattaaaacactttcctgtatattttgtgtgccacctttttcttctttccagaactgctgtgatacaatggcttaatccatcccagaagctccatgggcaggttgatttccttctggctcttctcaatccttttaaagagctggacggcactgctctttagcattaggagaaagaagaaagaaaggagatgagttggaagagagggagaggtttcccttagtctggggaatttcagctttctgtcttgctactaggtcttagcttcattcacttttggaagtctctctctttagagttcaaacttcagatgggctggtattttcttctttctgctcgtattgcccattggaaggatatttagtttgggaagggcaagaatcttggagtctatgtaatagatgtctggctgcttctccaagcataaaatataaatattttaaaataaattaatttaaaaaacactgctatggatgatttcagcagatgatccttaaatatttttgggtggttgagctagaagaaagaatagaatttaaaccattagagcacaaatacatttgttggtggagccctctttaaggagcagtcagtgaaattagtataattggaaaatttaatggagaaaatgcattttagccaaatgttgaaggagaaaaaaaattactccctctggagagacagaaagcagaggtattagtggaggtgtaaatgagcacattttatggggaaaatggtgccttaagcactgggtgtatacagataaataggaaatggcacctgccctcaaggaacacacagactggctgagaacctgacaggtaaaatggcaaatagaatgtgaagtgataattactgtaatgaatgtaaatgcgtgatgacaagttagcatggaggaggaaacactcaggcctgcctgagaaacttaggaaaggctgcagaatggaaaaaaaatgagttatcttgaaataagagtagaattttgccaataaaaatgagataagggagtgaaggggaccacatgtgagaacacagaagggtgatcagcatggagacgttcagggaactatcagaagtttggcttggccagaatgtaagacatgagattgcaagaggtgagtatggagaagtgagtagcttgggcccaaataataaagagccttgtaggccatgtataggtgtttagactttaacctgagaagtctggggagccatggaaggattttaagcaggtgaataactgaataaaatctgtatttaagaaggattgctatggctgtagtatggagtatggagcaaaggtcaagggtccagggtaaaaagtgaggacaaagagaccagttagatttttactgatccagggagagatgaaggcccagcttgagacagtggcagtaggattagggaagaagggatacattcaaaacatttctaggaggtggatcagtattaattggtgatcagttaatgggtgaaggagtgagggagaagaaatactatgatgatccacagggttctggtttaggtgaccaaataggtctatggcctttaactaggttaagaaatataaaaggagttctttttagacctgcaaggtttattgttctctgggtcagaaaggcaggtaggaaatgtccagtagaaagttggctagctggatttagaggtcaagagagaggtctgggaaagggatatacttggaagtcattagcatctaagtagcacttaaagccatggagaatgtatagattgaaaagagggcctgtgacaaatctccagcccaattgtttgtcactcacaatacaataacaaactgactttccaaaaataaatagaaagacggtgttgcttttgaggagattactgaagaatgctgtgcattttgaaaattaaatatcaaagtaaattattcatttgtggaaaaaaatcaaaggtttagggtattattatcttaaagactacaataataagtaacacttactgaggatttcctctgttccagctgagtgcttaatatgtgttaactcatttaattctcacaacagctctgtgagatagacactgttaatacccctactttacagataaacagagacaaagaaatatttaagtgttttgccaagttcatgccactggtaggtaagagagtggggatttgaatacaggcactttagctctggagcctgtgcccctgaccactccattacgcgttgttttgcaagaccaaggtacacgccacttggatgtctcttgttaatcatgggtggttcctggacccattgtgaggatgacttgtagtgagcaaggggtatgggatagggatgtgaattctgaaggacagcaaaggagaaacaaagagcagtcaagagacgaggaaaaccaacaaaaacagaggatcaaaatctcagaggaaggagaggccttcaaaatgtggaagatttgatgagtcaattggagcagaagcatagaagatttcattagtcatctttgagggagaaggttctacgcaaatatgaagatggaacataaattcaaagaggtcaggaagaaagtaagttataaggaaatgcagggctgggcgcggtgactcatgcctgtaatcccagcactttgggaggctgaggtgggtggatcacctggggtctggaggtcaagaccagcctggccaacatggtgaaaccccatctctacaaaaaatacaaaaatttgccaggtgtggtggtagacacatgtaatcccagctactcaaggggctgaggcaggagaattgcttgaacccaggaggtggaggttgcagtgagccgagatcgtgccattgccctccagcctggacgacaagagggaaactctgtctcaaaacagacaaacaaacaaacaaaaggaaatgcaggttgcaagaagtttgatcacgaaggtgaagcaagaaataaggtggtagttattatcctttcgaagagcagaaaagtcagactcataaatgctctgtttgtgtattattctgctactggtgagttaacagtaggaatcactagatccactgcgttcatccacatatgcttcccttccctccctgacttggtgtccagctttatctccaacccaggacactgtagccttagtttctacaacttgcctgtcctaaaaatggtatgtacgtcctgggaggcagtgtgctgtgacagctttggagttggacagacaggagtcatgttagctgtgcaaccttgaacacatactttttctgagcctcagtttcaccatctataaaacttggactaataatacattgaagagaaaggcaatacatgtaaagtacctgctactgtgcctggcatatatagtcaaagctcaataaacggtggtggtggtaatactagtcatagtagcaggaggaggaggaggagggaaagaaggagaaagaggaagaggaggtgtaatagcaggaacagttgctagtagcagtagtactagtagtagtaattttgggcactacacattttgccagagattcctagccctgacctcaggacttccaaagctttttatcactatctctgagagtggggagaacaatcattcccaaatactcataaccaatttcaaattttacatatatcaactaaaacttttcttgggaagagggagtggtaatgaaattgcagcagcaaaaatattgggtaccttggccatgtgactccacctagcccaccagtaactctgcagatgtgatagactaaaaagggttattgtgctcaataagctgctagtttgcagttactaatttaaacaaattttatttagtaaggaaacatttactgcccttctgcaagaatatccaaaagattcttcgtgttgatacttaagtaaatttgcccattatcctgcccaaattcttcttgattactgcctttaagcaaagccaaaagaaaagttttagggagggtcacatgctttcatctctagtaattttaaaaagagagagttctataattttgtatttgcgatttaaaatgtttattagcaaaaatgttctgtgaatatttttgttagagatggaagagcaaggggagcagacttaagagctcctgagaaagatttgaactgctagtgtcttgtgaaaatgaaatacctagtttgaaaccactgtggaattatagatggagaaaattgtttccatgaaaaatggaaaataagttcagtgatccagtcaatctattcatttatactactgtagtgactaattcagagtattacattcaatcttattaagaatataacgattgacatttaatatagatgaaaaacctaagttaactgtgcaatccagtgtgtggtcatagcctatttttatactagaaaagaaagtgctttataatttttcagagacctaatgcattcaatcctttttaaaaaatactttgtgacaattcttcatttatgtcagtaaagtaacatttttgaagacattaaatgttgcagttgaaatacttggagggtattaacacatgacagggtttaaggataaaattagttaggattaatattgttttcctcgccctcctccctcacatctatagggcaggtaagctttcaggtgtggtcatgtcttcatagccgaaacagttcacataggaatgcactttcatcccacttttgcacttttcctttggcacagtgaagcttatcttacagtcccgtttcccatccctcctctagttctcatttctgtgttcaaattccaggtcactcactaaatgaccagaagacttgcttaattttggctcctcttgtttgctccactattttcacaatccacccaaattccccatttccagtgtgctcttggaaagttaatggaatcttaataattcagctaaggctctatcaagcttatcctataccttgaaatgtttctagttccacttttacctctaatctctcctgccatcaacccaactaaaactaaacaaatgttttaaaaacccagacttgaaaccaaaacaactatcaccacagcagataggcacacagccattgagatgtccttactgtctctgcctgtctagaggagtccagctctgtggtacggtaagcaaggattgggaggaagagaatcttacttgaataatttgttctgggcactgtgctagagacatcatttctaatctcacttagtgtttatgacaatcctgtgatacagctggttaatattcccatttttcaagtgaggaacttgaaggccagagatattagatgccttactcaaggtcacacataagtaagctgggatgcagttctacatttctctcactccaaagtctatgttctttccattgcattgtgcagcctagtggagaagttgttggtttacttgccaccgattcatttgtgctcagataggtaggaggcagctccagaaaaccctttgtttttctccactaaatagctctagctctagaaaaacatatggtctgtttgggggcctggcgttcctgaatctgtggtaagcctcttatgtactcctgccattggcctacctttaatagcccagagcagctctccatattctgacagcccttcatggggtacagaggagagggagttgcctagagttggcagaaggaagcaataatacccacaattaggcatttacttgctcagattatttttgtgccatgaggggtggaaatagtgtgggcagctccaggtatcaacactgtcctcagccatagagtttacgctgggacccatattttcttgctgagactgccgggatgggtcctcattctagggctgtacatgaccatgtttcagggtaaaagtagtctccatgagacacagggtttcttaacagttactaagagtttgacagtaaagatgtactctcaaaagtataattaatgtttgcacatttaaaacaggatataaataacaaatataataccacaatgactgcaaatatatagatttcctcaaaaaagagtgaatgcattgctattattaatggtgtcttttgatggaatgattacttagaagtacacatacagccaggaaatcagctatttactacctcaagacagaaagagaatccaatgcctctgtctattctcactacctctcctctcacctaaatcaaatcttgaatccaagtttaccctatctcagccagtcctaagaactcttaattattcctaagagctttaaatacattagctcatttaatccacacaataacccaatgaagtacatatgattctcattctcattttacagatggggtaactgaagcacacaggggtaacttatttgtataaaatcacaggtggcaaattaagagtttgcatccaattttactgaggtccttgctcttaatgactatgctgtattaaaaaagatgggcaaaactaacaacccatggctccatgtgcagtgttttgcaagtcgctgattattgtgcttatggtctgggtaaggacagaaaaccagaaaaccagtattatgtgagcgtgtgcccatgtgggaatgatgtggtgtgatactagagcaatatttgggcaagcctttctttgtgatgataatctctccagagcatgcatcataatgcctctgcacgtgctatgcatctgtctatctatttcatagatggctgtgcctggctgttcatctcttatgtgtgtctggggagggggttgtatgtgtaaagaggatatatgtggaaaaaaggatatatgcccagtgagagaattagtgtttaaactgggtcatgaggattgctttgacctgtttccctccccgcccaccccaaagggttcttttcagtcctttgatgttttccccatataaggggagaaactgggacacaactggaggatgttgccttttgttttctttaatgagaaacattgactctttccttgagagaaggttttcctcctcttctccatatcccaagcctgttccagcttctccttagtaacatcaaaggcacaaaacaatcactggctttggaataatttctaaaccaataaaactctagctaaaagtgtatagcaccagtgctagtcgcatagaacaacatagttccatcctgagctccctcatcccaatctatatatgggtagttttgcactggcatagaatggcaggtttacgaatgtccaaagatgtcttattagaaaaatctcaggtacaggggaaagcccaggacacgaggaggattagagaagagggtgagtgacctaggcagggaaggataacaatgctatgtgaaaaggaaggagaaacaattacacgatgccagtttactctatagtgcacatataatgaaactcctgccaaatttgtggtgtgttctagcatctgaagagctttgaatcttctagcaccctggggatattctgggattccaattgccacccactcaacagtcaagaaattcaaaccatttcaggaggattccattggctttagaatgaaatggaatttatattatattggtagctcacagagaacacttacatttaagaagtaaaaatatatcacagatgaatacgcaaattgcatattgtctgcaggccagagagcaaaattaaacaccttcatgctttcgtactccatttctgtcaaaaacaggatatcagcagcaaagccactgaaaacacacacacacacacacacacacacacacacacacacacacacacacacacacaacactgacctacagtgagtactgccaaaccccatgctaacccagtgacacatcattagctcagaagttgaaagcaaatggtgttcctaagtggacctttataaaaaatattaagctccactgtgggtttagcatagtgttatgtgatacagaggaatatagtagcaggtgtattaagtctctatccctgtcttcaaggactttatagtctagttgagaaagcagagctaacagtatgaagcattgccaagcaatataaaataatttaaactgtgtgacaataactgtaagtgctgtagtagttcgggggagagggagatggaagaaggctaacatcattaccatcattaacatctattgtttattaacacttaatgtgctccaggtgtcatgccaagtgctttacatgtattatctcatttaatcttctcagttacctctgagacaggcactattattatccccatttttcagatgaggaaactcagatagctaaatgatttatccaaggggagtgtagaaatgagactagagaggcatggagggacctgattacagaggacattaaaagccatgctaagaagtttggcatttattctaaggtcaaagggaagccaattgaaatttagtatgaagccattttaagcacgggtgtagtgttttttgttttttgtttttgttttgttttgttttgagacggagtctccctttgtctccaggctggagttcagtggtgagatctcggctcactgcaacctccacctcccaggttcaagagattctcctgcctcagcctcccaagtagctgggattacaggcatgtgccgccacgcccagctaatttttttttttttttttgtatttttagtagagacggggtttcaccttgttggccaggatggtctcgatctcctgaccttgtgatccgcccacctcggcctcccaaagtgctggagttacaggcatgagccaccgcgcccggcctgtagtgtgttttttaaaaagtttatactgcccctctgctgggttaagtacacattgggaaaataaatgattggagacagaggggccaattaggagactgtagtagcattgtgcttggcacatagtaggcactcaatgtatatttgttggatggatatatgaattcagggaagagattttggtggacagatctagtgaaatataagggaagatgatagaaaaggatagatttgaattatatttatgaggtaaatataggggatgtgatgattaactggatgtggggaataagaaagagaagttaagaatgaagccctgggtttctgaggagctggtgatacccttcattcatttagggaacattagagaagaatcagatttaatggaacaggatgtaggaaagagacgagttcagtttggaaacactgagtttgtagtgcctgtagttatgcaaatgaaatgtccagtaagcagttagttatataggtctaaatttcaggagagagacttaggatagacataaatataattaaggcaaatggagatctttttgaggtgatggaattgttctaaaattggattgtggtaatggttacaaaattctgtaaatttactaaaattattgagttacccacttaaaatgggtgaattttgtggcatatacattatatatcaataaagctcttaaaattaaaaaagttaagcaaggtactggcatgtagagagtaactgaagccttagaaatggatgaggtcacctaagtcagtgtgctagaactctcagaatgctgacatttaagggacagacaaaggagttggaatgatcagcaggaaaactaggaaaatttgtctcatggaagctgaaagaagaaagtattttcagaagaagtgaatagatgatcttttaaataatgatttgaaagacttaaatatcttgaaatgtcaatgggaaggagtggaaccagaagagaggttggctgaaggaaagggaagaagattaatcaaatgaggaccccaagaagctagaagaggatggaatgcaaagcctctaggagaggactgatgaactttctagagagatatatcacttctttgtaataggagaaaggaaagatgattgtttccttattgttttgtgagaatttaaaataattccctgggataaattttattttctctgtgacaaaggaagtaaaatcatttactacgattttactatgagtgagaagggaggtagtagggttgaagctttgtggatggtagagatcgctgctgtggagatatagagagagctgttaagagaaacacagaattaataagaaactttgagagcctgcttgaagttggacaccacaaatttaagggggatcaatctatgcttccatgattagcatataggtcacacttaaaaccatgaaaatgaatgaatttggccaggaaaagttgattaggtgaggaaaaggacatagatatagattagatagagataatatatattattaactttttacctgtcacgtgttgtgatattttccccccagtttgtcttttgtctttattttctgtatggcttctggtttttctggcttgtgaaaggtctccccctcctcaaactttcttttcatattttcggtggttttattttttatattttaagtctttaatgtacctggaatttgttttagaatatgagattttgaaatgtattttagggcatgtagttgtgtttcctttcagatagataactattatgctaagcccatttattaaaagaacagtccttttcctgttgagtggatatgctaccattgccatatattggatttccatatgtacttgcttctattctagactctattctgttccattgatttaattttccattcttacgccaataccttactattttgattatactgactttttggtaatatctgatatttccttactattcttagatatttgtttctccatatttttacatatttgtgtctccatatgaacttttaaataattttgtatagttacaaaatatactcagtttggattgtgattatcactatattacagttgtgtattagtttttagaagaaagacattcctatgatatgtcttcctatccagaatcacggtatatctttgcattttttcaggttttatttttgggaccgtctctttaatatttagttgttttcttcaaataggtacagtacatttttttgttgttgttgattcctaagtactttgtactcttgtccgtgctgtgaatgggttacttttctatttccatttttaaaagcatatggagaaaagcttttgattttatatattttcttgtgtattacaatcttaccatattggcaaccttatatttaaaaaaaaaacctagagtctcgggtttatctgaggcacttatatctcctttaccaatatttataccaattatttcatgttctaactttcttttgcctcagctaaaacatttaaaacactatggtgatatcagacatccttgccttgttcataatgttactggaaagggccttagcatttcaccatttagtatgaagtttgctatttattatatttgaatgctgttttatttagaattttcacttggactggctactgattttgtttaaaaaccttttagaatatattaatataaccctatatgttgattttttctaatcttgaatcattcttttatatttggaataaaaagtgtttggttatggtattttattcttttgttgccctgctgcttttgttaaacatttttctctatatattcagaactgaaatcaatctatagccttactatttctgatatcatttttaggtttctgatattgtggaattatactagatctagtaaatgcatttgagacctttttgtctttctctgtggtcttaaatagtttaagttgtgtgagaatgatttgttctttcaaagtttatggaactcagctctaaaaccatctaggcctggagccttaaaaaaattacagattgttaatcacccttccaatctggtctaaagttattagattcttgaggttttgttactccttcttgggtaaaagcatttaatagattttaaaatcatgtggtatacattgcatatgatagtcccttataattaatatctctccaatggtgtgctggtgctgactttccaattgtgtgcatttttcccatattttggtttggtgtctatacattggtagcttaaaatccactaaagtgtaagttttcacgccatggaaatcagcaagcactacaaattgcggcttttttttttttttttttgagagccaattgttaaatggttatcagcatactattgtctatatctataagtgtatctccttttccattgttagtattgtatttttgttttattttctccctttttccttaataagtaatttcaaagaagcagcttttgatgttaattatctgttaattatcccttgtaagttagtttcattttgattttattagtttgagctttttaaaagtgaatttcctccttctatttactttcatttttttgtccttttccagtttcttaaattgagtgaattcctgtattttccatttttatatattttcctgagtagaggtttaactgtatcccgtatattttggtatttagtgtgtgctctttcattattttctataaaattaacaactttagtttcattttcctctttgattacaaggttatttaggagtattcaagcagaaaatttccctgacccctttgctggcaggaactggagtgcacgggtgctagaactagtcagccacttcagtgccagcaggggcagactccacttgcttggccccaccgtgttccacgccttgcaggagggggagcgcaggtgagcaggtgaaggagctggggcaagcgcttttgggtgctggcaggagcgaaactgtgcttccccacagcagcatctaggggggtgtccatatctcctgaagctccagaaagagtgttacagtcagtgctcttttagctttgctgtccatgaatggcttaagtgttaacagctcagtggagggtcagtgtgacggccttttgcacttgcacttgagttcttgttcaacatccaagaggaatgaggtcgcatgaacaaattggagatggtcaatgtgggggattttattgccaatgaaagtggctctcagcaggaaggggagctggaaaggggacagagcaggatgatcattttcccccagagtctagctgtccccagctggactcctcttcgaagcaacaccgtaaagccgtccctctgaagtcaagctgcttctttccaacttccaaccatagtccccaatgtccagctgcttctcctcttctctctgctggtgaaccctggggtttttatgggcacaggatggggagcagggtggggtatgggtggttttggaaaaggcagctttcaagcgggaaaataggaatgcgtgttctcactttgggacacggttccaggcttgagggcaagacctttgccagagacctatcctcttctgcccagaatttccctgcctcctgcccctgtcatttccctcctctgaagaggctcatctaactgctggtgtaatatggacgatgactggtcttagctacttcctgtttacagggggtgtgagtatgggaagaacagcagtcagattcctccccaaggtctacctaagggtccccagcaaaagggagccattgtctgaggttctggttgcctgactgtttggagtttgatggcctctaggtgcaaagaaacaagttttacagggttaagtatgcatggaccaaatatatgtccaaagaggagttaaaaggagagaatctaatgctgaagattacagaaataagaagtgaaatatactaatcattctgaaatcaacattataccccatggtatagcacagaatggaggtaaaaacaacaagcctaggcaagactataaagaggatatccatggaaggttaattattaacacttatcttttgtgatttttagcttgagttccccaatctcttcacataggtactttgggtgctcttctgggttgatgcaggtaactctgtcagcttcccaggcctttactcgggtatagtgaatacaatgatctattccagtgactttcagtgccataagagtagaaagaagtataatccctcccaatctgggcttatagagggagaaagggaagcaagtacctttaccagtattaggtccactgggttgaatagaggtggccctagttcctgggattggacctccaacagttgtttcagttcctgttggaaatgggccaaagaagttatatgtttaatcaaatcagaggatttttggtctagcaagaaatcattcgtgagaaaaggccatccatacatcatttcaaaggaactcaaacccagctttggaggggtgtttctaacatgtagtagggctatggggagaagggtagttcaggggcgacgagtctcctaagacagcttcctgaggtgcattttgataatattcatcttttctacctttcctgaggattgtggtctccaagcacaatgaagatggtactgtatgcctagtgcctttgagaccccctgggtgacggctgccttgaacaggggccattatcactctggaggtacttagggagtccaaagcaaggaattatctcattaattagtacttttatcacctcagagactttctccgtctgacaaggaattgcttctacttagttagtgaaggtatctatccacactaggagatactggatgcctcttgcctttggcatatgggtgaaatccactgctagtcttcccctggatagcctcctgtcctttggattcctgggggaagaagctgtcgattaaggggattattttaaaggcaggtctagcaagcattaacgatctgtttaactgtatcaggtttttacctgagagcaatttctgggccaactgatgggttttatccttacgtaggtggaaagcttggtgaaggattttaagaactttccattggtcagcagcctgtagatgaagcttgctgtcctccaattgtagccatcctggggactgaaagatgtatccctgagagattgcccattctatttccacaggagaatatttagattatatttctcttaaggggccctctcagatcagtgaggcttcaagtggatcagaaatctgaggctttgttgctgctgatttagctgcttggtctgccaatctattttgcttggctacttcatccatacctttttggtggcctttacaatgtattactgccacttcacatgtgagaaaaaccgaggataatagtctattaatttcctgatggtatttaatgggactcccattacctgtgaggaagtttctcgctttccagatagtggcatgggcacagaggactaggaaagcatacttagaatcagtgcaaatgttaactgtttttcctttgcttaatttgagtgcccttgtgagggcaattagtttggctaattaagcacttgtccctgagtagagagacacactctcaacaatatcattcagagtaactattgcataccttgccttatgtatcccttgttctacaaaagaacttctgtctgtaaagagaatccagtttgggttctctaagagggtttccttgagatcctctctggtcacataggtctgtactactagctgttcacagtcatgttcaagcttcccagcttcctctgggaggaaggtggctggatttagggagggacaggttcttaattggacttcagatccctctaatagcagaacttgatacacgaggaggcagttgtctgttagccagagattccccttagaagacagcagtcctgacacattatgtggagtgcaaacagttaagttattccccatggttaacttagtagcctttggtaccagcaaggctactgctgcatctgcctggaggcaggctgtccatcttttggctaccaaatcaagctccttacttaggtagcctacaggctgctgggctggaccagggcttgtgttagcactcccagggccatttgctttgcttctgacacataaagattaaacatcttccctatggggagactaagggctggtgccttaagcaaggtttgctttagttggtcagaggcttttctagtcccaggttcccaaattagagagtgagttttagctgcctgagtatcctttattaggtgatataagggacaaactatttcaccatacccaagtatccatagtctgaagaatcctgtaatacctaagaatcccctcagttgcttgagggttttggggaggggaaaggaggagatggacttaatcctttctttgcccagtgctctggtcccctctgacaagatcagaccaaggtacttcactgaagtctgacagagctgagctttagattttgaaaccttatatcctctattagccagaaaattgagaagagccttactaccctccgagaggtttcctcagttcgagcacagaggagaatgtcatctatatattgtaaaactttaacctgaggataaaggaactcagagaagtctcttgacaatgcctgcccaaacaagtgagggctgtctcagaatccctgaggtaacactgtccaggttaactgggtagtttggttagagggatcctcaaatgcaaacaaatactgggagtcagagtgtaatggtatgcagaagaaggcatcctttaggtccaggactgtgaactgtttagttccttcaggtacttgagatagcagggtatacagattggaaaccactgggtgtaatggaaccacagcttcattaacaaggtggaggtcctgaactagtcttcattccccattgggtttttgtactcccaatatcggagtattacaagggctgttgcagggtttgaggaggccctgcaaccttgttatcaatgatggcttctagtcctttcctaacttctggtttcaggggatattgtttctgattaggaaatgaggtgggatccttaaggtgaacctggactggtatggcatttgtggattggccaattttcccttgaattgcccaaacttctgtgttaatatcagtcttcactagggggagacaaatagtttgttcagaggccaccagaatggtggtccccatactggccagaatataccggttcagcagaggagttgggctctcaggtataattagaaaggcatgggtgaacaacaagtctccccagctacaactaaagagttggaaaaaataccggattaagagcctttctgagatacccctctcatttgtgctaagagaagagaaggggcccggattggagaggagagctgagagaccaaccccagtgtccaaaaggaggtccactttcctccctttgattttcagaactacctggggctcctggatggtaatggtggtctggaccactggagctacagagaggagccctgggacccatcagtcctgctgaaccatttgggagattggctctggacctggtgaccagcctccctggggacagtctgccttccagtggtccccactacagattggacagggtcaaggtggcttcctcatgctgccttggcaatcctttctaaaatgtcctggcatactatatctgtagcagttaacaggtgcacctcaggaatcctggggtttgtgggctttcatggtggccattaaaccctctgcttctttcctatgttttctctctctctcctggacctccctatctctattataaaagatcaaggtggccactttcaggagattcactaaagtactatctggtcccagggtctgtttctgcagtttcctcctaatatcaggggctacctgagtaataaatttatcctttaggattagttgtcccttgactgaattgggagatagagaggtgtgctttaccaaggcccctcttagcctctccagaaaggcagtaggattctcatcaaatccctggtctgtcacgggtagcttcgtataactgagaggcttagttctggtcctacgtaagccctccatcatggacacctaaagtgtctcctcttccactctcccatctcaatattgggatcctatttagggtcatccaatggtactgcttcccttccaattggataaagtttgactccttccctgacaatatatgtgatactaagctcatccccaaatccctctgtcagctgcagaatggcgtgcttctcagtgttagggtttgattcaaaagtaacataatgtctttccaggagagttcagatacttgggttatattctggaaagcctctatacaactgtcagggtcatctgaaaacttgccgtgatcccccttaatctgccttaagtcctgtagagagaagggcacctggaccttactggggtcaaattcaccaggcatctgttggagaggcaggagtgagactggggcttgtccagggtgaagatttctaggagggggcaagtgagagagagaagctggatggggaggaaggggtggacccagaggagcagcgctggagggagctggctgtcctgctggaggtgtctctggggttcatttctttagttccttgggattgccacttgcagccttccctgagatggcaaaccggagggctgaaccaatcctacactatcagcaaaggtctggattacttgcaaggaaaagaaagtctgcatgtatggcctcagaccatctgtcctcatgtttacagaaaaggtccaactacacgatggtattgaaatgaatggttccttcctgaggccaagacagtccttcctgcagatcacaatttggctaaacctttgtgctatgaggcattttacctccagagtatgagggtcaaagcagttccagtgattcaggataccctccagaggagtacagactggggtggtgaagatagctggttacccattccgaaagacagggaaataggtgtctctcatttcacttccttctttcagtgaaaacttgaggtatgagggagagagaaagtgaacctcctccttttctcttccatcattttatccccaagacttggcaaccttagatggatgccacccacaggtgccattgcagcctgcactcataaaacaaggagggcctagagaataggaattgtctgcactcacctatgccttcatcccctttactgccggcaacctttgggttcccagggctttatctatgccgtggagcatggcctccttccatgaagcagaggcttaatcagcaggaatttgtcctacccatttatactgtgcctgttgcctcacttgggattcttcagatctggttttcctttctagggcttcaacccaaagtttaaaattgagtttagggcaaaaaggtgcatcagtgggtgcatggattcatttagattaagtccatgatgggtcctgtcaaacttgcagttatcagccagcggggccactcctccattgctgccctatcataaccagagtgccgaggtaggaaaagaaccctatcacatagaaaaagaaaggaaaaaaaaaaaacagctgaagagagggggaagaaccccttgctctatgcaaatgggttcctttaatcactgtattcttcccccgctttggactgagctgaactcctcagccagaggagtaaaggctctatgggcgtgtgatgggaggggacggtgagtgggaaatgctggacagctgcccgtgtggggtccctgggccccaagactgccctggggccctggctgcagctgtgattttctcctgccctccatggctgttggaagtggcacatgcatgctttggacatgcccaagtgccccagccaggaggggaggggatggagaggaaactcactgcgtgccatgcatgtctgcagctgttggggtgggggtggggatggcacctctaagaacaaacggaaatcacattgttctgaattgcatatctgattgctgggccaaatgttcattctacttaataacatttctgcagtttgcagcaaaactcttaacattataaaagaagcaataggagccatttcaaaccatagaagaagaaaggaaagataccacagaaaaatctgagcatcttggcggaccacctattacattggggatggggtccagttcaggggccttctggcaacaacgaggagtggcattggccagatgccttcagctgccccaggactttattctggtcccacatgatggctagacccatgtgaagggaagcagagccttttacccaaaagagaaatggcagggttgcatcctgccccctgcaagtggcatagatcagaggaaagtctgaggacaagaaaagacagatccacatttttgcatttactcacccttctgacgtatcccagacaaggccctaaaatggagcaggaaatttccctgacccctttgcaggcaggaactcgagtgcaggggtgctagaactagctggctgcttcagtgctggcagggatggactccacttgcttggtcccactgccttccacccatcacaggacggggagtgcaggtgagcaggtgcaggaaccagggcgagtgcttttgggtgctggcaggagcaaaacttcatgtggatctgcagcagcatctggcgggggtggggccatgacccctgaagccccagaaagagtgttacaatcagtgctctttcagctttgccatccacatatggcttaagtgttaacagctcagtggagggtcacggtgactgccttttgcacccacacccgagttcttgtccagtgtccaggaggaatgaggtcacatgaacaaattggagatggtaaacttgggggattttattgccaatgaaagtggctctcagcgggaaggggagctgaaaaggggacggagcaggaagatagtcttcccctgtagtccagccatccccgaccagactcctctccaaagcaatgctgtcaagctgtccttctgaagtcaagctgactctctccaacattcaaccatagtctctgatgtccagctgcttctcctcttctcttctctctgctggcggagcctaggttttttatgggcacagggtggtgggcagggtgggccatgggtggttttggaaaaggcagcattcaagagggaaaacaggaatggatgttctcactttgggccacagttccaggcttgagggtgggacgcttgccggggacccactctcttctgcccagaatttccctgcctcctatccctatcagtatgtttcttaattttcaagtggttaaggatttgggaatttatctttttgttattttattcttattttacaggatagtgatcagagatggtaaactataaactttttcttcatgatcaattttaaatgctccatgaatataagggaagaatgtattattctgtatgatgcaaagtttacatgtaactattatattgatgtattgatggtttttttctatagtcttatttttgtttaaaacttgttttgttagtttcacactaaaactataactgtccagtgggttcctcttgtctgctgcccagatagagctgacttatcaagcagaagaattggcaatacagagaatttaattgacatgaggtgggccatgcctctcagaatttggggactagggtttttctttctttttcttttttcttttctttttttgagacagggtctggctctgtcacccaggctggagtgcagtgacatgatctcaactcactgcaaccttgacctccctgcaacctcagactcccgagtagctgggactacagacacatgctgccatgcctggctaatttttaaatattttgtagagacaggatttcaccatgttgccaaggctggtctcgaattcctaggctcaagcgatctgcccacttcagcctcccaaagtgctgagattactagaatgagtcactgtgcctagcttagggttttccaaaggtagtttgggggaaggggtgggagtggttagtcattgccattgggaagtggttctcttgcatgctgagtcgcttctgggtcggagcacatgagtgattggcaggtacaggtggagccattcatggtcagatctacaaaaaaacctgaaaaggtatctcaaaaggccaatcttaggttctacaatagtgatgttatctgcaggagtaactggggaaattgcatattttgtgaactctggaataatggcaggtaatcatttatgtctacatcttagcagaattcaggcttttctatgctttgagcctggtggtctctcattagctttacaaagatggtcgagttttggggaagggttcttatcatttaaactataaactaagcgtctcctaaaattagcttggcctaagcccaggaataattaagggcagcttgaaggccaaaggctagatccaatttccatcactgacatcgttttctcactgttataagttttgcaaaggcgatttcaaaattgtatcttttttctatcttatccctttctatttttaaggatatttatttcctagaagtggaattgacagtttaaagtaaagccacgtttcaatgtattgacacatattgtcaacagtctctatttgccaaggcaatttatactcccaccagaaatgtacaagggggcagattttcctttaccatgctgttagagtgctactaaattcagtcacctacacttagcctttttggtcatctctcagagaaagattgttggatgctgggcagtagtagagagcaggagctcccactgggttagggttaggtctgacaaaattggtgaaggtcatccagtgggcatagtacccctgttacaaataagactgttgaacttttgaggtttgggttgcttcaatacagaaagaggtcacagaaatcagaagcagttttgattaagcagttaaatgtccccatgttcgacttaagtagttccctccacactttctgccatccctgcatcctctagatttctcactctctttgttctgcccagtgatgaccttttcttctctctggtgtgtccttcaaaacttgttttctgagatactgaaattcacaatgacatatgaatgaacagaaaccactgtacagggatctgccttttcataaaggacatacgttcctgaaagtagaattttaagcatggatggggtgtatagtaccaatgaggtcttctatttcttcactaggaaacagcactcattaattattcattagaaatatacatggtatttgaaaaaccagtattaaattcctcttcataaaatacctgattcaaacaaatcaactgtaaaagtacacttttttatgtaatcaggacaatttaagtatagaacaagcattagatgaatgatattaaggaattattttattcactgtgattatgcaaaaagatatacttttgtttctgagatacaaactgaagcattaggggtgaaataacataacgttttggatttgctttaaaatgcctcagcagacagtaaccaaagcagcatggtactggtaccaaagcagatatacagaccaatggaacagaacagaggcctcagaaataacaccacacatctacaatcatctgatctttgacaaacctgacaaaaacaagaaatggggaaaggattccctatttaacaaatggtgctgggaaactggctagccatatgtagaaagctgaaactggatcccttccttacaccttatacaaaaattaattcaagatggattaaagacttaaatgtcagacctaaaatcataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaattaccatcagggtgaacaggcaacctacagaatgtgagaaaatttttgcaatctactcatctgacaaagggctagtatccagaatctacagtgaactcaaatttacaagaaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaccaacaggtgctggagaggttgtggagaaataggaacacttttacactgttggtgggactgtaaactagttcaaccattgtggaagacagcgtggcaattcttcaaggatctggaactagaaatacaatttgtcctagcaatcccattacccagcaatcccaaagtattataaatcattctactataaagacgcatgcacacatatgtttactgtggcactattcacaataataaagacttagaaccaacccaaatgtccatcaatgatagactggataaagaaaacgtggcacatatacaccgtggaatactatgcagccataaaaaagtatgagttcctgtcgtttgcagggacatggatgaagctggaaaccatcattctcagcaagctatcacaagaacagaaaaccaaacactgcatgttctcactcataagtgggaattgaacaatgagaacacatggaaacagggaggggaacattacacactggggcctgtcggggagtggggggctagggaagggttagcatgaggagaaatgcctaatgtaggtgacgggttgatgggtacagcaaaccaccatggcacgtgtatacctatgtaacaaaactgcatgttctgcacatgtaccccagaacttaaagtataatttaaaaaaatgcctcagcagaaaaaggagggaatagatcaaacaagtatagaaaaatgttggtggcttttgaagctgggggatggacacacggggcttcatcatattctctagttttaaatatgctcagtttcacaataaaaatgtttaaaattgcaatagtaacatattttcactgcaaccagttttttaaaaagccaaaatgcataaagctatcatttttaagttttccttgccctcttttcacacaatctatggcatagcttatttttataccaaatccatttttatcaaagtcctatatccccattctcaggactagcctagttttctcccatgcccaatttatcttccttttcattacattgtttgaagctcctcagtgaggagaatgtgatgatagggaaagatccaggtgtaagagctaagccatattattgtttgaacatagtctatgggaaagtggctgctaaggagatgcattctttattagaaaatatatttggaatctggtgctgaggatgtgagatctgaactcagtaagagatcatagacctgaattgctacaatatattcagaccaaagtagctgaataagttagctcactatccaaataaggacgacttagccttttaggttctagattagattaagaagaatgatctatccacattttacagaatggaagtcatttctgagtaaaaacttaagtctttaaattatttagaaacatttttatctacatacatatacacaagttataagttccaaatctaccgcaaataaccaagaaaatatcctggagtttatcagttgtaaatgataaactctcaagagttgaaatgccagctatcctatagatgagtaagtagagacataaatcaaaacctgaatttcagctttttgggaaagaagtactttttgggaaagaggtaccagaccagcgtagcaacttggagttggagaggagtaggcatggaaatcaatatttatttaattcctactatgttccaggtagtgtgctaagacctttgtctctgttatctcatttgattctcataaccacttgtgaggtaggtaacattgtttctattttaccagtcagaaagatagctcagagatgttaagtgacttgtcatgaagtcacttggctttcaagcgtcaaagcaggaatgcagattcaggccagcctggcttacaatccagactttttcccactctactctgctgcctgagtagaaatggaaacttagcacaggaaaatcctcaaaaaaagggaaaggtggttttcctcaaaaataaaaataaaaataaattttagctacaaagagaccaaaaacaaaacaaaacaaaacaaaaacagggcagattagaatggaacatggcagaagtcttggccttggagttaggatgcccagtttggttgtaactctgtcatttgctagcttatatgactttgataatttactttacctctctagatctcagtttcctcatccataaaatgcagacagtagtgtctaccctatctaatcaggttgttgtgaagatcaaatatagagatcaaatatatctgaaagcactttctaggccaagccataacaactacacagctgtaataactatacaaccataactaattatttcttttactagcagtaacaatgtattaagatggccagatttttggaatttcccagcaggttgagatcccttcccgtttttgtttttgttttttttccaggagaatctcttatttatttatttatttatttatttattttattatacttttaagttttagggtacatgtgcacaacgtgcaggtttgttacatatgtatacatgtgctgtgttggtgtgctgcacccattaactcgtcatttacattaggtatatctcctaatgctatccctctcccctccccccaccccacaacaggccccggtgtgtgatgtttcccttcctgtgtccatgtgttctcactgttcagttcccacctatgagtgagaacatgcggtgtttggttttttgtctttgcgatagtttgctgagaatgatggtttccagcttcatccatgtccctaaaaaggacatgaactcatcattttttatggctacatagtattccgtggtgtatatgtgccacatttttttgatccagtctattattgttggacatttgggttagttccaagtctttgctattgtgaatagtgccacaataaacatacgtgtgctcgtgtctttatagcagcatgttttgtaatcctttgggtatatacccagtaatgggatggctgggacaaatggtatttctagttctagatccctgaggaatcgcaacactgacttccacaatggttgaaagagtttacagtcccaccaacagtgtaaaagtgttcctatttctccacatcctctccggcacctgttgtttactgactttttaatgattgccattctaactggtgtgagatggtgtctcattgtggttttgatttgcatttctctgatggccagtgatgatgagcattttttcatgtgtcttttggctgcataaatgtcttcttttgagaagtgtctgttcatatcctttgcccactttttgatggggttatttgtttttttcttgtaaatttgtttgagttcattgtagattctggatattagccctttgttagatgagtagattggaaaaattttctcccattctgtaggtggcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggagttttatgcttttaggtctaacatttaagtctttaatccatcttgaattaatttttgtataaggtgtaaggaagggatccagtttcagctttctacctatggctagccagttttcccagcaccatttattaaatagggaatcctttccccattgcttgtttttgtcaggtttgtcaaagatcagacagttgtagatatgcggcattatttctgaggcctctgttctgttccattgatctatatctctgttttggtaccagtaccatgctgttttggttactgtagccttgtagtatagtttgacgtcaggtagcgtgatgcttccagctttattcttttggcttaggattgtcttggcagtgcaggctcatttttggtttcatatgaactttcaagtagttttttccaattctgtgaagaaggtcattggtagcttgatggggatggcattgaatctataaattaccttgggcagtatggccattttcacgatattgattcttcctacccatgagcatggaatgttcttccatttgtttgtatcctcttttatttcattgagcagtgttttgtagttctccttgaagaggtccttgacatcccttgtaagttggattcctaggtattttattctctttgaagcaattgtgaatgggagttcactcatgatttgactttctgtttgtctgttattggtgtataagaatgcttgtgatttttgcacattgattttgtatcctgagactttgctgaagttgcttatcagcctaaggagattttgggctgagatgatggggttttctaaatatacaatcatgtcatctgcaaacagggacaatttgacttcctcttttcctaattgaataccctttatttccttctcctgcctaattgccctggccagaacttccaacactgtgttgaataggagtggtgagagagggcatccctgtcttgtgccagttttcaaagggaatgcttccagtttttgcccattcagtatgatattggctgtgggtttttcataaatagctcttattattttgagatacgtccaatcaatgcctaatttcttgagagtttttagcatgaagggttgttgaattttgtcaaaggtcttttctgcatctattgagataatcatctggtttttgtctttgattctgtttatatgctggattatgtttattgatttgtgtatgttgaaccagccttgcatcccagggatgaagcccacttgatcatggtggataaggtttttgatgtgctgctggattcggtttgccagtattttactgaggatttttgcatcgatgttcatcagggatattggtctaaaattctctttttttgttgtgtctctaccaggctttggtatcaggatgatgctggcctcataaaatgagttagggaggattccctctttttctattgattggaatagtttcagaaggaatggtaccagctcctccttgtacctctggtagaattcagctgtgaatccatccgatcctggactttttttggtttgtaagctattaattattgcctcaatttcagagcctgttattggtctattcagagattcaacttcttcctggtttagtcttgggagagtgtatgtgttgaggaatttatccatttcttctagattttctagtttatttgcttagaggtgtttatagtactctctgatggtagtctgtatttctgtgggatcggtggtgatatctcctttatcattttttattgcatctatttgattcttctctcttttcttctttattagttttgctagtggtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttctctagttctcttaattgtgatgttagggtgtcaatttcagatctttcctgctttctcttgtgggcatttagtgctataaatttccctctacacactgctttgaatgtgtcccagaggttctggtatgttgtgtctttgttcccattggtttcaaagaacatgtttatttctgctttccttttgttacgtacccagtagtcattcaggagcaggttgttcagtttccatgtagttgagcggttttgagtgagtttcttaatcctgcgttctagttagattgcactgtggtctgagagacagtttgttataatttctgttcttttacatttgctgagaagtgctttactgtggtcaattttggaataggtgtggtgtggtgctgaaaagaatgtatattctgttgatttgggctggagagttctgtaaatgtctattaggtctgcttggtgcagagctgagttcaattcctggatatccttgttaactttctgcccgttgatttgtctaatgttgacaatgcgggggtgttaaagtctcccattattattatgtgggagtctaagtctctttgtaggcctctaaggacttgctttatgaatctgggtgctcctgtattgggtgcatatatgtttaggatagttagctcttcttgttgaattgatccctttaccattatgtaatggccttctttgtctcttttgatctttttgttggtttaaagtctgttttatcagaggctaggattgcagaccctgcctttttttgttttccatttgcttgggagatcttcctccatccctttattttgagcctatgtgtgtctctgcacttgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcaatggtctttacaatttggcatgattttgcagtggctggtaccggttattcctttccatgtttagtgcttccttcaggagctcttttagggcaggcctggtggtgacacaatctctcagcatttgctcatctgtaaaggcttttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggacccggcctttctctctggctgcccttaacattttttccttcatttcaactttggtgaatctgacaattatgtgtcttggagttgctcttctcgagggtatctttgtggcattctctgtatttcctgaatctgaatgttggcctgccttgctggattggggaatttctcctggataatatcctgcaaagtgttttccaacttggttccattctccccgtcactttcaggtacaccaatcagacgtagatttggtcttttcacatagtctcatattttttggaggcttcgttcatttcttttttttcttttttctctaaacttctcttctcacttcatttcattcatttcatcttccatcactgacaccctttcttccagttgatcgaatcagctactgaggcttgtgcattcatcacatagttctcgtgccatggttttcagctccatcaggtcctttaaggacttctctgcattggttattctagttagccattcatgtaattttttttcaaggtttttaacttctttgccttggattcgaacttcctcctttagctcggagtagtttgatcatctgaagctttcttctctcaactcatcaaattctttctccatccagctttgttctgttgctggtgaggagctgcgttcctttggaggaggaaaggcgctctgatttttagagtttccagtttttctgctctgttttttccctatctttgtggttttatcttccttttgtctttgatgatggtgacgtacagatggggttttggtgtggatgtcctttctgtttattagttttccttcttacagtcaggacccttagctgcaggcctgttggagtttgtgggaggtccactccagaccctgtttgcctgggtatcagcagcagaggctgcagaacagtggatattggtgaacagcagatgttgctgcctgatctttcctctggaagttttgtctcagaggagtacccggccttgtgaggtatcagtctgcccctactggggggtgcctcccagttaggctactcgggggttagggatccacttgaagaggcagtctgtctgttctcagatctccagctgtgtgctgggagaaccactcctctcttcaaagctgtcagacagggacatttaagtctgcagagttttctgctgccttttgtttggctatgccctgcccccagagatggagtctacagaggcaggcaggcctccttgagctgcggtgggctccacccagttcaagcttcccagctgctttgtttacctactcaagcctcggcaatggtgggtgcccctcccccagccttgctgccaccttgcagtttgatctcagagtgctgtgctagcaattagcgaggctctgtgggattaggtccctctgagccaggcgcaggatataatctggtgtgccgtttgctaagaccattggaaaagcacagtgttagggtgggagtgacccagttttccaggtgctgtctctcacccgtttctttgactaggaaagggaattccctgaccccttgagcttcctgggtgaggcgatgcctcaccctgcttcggctcacgctcggtgcgctgcacccactgtcctgcaccctctttctgagactccccagtgagatgaacccagtacctcagttggaaatgcagaaatcacccgtcttctgcgtcacacacgctgggagctgtagactggagctgttcctattcggccatcttggctccatcctcctgtttgttttatacctttttttttttttttttttgagaaagagtctcaccttgtcacccaggctggaatgcagtggcgcaatctcagctcattgcaacctccgcctctcaggttcaagtgattctcctgcctcagactcccgagtagctgagattacaggcatgcgccaccatgcctggctattttttgtatttttaataaagatagggtttcaccatgttggtcaggctgagcctaaaacagacctcaagtgatctgcccgccttagcctcccaaagtgctgggattacaggtgtgaaccactgcgcccagcccatcctaatcagggcctctgacccccttggggttttccccgtagaaacccctttgtttatttcttgactcacaaggtagttgagacctctggaaatatgttctcaagacctctttgttgcccagtcacagagttcagcgttggttattattctgaggcttcccttccctctgatgcttacaaacagaattcctctggtccttgtctttcaggctctttcctggtacttcctatttctctactccctcagcttagaagcaacataggctcttcttcagctattttcactcttctacttgggcccttgcttcttctgttgggctggaatcagactgttttctgtctgcctggaatcagattttttcccttttgtcatccagagttccctgtctcagaaagaatgacctctttctcataacaatgcccttttcgaccttagctatgagagttcaaatttccctggccctcccagtagaaattccttgctctgtatatatacagggagtatcacgatggtgaatccatccctcagaaacaaatgtcttgggaggagtgcttatgtcagacttgagtacagagagtggctaaatgctccccacaatctgatctgagacttaagaaggcggaaacattcactggcttgctttgttctcctccctttccataattccttggttgtgaaggcagtgaaaaggatggccttggaaaaagccctagactagaaatcaggaaacctgggttctgctgctggctctgtcacccactagtcacatgaacttgggtggaacagcctgtgcaaacctctattagactgcttgctcttccatgaaggaatttcttggttacaggctgtttccttggttggactagaagcttcctgaaggtagcagccatggccatgccacaatcattttggaaactgcagtttctaactggtctctctggcccatcctgttcccctcctatccattttccacattgctgtggaaatgaacttgtaaaatgcaaaacctgtcatgtcactccctaccacaaaccctttaatggttcccccactgcctttaaaacccattatgatctggcccctacctacctctctagcatggtctcccagacctttttgctgtcttcgtcttctctgctgtgaatctccccttcctctagctaactctcattcattccttaaaaatatcacatccttaggaagccttccttgaccatctaagctccccacttgacaactgttggttaaatccccatcttataagcacccaaagattatcctttttacgtgataaacctcttttgtagcactcctcaaacaggtaactgctcagtatctgcttccctgctcattataagattcacgagatgatggcagaggccttatctatctcgtgtattgctaagtgcttactaaaatgcctagcacataataacagtaaaatttgttcaatggtaatatgaaatgacctgtaatgtatccacataaatgagtgttgactgcttcaagaattgggtgtatcctccatggtaagagtgatgtctgtctataatctttcatgttcttacggctttctgaaaaacagtgctattattgaaatatctcccataaacattataaaacagtaaaacagttaatgtccttttgatcctataatgtagtattacacagatcttctcacttcgggtaaaaaacacagtctttgtcagtgcttctttttactgctagactatgaaactatgaattttgcttattagctgaaatattactagaatgtttatattttgttaatatctcaggttaacagtctgctatttgattctttaacctgtcttgaaaaggcatgtatatgtctcattattacttaaagaaatcgggtagctgatttgagaatataccattatgttaactttttagttgattctatttttaacatgaaaataaacaagtcaatttaaaacttttaaaaaggaacgattaagtagatatattttatcttgtttttggaggaatgtcaatattgtgaagcacttttccaagtccttttaagcagaatatgagttgacttattaatagtaatatgctcactgggagacagtaagtggaaagaaaagtgatagacttgagtctgtctggctctgttttataagctgcgtacactgaacctcattttattcatctaaaaaataggatgatagtatgtactttgaagagttattctgaaagttgaaaataatataaagtactagcacatctaatgatgtccttttgccatctgtactttatatgctgttcattcattccaaaaatatttaagcgcatttctgcattgggccaggcactggcaacataatggtggacgtcgcacctgtcttcacagaacttacactccttcgattttccatctgtaggagtactgctcagctcagccttcacctcctttaagaagccatcacccatgctctaagcctcattccctgcctccctcatctggttcaggtgttcctcctctgtgtcttcagggtaacctgtgcatactttcatcatagcacttctatataccgatttgtctccccaccagactaagctctcaggccgagtatggtgtcctatcctttttttttttatacccagcacatggcttggtacacgaataggtaccgagaaaggatatttggataaacattgccatctggtggccagatgttgtaagtacaatcttttatgcatcataagggtgagtaaagcccaggtgagtaaagcacctaggaaaggcaactttttatttattttaacacagggaaaggaaatatttcagaatatgtggtctcctagaatctcctaggtctcctagaggtgttgttattccaacgtctctccaaatctttcataattcagaaaacaatatttaaatgacacaacagataaaactattttgagtgtgcaaaaataaaatgaaagagaaatttgtctcatgtaataaagaaatgtaacatagtatacaataccttttttcataatacctttatttcaatgcctacacacattcattcattcaacaaatatttactgagcatttactgtgtgacaagcactattctaggtgttagggatacagtgaacaaaaagtgcttaaacttaaggagcttacattctaatgggaggagacacacaataaacaaacatatttttattagggattataagtattacggataaaaataaactaggttacagagtggggtgagtgtgtgtgtgtgtgtgtgtgtgtgtgtgtgtgtgtgaaagagagagagagagagagaacgccagttgagcaaaggcctgaagatatattagaacttcagaaaactacagaaatgttggttgaccaggcctgcctaaaacattatgggacttctagagagttttctttcttttttctttttaaaaataagtttaatcttacataaaagttgctaaaataatacagagagttcccacatacatttaactaaccttctctaatgttaacatcttacataaccacacaactatcagaactaggaaactgtcattggtacaataattctattgagcaaactatagacctcatttgatttttaccagcttttgcatgcactcaactttttttggggggggggtggatagttctattaatcttatcacatttatagattcttgtaatcaccactgtaattaggacattattgttttatcatccccccaaaactcatttgtgctacttctttataggcacatctgtcccccagcaaccactgatatgttcatcattactataattttctcatttctagaatgttatgtaaatggaatcatatagtatgtaaaatactgtgatttgctatgtcactcatcataatggccctgagagccactgaatttgttgtgtacatcaatagttttttattttttattactaagtagtattctactatgtgaatattctacaatttgtttatatgtgcccacggtgaagagcatttcagttgtttccagttttttgctaatagaaacaaagctgttatgaccattcgtgtaaggtttttgtgtggacataaatgttcatatttctagggtaaatacacaaggatgagagctagagagttttatttcttcagagggatttataagcaagtgccatgctttacaaaacaagcagtagattggaaagaacactggataggactcagaagatctggctcaagccttgccctgtcatttagtagcaatgtgatgctggataagcctctcccctctctaggccccatatttctgtctcttaagtgatggagtaggaatcgattatttcttcagtctttttaagatctaattacatggttctgacgagatagaaaggaggtttctgcctcatttcacaaaaaattttatagctatgtacataaaataccagatgaaaaacataggttatatctcccacctttttcttccatgttccaaacagttacttggtggcttacacctgtaatcctagcactttaggaggccgaaggtggatggatcgcttgaggtcaggtgttcgagaccagcctggccaacatgatgaaacccatctctactaaaaatacaaaaattagccgggaatggtggcgcatgcctatagtcccagctactcggcggggttgggggggtttgggggctgaggctggagaatcacttgaacttgggaggtggaggttgaattgagccgagatcatgccactgcactccagcctggacaacagagcaagactccgtctaaaaaaataaaaaataaacagttactttgcttacaaagagaatatgggggagacagtaactaagcctaaggctataaaggtttggttgtctgttccctgaggagaaaggactccaaaatcaacacagaatggccacatggcataatgccattcctaaggcatgtatatgaagcagattgtcctcacgctctgtctccattatttttattagttagacatagagtaaagtacatacaaaatatatgtgtgtatatatatgtgtgtgaactgtctatgcttttaaaatatgttgtattatgcatttctatacaggtactattttttttcaaaagtcaggaaggaaatacacaaaatatttgcaatggttaactctagagattgtgattgtcgtgagaggcaactctaaaggaaaaagaagtatatgtttgtgagcacagcctctctctctctcacacacacacacacacacgcacgcatacacacagtggttaaaaccatagacatgagccagactgcctgggtgcaaatcctggctctgatatttactagttatatgaccttgggcaagttacataacctctatgttttctcggtttcttctatagaatgggaatggtaataatagtacctaccttatggggttaatgggaaaagtaaacaagtgaaaatacatgaagcaattagaatagtgcctaacatgtggttagcactataaaagtattaactcttatgtactcctcccacaagcagatagaaaacttttctgtcagtcattgtctatctgaaggcctcacgtagcatgagtccctgagcccaattcactacgatagttatacttctagaaatggcttggctgccacctccccatccacactacttttctaactttaacagccaatctcccagctacctctactctcctaatccctcaccccttccctggccaaaaaaattacacactgaagctgtagattccttaactatgtctcagtattttttttgcttgctaaactgtagttactccagtacaggtgactaaaaattctattaataatttcatttatttcttgctcctttaagtgaccaccctccctcaaatctaaagaaacaggtataaccaattttttttaaatccctgcttcatttagtcatacttacgtaaagctggaaggaccatctttgaaatgttgcagtgtttacctttagaaaacaaaaaagaagattgtctcttcttcctcttccttttgtacatttgaaacttcctgatataacagggctatagtgctggtggtgatcatgatgctagtgctagtggtagtgatgtgtgtgtatgtgtgtgcgtgtgagagagtgtgagggtgggaggagagagggagaaggatccttaaagtgtgatctgggttaacactttagctttgatgctgccacagcaaatgctatgtctgttcataaacattgtgttttcttaaatgcatcattttaagaaagtaatgaattctttgcagctcagtaaggtgacaaggctgttcataataatttcttgataattcatcagatgtccaatttacctctcacttttccttctcatctcctttgcacagaaagtgactgcttattaaataaagccaaactcagcctcttttttctgttatggagtctcagaaggtgggatagtgatcacctgagtggtcctgggcaataatgggaagtgggaagtttgttgtgtccccctcccagttcttcatgtactgtgtctgccttctctcttcaccttgctctcaactaagatgtcaattaacaattcttaaggtgttactataatgctaagatcctgacatttttatccaagtactttcagagactcaaaatgacagcacagctctccataatatatctccaacccttgtttctagccttgtttgcctccattacatctgtcaggctgatctgctttaaccaagcacgttttctatttttctgcttatgcttttgctcatgctattcatgtaattcattctgcctaaacttgtctccccttaagctccatttctagctgcccaagtcttgctcatccttgaagaccagctcagctacatgaaactttatctaatcctctgattgtccttttccaaattttctctttcctatgatctcatacacctttaattgtattctattatattacttgttttgctggtctttaaattataattagttgtattcacactcatagtctctactagactgtaagtgccttgaaggcagaagctgagtcattttcatcgttatatcccactcagggaaacccagcactatgctggatacatgtgggatatactgtggtatgtgggagacactcaataaatgtttgttgaaataaaaacttccccaaatgaactttaatgccaaaatttcacaatattctggtgaaagggagatctatttgggcagaagatttcagagaataaactaggctggcatttactgtgtagagtggagagcactgagacggagaagccagtgaggaattccttgccatataattattattattattattgcatttcacttgagtctgggtatatgggatcatctactatttcatatatcttgttccatctgaacaggaaatctcagtgccttctgaactcctgtgcaatgatgcactataggactgatggatgtgactaagctgaggtgaaagtggaagtggggaagttatcgtgggagtgggttggagggaaggctgatgaactttaaacccaggaataaaataactatagaatgagcaatggaatatctcccctgccccctccccctccccccccccaaaaatcctaactatcaaataagctctctgaaagaagctaagggtaaaaaggtctagtccatttacatttcaatacagaagagaaacaattgccaaaataactttttgcagtttcttaaatctttgcaacttatggctttggcgaactcccacctatttatttcctagtattgaacagtggtaaagtccttccatcaggggccttatgtgtttgtattaagaataggtggaaattggggaagactaggtcttactctacagtcagtctttgggctgggaggtaatagggtaggatgggcagttggaaagaaatatgcaagtcaaatttttgctgccttaagaagaaagtaaaagagcaaagagcagagaagaggacctggagacttaccagggagcctgtgttgcctagtgtttaggacttggaagattgaggctaagactcttagtcataaacatcacaaactgcctcccaaaagtctttttggggtgggtggatttatacaagtaggttgccaagattgacctaatggtattttcaaggaggatagattttttttccacagacataaagccatttagacaaaaccactaacctaatacaaagagcgaatgtcaaataaagagctagggtcttccacaaaccaaccaaccagccaagtatgcttattaaggtaacccagttattttcaattaagcgttaataagcaagtgaaatacctcaatgtattatgtcttcaaacaaagaaaataccaggggctttcaaatgtcttccaagcaatttgagttgttttattcacatcacaaagaccggttttccctgaagtatttcctgttcagaaaacacttaaggaccctgctcttctggggtgcttcttgacatgaaaagattttaatgtcattgctttacctttagtttggaattgtgcctcttcagccaacttttcattctattagttgtgcctggttttatctcccctgatgtgactgtccaaaaaacattcccaccctagctccctcatttcaccttatattttctctacaaaatacactcactggagtatattttataatgcttggcattcttattttgatttttttactgtgctaaatcagtcagtaaatgtttgttgtaaggctttgtaccagttataatgggagagacaaagtagtgtaaaatcttccctcaaggagcttgctgtctaattgaagatatgtaagcaaaagagtgcttcttatatttgatatttcctttctattactgatattctccttgggtatgccctgtccacatcacaacagcctcctaaatagtcctcaggtttactattaccctccatcaaatcagtccctgttcatcttcttaaacaagttcactgtggtacttctcgcaccaccttacctttcctcccctcaaaaatactacttaaagataccatattgcctaaaaataaagttcagtctcatttgtttggcttgaaatttctctccttcacacctttttaatctaagtcttattccatctttaagatttaattcaacttccatttcatccatgcatctttccttcacttacccaccaaaagtaatctttccttttaatttcagtagattatagtctacatcacccattcagtatttaatttatgctaccttgattggtttcttttatatgtatatggctcttccccatccagtttgcaaagtttttgagggcagggccttagcataatgctttgcacagaaaagatgcttgataagatgtctggtaatgaagacatgatttttcctggcttcagagtagaggaaggattatgaggatgggtggcaaaggaaatattctggaggtagggagattaattaacgaggtttttgcaacaacagtcctatcacaataggtgataagggcttcaacctattggttccttggctcagatcctcactatattaacgaataagggtagtcaagtgaagcagtgggaatggagaaggaacaaagaaacctgtaactatttgcgatcagttggttgtaaacactactgcacttggaccagccactgaggaaatttagcatgattaaaaaggaaaggagggaaggactttgggactgctgtgaatttatgtggggacaaaggagaagtagcagtcagagtttactgaacctgagtaactgcaataatgatagtagcattgacacaaaaataggaaaatcagaggtggaagccagatctggagagaaggtgataagtttgtttttagacttactgagtttagggtaacttgagtaacaaagtggacatgtctaatgaggagtaaaagataccttttttcacatttaattcaatccaacaaataattacggagcatctactatgtgcccatcatgatagtggagctagatatagtcacataagacacaattcttgccctccagaactcatgatggagtgaggaagacagactaatatgataaaatataggaaatggtataattgaactatatatagagtatgtgaaaatataaataggggatcaattgcttgtgtccaagcaagtgagaaaaatcatagaagtgatgatctttgagaagggccttaaaagataagtagaaatgtgttcagtaaacagatggggaaatgactttccaagtaaaatgacaatctcgggcaaaggcacaggacatgaaagtgcatggcattctaggggaacaacaaggagtctgaagtgactaatgagaaacggatgacagaataaagatggatgatttgaaagagatgatgattttcagaaattgaagaaaagggtgttgttacactcaactggagagcagcatatgtgtaaggttaaacgtgtagtctctagtattgcactctctcagcccaaatctcatccctgctatgtactaactgtgtaaccttaagcaagtcacttaatctctctgtgcttagttttcctcatctgtcaaatgtagataaaggtacctacctcgggactgttttgaggattgagagagccaatatatgtaaactaattagagcaatgccaggcatatagtgttatgtaaaggctagtccgaggattacattttaagaaaccaggtacgacatcattgtgtactacaccagtagccacctaaaaaagaaattataaatggcaagtgtctaagtttctagatactgtaagcaaggacccagagaaaactaaatgaatctcttagtctcagataaaggagttcgtgagctggtgagatatctgccttggaaaggtagatccaatttagggaaagggtgaggtgtctgagaaaaaaaagtagaatggctagagtgccattcagagtaaacagaagccccagttgtgacattgccctagaaaatggaaaaaagcaacataagattgtcactcagcaacagacatattttatttcagttaagtaggaaacagaaaattagccatcagtgagcttcaagtatgagagagggggtagtagggtccagtgacaggtattttgctcgggttggagaatatggagcaaccctctgaagagggatagcaattggaaatgcagccctaccttgctaatgaagcacatctagccccttgagttttgatgctctcaagtaacccattgtctgttcctcagccttctagagctctgctcgagtgatccttgaatagactcttggaatgcttgtgcttccctgtatgactgctctgtgtgctgctgaaatggaactgaacctcgcccgcccacccagccagcccaggggtttcacttgacagaactcggtttgaattctggttttaccacttactagttgtgtgatttttgagcaagtcactaaaattctctacgcctcagtttccccgtatgtgaaatgggaataaacatggttcctatattgtaaaattgttatgataattacatgaaataatttacctatgaagtgcttggcaagttaagtactaaaaagatgttagttcttttctccttcctttcctgttatacttgggcagccccaaaatcccctgctctcattttagcccctcctgggggctctgtaccatctagtgtcaataataatagagatgaggagaaggagaaatcaatccatggaaagaaaatgcagaatggtagtttttttttttttccaaccctgactttgcagtaaagatgttttgatgtagccagtatcccaaaataggaaaggtattcagatactggacagcccaaggtgagaaatacccactaaaacacgacaactatctgaaaaatatatacacatgaatatatgtttaatgatatatttaatgtgaaaaattagaagggaacaaggaaaactgaaaatatttttgttagcacaatatattgttgtaatgttatcttaatattgtgcctgtggaggaggatactcttttcttgacatacataaatctccttaccctctttccaaaagaacagcaggaggaaagggtactggagtaaagggaattgttcagtgggaataacatgcccccatctcatctgtccttctgcccagccttccattaaccatcatgatctaccagaggcctggagagcttcctaactgtggtgcttcaatgcccttgcatcattaatatcatcatctctacccttcttctaggagtggatcttatgagggaggtatggaagaagttgtgcatgcttagctgtcagtccgaaccttttagagccagcaggggacaaaggcaacaatcactgtgtaatactctgaaatttcttggcaggtgaatactgctatgcatgaggcaaaacttatggaagaatgtgacgagttggtagagatcatccagcagaggaagcaaatgatcgctgtcaaaatcaaagagacaaaggtaaagcgcagcacttcagtgaatccaaggaagggttgactttacaaatatcaaagtttgatccagatgattctggtttgatcatgaaatcaagaagaaatgagattatagggggagaggcaaagaagtgatgtttggcctactgctctgaatccagtaaaaacgatggccattctggggtgttagaaacgttctatatcttgacctggtttacgtgggtgtatgtgtaggcaaaagttcattgagctgtacacttaggatttgggtgctttactgttgtatgttataactcaatgaaaaggaaaaaagtaatggtagaaatgtgagtcaggattatggaccatgaattccaggatgaggactctgggcttaatctgaaaagtgttgggcagccattctcgtttcttaggaagggagaaagacggattgatatggcagaggtatgcagggtagatcagaatgggatgataccaaagtcagggtagcaagttatgagacttatggaatgatgctttgtaagagttgataaagacctaaaccagagtagtggcagcacaaatgggagggaagaacacaacaggcactgctagaaaggaaacgataggaaacattgaacttttaaatataaaagacgaatgagagagagggaagactcagtgaagacattcaggtttctagcctgggaactgaagaatcatgatcataagcgtcaagtgtgagcctccatacagctatatggttttaggcttgttggcttgctcgtcagtgttagtggttataagttcatgctgtgtgtataatgtgagatgttttgagaggctagagtgatcactaataatttgtgccatgctgagtggttatagcttatccaggaaactaaagtttccaagaatacagatttgtgaacacacaggtatgcataaagacacttagagaaatatgtacatagaactgtagatactcataaagaaaaagatggtactttttagtaaacatatatgtgaaaatatattgacaacaaaatgtaaacaaacaaaaatgtaaacaattataatctctgggtggtagtgtttcttttatactttttattttctgaattttctataatgggcatgcattgatttataaccagaaaaattagtgttactaatacacagaggaggtagataaccgagagtatatgactgtgttgcagcctaagtatgcaagcagtagataagagaaggaggggttggcacaagagacacagtgggtagggtgagaaggtgagtggttagtacagggaccatggaatattaataaaccttatttttagaatcactgcagcatgcctccttcatgttgttttttattgtttttaattaagcactgcatgttttatcttatttttttcttttactaattccttaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagaggtcagttccttatattctttggaaatgcctgctcttgtgaaaagaggccaatttaaagtcacttaaagttcaggcatgtatctaacagctgccacctgaagattttaccagttaagtagttattgagcctcagtggtaaattaccctttggatttctggacccttgtctctgtctctgcagcctatcagctcttttaaggcacagtcaagtaccagccgtagctattgccatagctccttgctgctcactcagcgcatgagttttctatgatggtgttggtataagggtagagaaacttttagctatattgataggtgcgtgctcttctcagtctgcatgcagtttctattgctttcatttagttattctgcacataaatcctttatggcagtaatttttaggcctttatttaatcactcacccctttctaaattagatgagagtcatgaaccttcttccagaggaaaaacaatgcatttaataaatatacacagataattttctatactatttcagaggacttgcagatccttagaagcccatccatagaccactggcaaaaaaaccagggtctaaagtgaaacattgttcagtatagtcaccaagacttcaaggggctgcagaggctcataaggccagatttgacctccatatatctccttctcattcattgaagaccttggctccaggctcgcagtgttcctcccattgcctctgccatcattttgggtgacttcagcaacaaccacatggctgactcatctaatgctttagccatctagcttctttaacatcccctccaacagtgactctcacctcagagctccatctcatccacccattttcatggaccacatgctgaatgaacttcaccatcactcagaattgcactgaaatcataacttaaaacatgccagtttttaactataccctctacttaacaactcttttttcttatttttgttttgttttgtttgagacagagtctcactctgttgcccaggctggagtacagtggtgcgatcttggctcactgcatcctctgcctcccaggttcaaaggattctcctgacttagcctcccaagtagctgggattataggcatgcaccaccatgcctggctaatttttgtatttttagtagagatggggtttcgccattttggccaggctggtttcgaattcctggcctcaagtaatatgcctgcctcagcctcccaaactgttgggattacaggcgtgagccactgccctcggccaacaattctttttttcttcaaatacgtgtatacttcaactttgttgagactgctaaggcctgactcctatactttcttccgacctaccagctatttcctgtcttcgcttctttctttagcctatttaggatctgtgatttctcacttcagatactctcttttcaatattctcaatccccttgccccattgtccttttaacataccaacctgataaagtcctaatcctgaatcagtcccactttttccattcctatatttgagttgcagcaccctactggagaaaatcacataaccaaagaggttggtactactgcatcacaaatgtatagcttctaaacctcacctgggccttcagtgctaacctgaaatccttctgcattgctttggtcagctttctttttaacttgtcatcataatggctatctcaaatcttttgtacttacctcaaaattccaactctgccacttttctgcttatgctcagtaaatgccctcttattttacaaagaacagtaagtgtgaaatagcgaattcaacttctcatatcaaacttctgaacacacttaggtccacatccattaacttctgccttccttctgattaaaatggaagagatgtctcttcatttgtgctttggccaaatacactcttttttccatagcttcaatttatccctctctatagttgacttcacatccatttttaacccactcatgtctttcctacctaaaaccaaccaaacaaaaaaaccccatgactttcctctacttcatatcccctccaattatcacctgtccctctccttccctgcacagcaaacttcgcgaaagactttacatttcttcacccctaatttactcttctgaaatatttaaaatgtatttatatccaagtaataccttgtgcatagttagaaagtaaaatattactataagtcatattgcaagaaatagcaatctcctcattctcaatgtctgctctctgataataccattatcaatagagttcttactttgtactgggcattattttaagccttcataagtattaactcacttaatcctcaaaaaaactttatgaggtagatactacttttatccccattttataaatgagagaacgatgttcagagaggttaaataacttgcttacaattgtccaactagtaaggggcacaggcaagattcaaatttagggagtctagtgccacagtctacacttttacaacaaagccaagcaatttcagctctatcagatgtttttattggcatgaccttacatttctaaataacatccttacattggtagttttaatttttttcaactttagacagtatcaattaacttctgcaaatttggactttttttctgccactacttctacaaatatttttatgccacttccttcctctctattcgggattccaattacatgtatatttggctgtctgaaattgtcctatagcttaccaatgctctatttttgttttgcagtctttttatttttttgccattgtgaaaacacatgcaagtgtgtttcattttggatagcttctattgatatatcttcaagttcactagccttttcttctgtgatacctaatctgctgttaacccctccagtgtattttttatcttagatattataactttcatctctagtttgatttgggtcttttaaaaaatgtcttccatatctcaagatattcaggctgggtgtggtggctcacacctttaatcacagcactctgggaggctgaggtgggaagatcacttgagaccagcctgggcaacatagcgagattccatctaaaaaaaaaaaaaaaaaagcctgcatctggtgacatgtgcctgtagtcctagctacttgggaggctgaagcaagaggatcttctgagcccaggagttcaagggtacagtgggtcacgatgctgccactgcactccagcctgggcaacaggacaatgtcttgtctctgaaaacaaaaaaagatatttagcctttcctctagctttctgaacatatggaatacagttaaaataattgcttttatgtccttgcttgctaattctaatacctgtgtcatatctgggtccgtttcaattggttgccttttcttctcattatggattgtattttcttgattttttgcctatcaggtaattttttactggatatcagacttgttaattttctctttcgggatgctgtatatttttgtattcctataaatattcttaaactttgttctgagacacagttaagttacttgaaaacagcttgatcctttcaagtcttggttttcagatttgataggtgagatcagagcaatgtttagtctagagacaatttttctccactactgaggcaaaacccttctgagtactctattccagtgtcctgtgagtcatgagattttccagtttagctggtaggaacacacactattgctagacctatgtgagtaccagggattgttccctcttatctttttgggtggctctttccccagcattatgcagtttcctcgcatgcatttgttgatcagtattctgttgactactagagggaaactctgaaggtctctagaattctctctgcagctttttcctctctggtactatgtcctgtgaactccagccaacttcgtccacttggattctcagctctgtctccttaattttagggaactcattgggctctgcctggatttccccttcctgtaccacttgattcccttaagcttttcaaacaaacgctcctgtagtttcttaagaaagagtacatgggaagtaaattttcaagaactttttgcctaaaaatatttcaagttaattttcacacttgataggttggaaataaattttgaaggcatgacttcattgtctcctggcttccattattgtgttgagacgttcactgccgttttgaatccagatcttttgaatataacctatgttttaaaatccagaagcttaaacaaaagttaatattacttttaattgacaaatcatagttgtatacattaatgggttgcaatgtgatgttttcatatatgcatacaatgtggaatgactaatcaaagccaattaacatatccattacctcaccattttttgtggtcagccattgagatttactcttttagctattttgaaacatacaatatgttattattgattatattcacactgctgcacaacagatctcagaaacttattcctcctgtctaactgaaactttataccctttgtccaacaactccccattccctcctcataccagcctctagtaaccaccattctactctctatttctatgagtttgattttttcagattccacctatgtgcgagatcatatggtatttgtctttctgtgcctggcttattttacttagcatacatcctccaggttcatttatgctgtcaaggataacaggatttcctccaacttcagtggctgaaaggtattacattatgtatctataccacattttctttatccattcatccattgatagaaacttaggtagataccatatcttggctattctgaataatgcttcagtgaacatgggaatgcagatatttctttgacatattgatttcaacttctttggatatatactgactagtgggattgctggatcctacagtagttctatttttagttttttgaggaacctccatactgttttttataatggctgtactaatttatattcccaccaacaatgtataagggttcccttttctctacatcctcaccagcacttatccttcctccttttaataatagccattacgatctagaagttttaaagatcttatctttaacccagtttttctgaaatttcatcaagatttgcctctgttatagattttcctttcctttcctttcctttcctttcctttcctttcctttcctttcctttcctttcctttcctttccctctctctttctccctctctctctctttccttctttctttcttcttgttctgttgcccaggctggagtgcagtggcacgatctcagctcactgcaatctctgcctcccagattcaagtgattcttctgcctcagcctccctggtagctgggactacaggctcacgccattacgcccggctaattttggtatttttagtagagatgtggtttcaccatgttggccagggtggtctcgaactcctgatctccagtgatctgcccaccttggcctcccaaagtgctgagattacaggtgtgagccaccgtgtctggcgcgttgtggactttttgtcattcatttttcctgggcactcagtgaatctttctaatctaaagactggtgacctctagctctgggaaatgttcttgtattatttgctaataatttcctcccctttattctttctcttctttgtttatgggactttgattagtgaactgttggacatcctagactttttttctctaattttatcttttccattttccatgactttgtcttcttattttactaagatacttccttaatttttcattaaatccttctattgaaattttaatttcagcattcctaattttattcacaagagctcatccttcaccttgtttcttttttagcattctgtttttgctttgtggatacgaactatttggttttcttcttgagaatattgtcatttttaaaagtttgcttctaaaccctgcattgtctgggtttcctcccagttccttttctctgttagtttaaattgctgtcttttcctaaatatctggcaaactactggctgtgtgtttgagtttaagcactaaaagatgactggaaactctgagtggatgggaataatttatgggttggtgaactttgctataggattataaggcggaatgctggctttttattgatggactcccaagtgtcagttctgtaggtcttttctcttgggtcagtttcccttggatgaaatcctccaatctcctgcttttgattggaggggcagcggtgtggaaggtataagcctggctgccagcattctgggagccaaggagggaaaaggagctgagagttttaagactgcttttagtataatgtcaaagatcagcagaaagtaaaactcacatatcctgccagaatgagggaagggtagtctctggtttagtgtgcatggatctgtggatctagttgttcctcatgcaaactttcaactttctgtggcactaaatcaacttgatgttgttggcttcctgatctagctttctctggactgttattggttaccacacattcatccctttctagcttccaaacatttgttgacaatcttttacttgttggcatctcttttccattctctttgtctttgtgggtttatgacatttcattctttgactgttatttcagtgagatttcatgaaagcaaaaataaaacatatattcaaaccactgtatttaataatctctgctctccaaccctctgaaatgttttgtcccactaccacaccattgaaagtattcttttcaaggtcatcaaatgaataccttgttgctaaatataatagacacccctttgtttcatcttacttgatctctcagtagcatttgtcctcctgaacatttttacttgaaatttctctgcccttaccttccatgaacactcctggttttcttcctactttgttgtttttgttttgttttgcctttgtgagcaatgtttccttggcctattcctttaatgctattgttctttgtgattgtgtcttaggttattctcttctctcattacacgttctccttgttgcaaactcattggttcctagggcttcaattaccatctagatggttatgattcccaactctttatctgaatcttctttgcataggctcaggtataacctgaggtgtaggtggaatagatgactatctatgtagtatgacttgagaatcatctactcaccttcaatactggtctcccacagggtctgaaattttcccccaccattatgcattgtattgtgttaagccaccatgacttcagttaaaatgaaattttagctgggagagatatgcctttccccttacaaatgacaccttatattatgtgcaatagaaaccaaggccttgagagactgcaacaagatcgctaatgttgtgttttgcttaaataaaaaaacacagacagtcagatacacacacacacacaccccaccatgtcacttttaacccattcttaacctttggtccatcattaacatttaggaatatggtattctaatatttctatttagatatatttcacaaacatgatatgctatatatactatattatactctacatttgaaacaatgtatcacaaacttttctctatatcattggatattataaaacctgatttccaattgcttcatgttattttatcttttgatgtatagtacattacttaactcagtctccactgttagacaatcaggctacatatggtgtgttgagtgcccttgtagttctatctttgcatacatctcaattatttccataataaaaattttatgaaatagaactgtggtgtcaaagaagacttatattttaagctattttgaaatttaatgctaatttggccttcaaaatatgtatcaatttcaatcctaatacaaatatgtaggcattattgactataggcataaaagctcctatgctgtcatttgtttgtaatttaaacgctatctcattttaatttacatttctttgatttctcataaagttggactttttaaatatatttattggccatttgtttgctttgactttgttttctttgatgctttgtgaattaaccctttttgttttgtttgtttacactcatgcttattccaagacactttaaaatctggtctctttgcctccaattttgaccctttccaatccctccactgaagccatagtagtattcctgaaacatgaatttcagcatattatttccccacctaatgcttagtgacccccatcgttcttaagataaaatccaacgtttgtaacgtggcctacaaagtcctgcatgattttgtctcattctccaggcttcaaacaagagagaacacacacacatccacatagtctttgcttagttaactcttactcattacataggtcattggtgaaaatcgacttccacatgggagatttcccttagctcccaagtctctttagataactcctgtgtatgctctactccctttgtagcagcacttctattgcccacgtaatgtctttctccttcatgatgtgtgagctcttgaaggcaagaaccacagcaaagcttgttcactttgtgtatctccagtgcccagtacagtgcctggcacattagttgtgcttaataagtattggatagatggatggaggaaataaagaagattggagaggccagaaagaaattccatgagctaattttctagattaactgttatcctaaagaagttgttgtctccttactcaccaaatcctggctattcatgtgagaccttatgattgtactgagctagtctttcatttggcctgtagtttatcactgaaacatctctattttcagaaacaataagaggtgttgttggtagatgtatagcagggtatatgtacatgaggatatgtatttttcagtttcccattcccttacaactagttcaccataaaagtttcctctctggtcttcctacattcaatgccttttctctctcctctaacctacatattattgccaagtgaatttttctttcctcaccatcatttacatgttcaaggatctcattggctctgatttagaagatcttgcacaggactaaaacatgtatattttggcaaaagctcctccagataatcctgatgtgtagcgatggctaaaaattgctgaaatatataaaatatacctcaattttttgaagaaaagaacagtctaaatggttaaggttatagaatttagaatcagatggacatgggctcaattatatttctgactcttactggttgtgtgatcttggacaagttacttagcattttaatgtgccaactttctcattcgcaaaatggaaataacatctactacatagtgttatggtaaagagtaaattagatagtgtatgtaaagtgaatgcacagagcattgtatatactaagcacccaataaatgttagcagttattttgttgttagtcattcaattgttcattcaacaattattttttcactatgtgtcaaatgctgtgttagggccatggaagatattaagaggtacaaaatatgaaccctgctcttgagactcctagatttagttgggaagataaaactatcatagcactatacaatctgaggataataaagtgaaatataaatattataaaagatcacataggtcaggtgcggtggctagctcatgtaattccagcactttgggaggccaaaacgggtggatcacttgaggtcaggagtttgagaccagcctggccaacttggcaaaatcccgtctctactaaaaatacaaaaattagctgggtgtggtggcgggccaccagctagggaggctgagacatgagaattgcttgaacctggaagggggtcggagaggcagagattgcagtgaactgagatggcgccactgcactgcaacctgcgtgacacagcaagactctgtctcaaaaaaaaaaaaatcacataaaggatatatttagggaaggtgttaacctagcatgctgacttgctgactagcataaacaaaaaagaaaaatctctcttaaactgtttttaccaaacctttaaaggtctagttttgatgctgtctgccagatggaaaatgatgcagaggggaaaaaatcctgtatttacttctcaaaattaagaccggatgggggagtgtgtttgaggggtgaacatatgtgaataaatatggtataactcttaattggttcctgatgattaaaatttaaatagtttccattggaaaggcagagatatgatattttcactaaataaatcaagccttacaagtcatttattttctccttgttaaaccagaaatcaaacactgggtgaaagttgcaacctattttgatgtatattgatgtacttttctctttttcagggtcgctatggcaactgcatcttctcaagttctgattccagacatcaattttaatgatgcctttgaaaactttgctttagatttttccagagaaaagaaactgctagaggggttagattatttaacaggtgtgaaaatactgtgctttcctttccatttaattttttttcttctggtatgcttttacttaaaaataatttgaaaaagacaatatttataatttacatattttataatctttaaaatgatgcatgtgtcttttcagacagaatatattttagttcatgtaacagaaaaaaagatgatttatgatttgttaactatttctagggtcaaaatgggtataccatctgtacttaagagtaaaacacaagaaattgctgatagatttgtccttatgaatctaacagtaatgtattgttgctagttatgagagtagaactcaggtgacaattagggaatattagagaatgccttatgtgggtgtaagtacaaccaaaatggttttaaggaaaattaggagttagtagatcaggaagaaaaatgtaagaaatatctggctctcagacaattttagaaaatgagggatgcaaccagcctgttaaaaatgctggctactttcaggattatttaatgatcatttcatgaaaaaaatatacacaaacaatttttgaactgttttgttactatattaaatagctgctccttattgaacatctactttattctagacactgtatattaattttgtatctttaaaccttacaacaaatctataagttaattatcacccctattttatagatgagggaactcattattttgcacttgactatacagctaaaaatatataatggggctgggcacagtggctcacgcccataatcccagcaccttgggaggccgaggtgggtggatcacctgaagtcaggagttcgagaccagcctggccaacatggcgaaaccctgtctctactaaaaatacaaaaattagccagatgtggtggtgggtgcctgtaatcccagcttctcaggaggctgatgcaggagaatcacttgaacccagaaggcagaggttgcagtgagccgagattgcgccactgcagtccagcctgggcaacaagagcaaaaatctgtctatatatatatatactcattttgaaatttaaaaaaataagttgaagaccgtatgttaagaaaaccatataatcactttaatgtctacataagtgtttatgcaggcagactagacagctggggcagtcatcacaaaaatttaggcttatatctttgctaaaatatttttattgatgtagcaaaagtggttttagggagcttgagatcccagcattttgcttcaggttgcatggttcatgcaatctaaagattctctattaagaaaatctcttcaagagatgttgggttacgcaggaagagtaacaattgtaaaattccagaagagaaagtatgctttccttactttcttttccacctttccttacagccccaaacccaccatctatccgagaagaactctgtactgcctcccatgacaccattacagtccactggatctcggatgatgagttcagcatcagctcctatgagcttcagtacaccatattcactggccaggctaacttcatcagtaagtcatggtgtagttggggcctgtggccagagataaggaaatgtaaggaagcagtaagctgctcaagattggccggggcgccacgaggcaagtgtttgtaagacatgttaggttgtttagtatagtgtttcatagacagtgtaagctccccagggcattgcaaagaccttactgatgggtaacaagcaagttgtatatttccttgctgggcagttgctggggccattcccattcatttatgtaacccttagcctttcctcaattaatccatgtcactccactttcccaaggagagtacagcttggtacttgttccttgccaccatcattgctggttctgtgtgtatgaacatctctctccttgactcttcttctacttcattatcgtggtaaaatacattatgttcaaagacttttcctttaccaaacctacctctatcagtgaatatggtgacaagcctcctgcctctgtcactcttccctttacttcttcctttccaccaagaattatgctaaatatgaaaacatgtcagtgggccacaaaatgaaaaaggttaacaaagctgttgtttagctcacatgttacggtttcactttctggtgaattggagcaagacaaaacagagtaggaacttcactcatgccagtcaagaggggatgagctgaaagttcccctcaatgccctgggtgcagtgagggctggggtgagggatggtggaaatggaaacaaaagcaaaattaaagctggattcaagactggaacagattcccaacctaaaataacatctccatagctgcaaattagtattttcttttacttttttgttcctgcttttgtgtctgacttcacaggccagcatgagagtagtttttccaactaaccccttcaaataggcttccttttcctgttttgtgacaaatctggggcagaattctgttttgtaacaaggtggggtggggagatgagaggacatttggggatcaaactctaaaaaacatttgcttcgtgcagctccaacctaaaccacttggcccatgtaactatgttcctgggtgtttcttcagattgtgaagtcacaaactctaatgcttcactgatttatttgtctctcctactctggaaagtcttagcgccaacaactgtgcttctttttcctgatatggggaaagcagtcatctcccaggaattaagaagaagtctgagaagtgacaaagatctaaaggttgtcacctctgttttcaaggttatatagtcctttgtaaagaaaagcttaaaggataattcttaacagtgataggatcatagcatcttagaattggaatggagcttagaagtcatctagtctaatcttcttcccttctaccagacacccagtagataatcatcctgtctctgcttgaacatttccagtgataggtacctcacttctaacaaaacaacccatttgattgttgtgcagctataaataatggccagtgcttccttataaggggcttaactcttccttttagtaaataataacaacaataataatttacatgtgtattatgctttgccatttacaaatgctcccacatacattatctcatttagtccttatgggtgcttacttagccttataaaatgttattaactctactttatagatgaagaaactggggctcaggttgagtgagttgcccaaagtcacagagctacgaaatgagggagtcaaggttgcagcttgagcctgtcagacttcaagtttaatgctccttaaagtaaaccacagcaaccaattagtcctagttctgaacttttgtgcctcactaacaaacctaatccatctttcacataacagttcttcagataattttagttagttcctatgtccttctaaattttctcttttccaggctaggcatcttcctttctttcaattgctcttcatatggcatagtttcagatcttttgttatcctagtatcatttttaagaacacactcctgattatcactgtgctttataaaatgttctgtcaatgaagtgaatgtagtactcccaaagtggtctgagcactgcagaggatagctggattatttctcttgtacattagctgattcccaattgccctgtaccttttttttcagcagccactttgactactgactgtttactgagcatatgatcaactgaattttctatgtattccaaatcctgttcttatacaattgaatgtctaaaacaaaaatacaaagccttgaatttatccctagtacattttatctggttagttctgccacttcatttcagcatgctaaaatcctttgggatacagattctaccttcaaatatacttgcttaccctcacagcctgccttctatttcttcctctagttattgatagaaaattttgttagaacaaggacaagggcagaggcctgaagcaaaattttggatggcaatgagaaactattttactaggaataagtatttttgaagattcaggatcccaatcctacctgccggtctggcctgccacagttgactgaacctccgttctgagagctactttcctttgacgttttttcacattttctttatccagaaatttcatgcttgttggtgaggattattcccccttcaccttttctttcaactttatttcctgatttttaactttcttcccacctcttctaagatttgaaatgatcacaaccaatgatgtttcagattatgctgtgaggtgaatgagaattccaacagatatttgagtgtgtttgtcttctgattactttattatctttcctccgtttgaattttgtgttttgcattacaaaagcattagccgtaaactctgcctagccaggcggaccataacatactaccagaaagacataacttctatttcccttccttttcattctcatgcaaatactctctaccacacatttacactcaggttcagggatttccatattgtaatttttcccttttgaacaagaggtatacttccactgacataattcaatcataagtcccatcttactaaatctcagtaatacctagaggatcatatatttacctttttaaatttagaaatgatttcaaaatcacagaaaactttccaagactagcacaaagaacacccatatattctttacccaaattcacctactgttaatatttgtcccatttcctttagcatttgctaacattccctgttcttttggaaccattttagagcaaattgcatacatcatggtctttcacctctgaattcttcagtgtatatttcctaagaataaggaaattctcttacataaccacagtatagttaccaacttgaagaaatttaacgttgatgcaatacttttatctaaccaccatttatatttcaatttttgacatttgaccaaataatattctttatgacatataaagaacccaatattgtcctttatagtttagggtcaggtattacatttaattgtcgtatctcttttgccatatctcttttaatctggaacatttcttcagcctttctttgtcttgaacaacattgacattttttaaaaagtgttcttttatgtctttattatacttcattatactgttccttattttgattttttctgaagttttctcatgattatatttagcagtacagttctttcttagggtataatatctggagacacatgatgtccacttgcccttcactgatgatgctaattttgatcacctagtcaagatgtcgtctgatttattcactgtagttgctactttttcttttgccactaataaggaatctgtgtggtatgttttaaaaccataaaaataccctgctgcttcatcaaaccatctcatccctacccccacccttgttttattatcagttgatgatacttgcctgaatcaatcattaatatgatgattgcaaaatgatgatttttccagttgagtattccctcccacattttcaagttggcacttggcattctactataagcaagagttccactccccatttcctcccatttgtttatatatcagtatgggctgatgaattatcttttttcaattgttaataattatttacagcccttacttgtgttggtgttcaaattgtcaagatttagccattgggagcctttcaaggtgatttctgggtccttataatattcccccatcattttcttgagcacttccttactttctggcataacaaaatgttctaggctcattttgaccttattctgtcccagccttgaaatcagtcattattttccaagaaaccctggtttcttttagtgggacaatattagagaccaagacctgagtgctagatatgctagatataaacacaaatatccatacatgtaagcatatgcacacatatataataacacatgcatacatactttatatatgtgcatatttatgtgcacatacacaaacatatatatattttagaaatcatgagtttacaccaataccttaaattccagtccatccccacaggttccttcctgcctttctccattctgtatttgtatgttccttcttccacagtatgaaccctggctcccaacatcaacacatgtactcatttgctcaatcccataatacatctaaaatagtttctgaattgctctgtccacgccacaacaaaaacaaactggctaacaatacttcaggatttgtttgaggttttcctcccacccccactacattgatgtaattatgctgttcgtctgaaatgcagttgggtttgtttcagtttgccttcagctttagtccccaattttcccatctgtattcatttaattttatttttttgaatttgtaaaacaatgtgtttcccaaagaggatgctatacaaaaaggtacattcagagaaatgtcatttcctcccacatccttttaatcctgttcctccaccccctaccccttgtggataaccaacttcatgaattttttatttatctttcctgtttttattgttgttgctttgtaaatccaagcaaatatatggatgttttcttatttttctttctctcaaaaaagtagtgtactgcatatatactacatatacatatatacttttggaatttgcttttttcaattgacaatatttccttgaaatcactctatatcagttcatagtgatcttttcctcatttttttcacagctgcatagtacttcattgtgaagtttgtctttgtattgttgggtgtgtatctggagattatatgttttcctctttgtattaaaatcttatgtgcagcttgtgattcatactgtgtattggtaacataggcaaggcctcaaacattgctcctacccttttaatccatattgtcttttcattagaatcactgggcacctccaccaattcttcctcctctttctcctgcatatctgtttgccctccatcgtttcttttactagttttaacttaggctcttcaacttcctctcagattaattataagccctttgatcagatctcttgcaaaacattcatgacttattattttcaattttcaacctcactaaattttgtactagagttgcatagaaatgactgaattcactgcttatattcctcgcctttccctttctaccctctagtagaactgtggctaaaaagtggtaaactaactgaaaagcagataacagtagaaagaagtctaaataatctgcagactagaatgttggtttttcttttaccgaaagcttgccaaatacatgttttaattatttacatttcccctgtttaagttaatatttgcagtctaaaatatatcaaaagcagaagcctagttctctgatccctttccctacttggaagggaggaagattccagataacaatgtgctcctggaccactcaacccaaaatgaacatgggaatcacacaacagaatgtgttgtgtaatagtggggagatgatatcttgctttggttatcatgtcatctctttggcttccctacggtactgtggagaccggctagtttgggaagtaagggtaaggatggagtaggagagtggaattgtaagccctgagagcctcactaccttgcagagacaaaagaacattgttgttcaccccatgaactgtgatgtagtagagagaacactgggctaccattttaaaaataccagggttctattctcagcaccatcactgactatctgtggccttgggcaggtcacttttcttctctcaatcctagtttcccatttgtaaaataagggaaatacagtatctatgtgtccctttggctgagtttccatgtttccctgctctgcacaggattgctccatccatacaagaccaaactcagctctcagaggagtggacgtttggagtaaatatccagagactccataagagtgatgattccgtgactctgtatagtagccattcctgtgttatctgggaaagaaattgaaataacctaacttatgctagtagttccattcaattgccacaagcaaggagcctggcctaagcctagttctatgggagtaatgaaatagtggaatcataagccctggttcatctcattacatcttctaagactcaaaagaaaacaaaatgaattcacttttgagggggtggcttatgatgaattttcagtgtgtttttcattctgtctctcttacctgctggttaatgtccttgtctttccccatgttacaggcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagtacgttgtggtgatttcaaaaggaaagatcaattttcttctccatgccaggggagtacacagcctgagcaggcactcacagcagtgcatggggagcagtggtactgggtagaggagctatactgttgtagtttgtactttgggcaaggagtttgttggtgcccatgggagatttgtggactcagagatatgcacaaaaagactgttagcttgggaggatgttagtgaagagttttctctgtactccaccccttatatttgggggacaattgcataaaagagcattatttgtgataatctagtaaaatcttactacagagaagccatatctgttaggaatgcttttgacagcaaataacaaaaagtgcaactaacatagcttaacaaatagcgtttgttaattgtttaaatgaatagtatatattttatctctcacacatacacataggaagaagtttgaaggtaggcagttcagggctaatgcagctgctctgcgatgtcataaaagatgcaggctccttctccctgtgtgcattggcttcttgccacatggctgcaagatggccactgcaactttcagatgtcatattacctctcaagataggaaagaggaaagagttggtacacataatggttatcccttttatctggaaatccaaaactttcctagaactttcccctgctctgtctgacttctgcttccatctgcttccatgttcttagccgcccctagcagtaagggaggctggaagattgagtatttagcttttccggcctctatagtgaaagtgagtaagagagaaaaagttgggaaagggtaatgtgttagccaacagtgtctgtcacagaagcattctgtataaaaatctcttgccacacccagcaactggtccctcagtaacaatgcctttgtcatatggttataaagaattatctgttgtgaatgatcctacacaataaatgttttctctgatcattgatgatgcaacagtcactctaacaaaattgcctaattatatgttatttacatcccaattgtaagagggcaaaaataattgttcagttgctgagttctcagggttttccggttctgccatcaagcagcaattacatcaattcccctcacctcagacatcataacactctttctgttaaaatctacccaaatcccaaacaacccactgaaattaagcaaagtacaaaacatatttgagaacatgaaactttgagcactcccttttactttgataatatatgatgtgggggacagcttattagctcctctttgcttggaatatgacttccctcaaattgcttttaggagagatccacattttttcccacagtgggaaaataaacgccgttatgaaggtcgttttatgggagattggcctttattcttattttattgaaaactctggtttctggcctgttttcttaataaaatttaaacagcagccaacttgcactggaccaagagtgatcatgttatcgagcataccctgccagtgatgatgctggtggaaaaggtagaattttaagatacttcatagtgctttttcttttttttttttctacttatttttcaggccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtgagtggatcccattttccttttcttttctgtcctctgtcattaggttcctaggagattcaattctatagcacaaccataataccaataagtcaaggttaaaaggtatgtgatgaaaaccactcctagaaaaatttgccagctttttaataaaataatggaaaatatactgggctaggagatggaaactgccacattgctctaattgctaactttttaaagctctagtgatatcagcattatgcatctaagtgtaaactatttaaggaataaacatatatcctatttgttatatatcatatatggtgtcttacacaactcagataattcataaatgtttatttctctctcctttccactgtctcacaggtatgcaattggcattgcctacaaatcagctccaaagaatgaatggattggcaagaatgcctcctcatgggtcttctctcgctgcaatagtaacttcgtggtgagacacaacaacaaggaaatgctggtggatgtgcccccacacctgaagcgtctgggtgtcctcctggattatgacaacaatatgctgtctttctatgacccagctaactctctccatcttcatacttttgatgtgaccttcattcttccagtttgtccaacatttacaatctggaacaaatccctaatgatcctgtctggcttgcctgccccagattttattgattaccctgagcggcaggaatgcaactgcaggcctcaagaatccccttatgtttctgggatgaaaacctgtcattaagtttcaggagagtatataattcactggctctctagttcagcagttcttcccctcctacacctaagttagcgttcaatatacgagacacaaaataaagtttgtttgaagcatccaaaataa

SEQ ID NO: 397 - DNA, 99647 bp, Homo sapiens
gggtagcgcgcctgggagggagaaagaagtcgggggccgtggcgcgcagcccgcggggcctgaagggatgttcgaggacaagccccacgctgagggggcggcggtggtcgccgcagccggggaggcgctacaggccctgtgccaggagctgaacctggacgaggggagcgcggccgaagccctggacgactttactgccatccgaggcaactacagcctagaggtgagcggcagcaggtggggcggccggaccctaccctcgccaggccccacccctgccccgccccttcctcggcctatggggtggtgggagtttccccacctaggagggtcgctgcgcagccaagcgccgaggggcgggaaaggtgggtgtagctcagccaatccacccatcattttgaggcgggaaactgaagctcaggaaaggagcggcctaggtcccgcgccgctcagaccccaggcttcctgaccacacttccctctaccccgccaagcgccacaaaagtcatggtgctgcccttaaatcagtaagaacaaatataatggtaaagtgaaaatgaactgcatgccaagacatcactgcccagagctttaaatggaccctcagttccgtctgaaccccttctgtgatccccatttcacgcaagaggaagcggagccctagacgggttaagctacaggcccaaggtcacacggttagagatggagccagacccagggtctgagccgtttaacctccaccctctgcttcaccagggtggagctgccggtcgctgtgcagcagtttgatcaaagccaatgtgcacacgaagctgatctcagccctacgtttcctcctccgtcagagcatcgtcctgatgctttgcatcagtgtctggctctgaataaaacaaatgtcagttataattacttgatttttttccccatcattcttgcattttatcctcgcaacagccctgtgaacatggcatggcaatgagtattagactgctttccaggtgataatggcaaggctcagaaggttgtcttgcctaggattattctaatatagaaacccaggctgggcgtggcggctcacgcctataatcccagcactttgggaggccaaggcgggcggatcacttgaggccaggagttcgagactaacctgggcaacacggcgaaaccccatctctactaaaaaaatacaaaaactagctgggtgtggtggcgcctgcctgtaatctagctactcgggaggctgaggcaggagaattgcttaaacccaggaggcataggccgcagtgagtggagatcacaccactgcactccagcctgggtgacagcaagactctatctaaaaacagagaaagaaacccagacgagcataagcccagtgtagacagaattgtgatggagtgtatttcatgtagcaccactggcctcatgttcaaaggctttcatgtgccaagggcgctggacccactcccagggtgcaccactgactcaccacccagtgaaataattgctgggttcaaaggcatagagttggaaaagtgtcgattgtatgtgtgcctatatatgaaggagtagtacctgaaaaaagtgtcttcagaactggatagactgggtaaaggacaatggtccacatccgtgggtggcatgactggagagctgtgggaagaataagaaagtaagggagattagaatgaatggcgtctcaattgaaaacagattgatttttgaaagcctgagaaagcatttctgacatcctaggtctgatttggtctctcttgcccaaggtcacaccatctgtcattgaataagcatttactgtgtcaaactatggtcaaggcatgcacctgtttcagattcttgaatatgacaagtttgttcccagttttgtggtatatccatgccattccctctgcctggaatatttcccctcacccccaacaccaggaaaagttgagagctaaatctctagttaggcagagttgaataggacatcttcaatgtttgctctacttatttattttttctttctttttttcttccttagaaacagggtcttggccgggcgcacggtggctcacacctgtaatcccaccactttgggaggctgaggtgggcagatcaccttaggtcaggggtccaagaccagcctggccagcatggtgaaaccccgtctctactaaaaatataaaattagctgagcatggtgacgtgcacttgtaatcccagctactcaggaggctgaggcaggagaatctcttgaaaccaggaggtagaggttgcagtgagccaagatcacgccattgcactccaccctgcacaagagtgtaactccatctcaaaaaaaaaaaaaaaatggaaagaaacagggtcttgctcttttgaccaggcctggaatgcagtggtgcaattatagctcactgtaaactcaaacttctgtgctcaagtgatgttcctgcttcagcctccccagtagctgggactataggcatgcaccacggtgctcagctaatttttcaattttttgtggagatagtatctgactatgttgcccaagctggtcttgaactggcctcaagtgatttttctgccgcagcctcccagagcattgggattacaagcatgagccaccgagcccagcccaatgcttgctttagaaagcacaaatgtatgaactgaaattttgtgtttattctatccagtgtttattttcctctttttttaaaatcaattttttaaaggtatttggagtagtcattttcatatatctcatgcttcctaagaagtctttctccaatccctacccctctctagtctacctgacaaactcctgcttacatttttattgatttacaaattttgtctccttttgtgaggccttccctaaactgtagtcaaaatcagttattcactgcactatattctcctacaacactttatcttcagttcttcttatagcttgtatatctcaccaattataaatgatagtatctgttcctcttcttagctccagatgtgaagttctgtgagatcagaaaacattttttgtatttctaaggcctggcaagtaggccttagaaatgcaaaaaatggtttctgatatcatagaattcatagaatttttatgaaataggattttatcaaatagaattgtattctattttattctcatggaataaaatagttgacttttttaaggaaagaaagtcaggccaggcacagtggctcacacctataatcccagcactttgggaggctgaggcaggaggatcacttgagcccagaagttcaagaccagcctgggcaacatagtgagaccctatctctacacaaaataaaataggctgggcatggtggctcacacctgttatcccgacattttgggaggctgaggcaggtggatcacttgagcccaggagtttgagaccagcttgggcaatatggtgaaaccccatctctacaaaaattagctgggtgtggtggcatgtgcctttagtcccagctactccagaggctaaggtggggggattgcttgagcctgggaggtcgaggctgcagtggccctcattcctgggaagtcaagactgcagtggccctgattgtaccactgcactccagcctggggcaacagagtgagaccctgttttaaaaagtaaaataaaaatcagtgtattctttaatgtctttaaaaaaatcgaaacaataattttaggacttatattttcaccatcttgctagaattttcatttagtagcctgtatccaaaggctctataatacttggatgctaatcccaaacaactctttctctttttcttttttgagacaaaaaaagggcctcaggcacttctcccatctcagcctccagagtagctgggactacaggcgcataccaccacgtcctgctaatttttttgtattttgtagagatagggttttgctgtgttacccaagctagtctcgaacccctgaactcaagcagtccacccacatcagcttcccaaagtgctggaattacatgcgtaagccaccatgaccagaccctattcccaagcaattcattaatcaaagcttgtaaaaatattcatctttaagcttacctgcctcatttagtgctttgagaaaagacttctcattccttcagggtaggaacattgggtttattgatggccacccatttctacccaccccttttagattattgcaagaaatctttttatcaatctttttatccttctagggtttggtcttaaagacagtctgtggaacagtgtataagaacactattgtgttgtgctatcagatttacatctgtaattctttttttttttttttttgagatagagtctcgttctttcacccttgctggagtccagtgggtcagtcacagctcactgcagccttaaccttctggactcaaatgatcctcccatctcagttccccaggtagctctaactacagacgtgccacatacccggctaattttttccttttttgtacagacgggggtctcactatgtttcctaggctgatcttgaactcctgagctcaagcaatcctctgcctcagcctcccaaagtgctggggttacgagcatgagccactgtgcctggcctttatctgtaattcttgtttttttttttgagatggagtctcactcccgttgcgcaggctggagtgcagtggcgtgatctcggctcactgcaacccccacctcctaggttcaagtgattctccttcctcagcctcccaagtagctgggattacaggcgtgcgccaccacacctggctaatttttgtattttttagtagagacggggtttcgccacattggccaggctgctctcaaactcctgacctcaggtgatccacccatctcggcctcccaaagtgctaggattacagacgtgagccaccgcaccggcctatccgtaattcttaatccttaaacttcagctattgtatttcagcagtgaagtcatgaagtgattctagcttggagatgtctgaagtctaatgcagaaaattgttgaattcccaaatgtcacctttttgtggcattgtaaattgagatatctactaatataaagagccgtgcttactacagtcgtgtgctgcagaatgtttcagtcagtgatggaccacacatactttatttttactatatgttttctgtgtttagatacacaaataattactattgtgttacatttaccaacagtatttagtatagtaacatgctccacaggtttgtagcctagaaacaataagcataccatatagcctaggtttagtaggctatgctatgtttgcacaacaaaattgcctaatgttgcatttctcagaatatatccctgtcattaagcaatgcatatgactgtattttaaagatgacatgttttggggtaaatccccaaatgtttaccttacaaaaatgacagtctccttcatgttgcgtaagattaatattaattttttatgtgtgactcccttgccaactttttactctgttcttgcctttccctgccacactaaagagaaacataaagcaaaaacgatagaaacttcaggatcatcaaggccatttcttaaaatcaagaaagtcatgctgacaaattttaataaaactcttctggtaattcagacatgcttcacttaatgacagggacatggtctaagaaatgcaacattaggtgattttgttgtgtgaacttcacagagtatacttatgcaaacctagatagtgtagtctactatacacctaggctgtttaatatagcctgttgctcctgggctgcaaacttgttcagcatgtttctgtactgaacactataggcaactataatggtgagtatgtgtgtatctaaacataaaaggggtacagtaaattataattttttaaatatatagaacagttagaacatacagtattacaatcttttttgtgtgtgtgacagagtgtccctgtgttgcccaggctagactgtagtggcacgatctctactcactgcaacctctgcctcccgagtttaagctattctcctgcctcagcctcccaagtaggtgggactacaggtgcatgccaccacacccagctaattttttgcatttttagtagagacggagttttgccatgttggccaggctggtcttgaacccctggcctcaagtgattcacccgctccagcctcccaggcatgagccaccgcgcctggcaagtattataatcttaagtgaccaccattgtatatgtggtccagtgttgaccaagatgttatgtggcatatgcctgtattagatttggagtgtaggtgaaagagtttttttcttttttttttttttaagagacaggatttaagagacaggatctcgctcagctgcctatgttggaatgtagtggcacaaacatagctcactgcagtcttgaactcctgagcttaagcgatactcttgcctcagccacccaagtagctgggactgcaggcaagcaccaccatgcctggctaatttttttattttcatttttagagtctacgttgccctggctagtcttaaactcctggcatcaagtgatactcgcacctcagcctcccgagttactgggattacaaacatgagccaccaagccaggcttttatctttagattaatattaatttagcatgttatagttgtaaaaacacagaactaagagtaaggagttttatacccattactgcaactaacagctttgtgaccttgggcaaatatcttcacttctctggccctttatctacataaggaaaattgagaccagataattctacatctcttgtttctagaattaaagcattttaacataatattatacctgttttgctgtttgtcttttgcttgccagggagaagttacacactggttggcatgttcattatatgttgcatgccgcaaaagcattattcccacggttggaaagggtatcatggaaggcaactgtgtttcacttaccagaatactacgttcagctaaattaaggtaaacctctttgatgtttttaaatgttatataagctctaaattttggaatcagttttctcttgttttgagatcatttgacttcatttaatttttattttatttatttatttatttatttatttttgagacgcagtctcactgtgccagccaggctggagtgcagtggcacagtcttggcttactgcaatctctgcctcctgggttcaagtgattctcatgcctcagcctcctgagtatctgggattacagacacacaccaccaagcccggctaattttttgtattttttttttttagtagagatggggtttcatcatgttggtcaggctgttctcgaactcctgacctcaaatgatctacccacctcaacctcccaaagtgctatgggattatagacgtgagccactgtgtgacttcatttaattctaagttataacatagataatcctttcccaattttcatattctttctctgcctttctcaaattctgctagaaacctctgtgttgaatctttagctatactttttaaaattaattttttaaaatttggaaataattttaggcttacagagaagttacaaaaataagaaaaggacaatacccatatacccttgactcagagtcacctgttattgacattttatcccatttgctttctcatttgatttttctttcttcaatatatagatctttctctctctctcttttttttttttttttgagatggagttttgctcttgttgcccaggctagagtgcagtggtgcaatctcagctcaccacaacctctgcctcctgggttcaagcgattctcctgcctcagcctcccgagtagctgggattacaggcatgtgccaccacgcctggctaattttgtatttttagtagagacggagttactccatgtttggtcaggctggtctcgaactcccgacctcaggtgatccacccgcctcagcctccctaaatgctgggattacaggcgtgagccagcactcccagccagatctttctctttttatcctcaaccatttcagtctaagtagcatacatttgtagccttttaccccaaaatacttcactgtgtatttctttaaataactacagtacagctaccaacttcagcaaaattaacactgataaaataattttatttaacctgctaactctgttctagttttgttagttgattcaataatgttctttatggcattttttttcctggaagtacaatttctaattaaggatcaggtattgcatttgcttatcatgtctatttattcttctgtaattaggaacatttccacagcctttctttttcttttatgacattaccatttttgaagaatataatccacaatcactttgtccctttctttaattaaaaaaaatttttttagaggccgagtcttgctgtattgcccaggcctcgagtgcagtggcacctttttagctcactgcagcctcaaactcctcagctcaaatgatcctcctgcttcagcctcccaagtagctgagactacaatcatgtgccaccatgcctgactgatatttttaaatctttttatagagacagggtcttactatgttgctcaagcttgtctcaaagtcctgaccttaagtggtcctcttgcctcagccttttttttttttgggacagagtctcactctgttgcccaggtggagtgcagtggtgcaatctggactcgttgcaacctccgcctcccgggttcaagcgattctcctgcctcagcctcctgagtagctgggactacaggcatgtgccaccacgcccagctaatttttgtatttttcgtagagatgtggattcaccatattagccaggctggtctcaaactcctgaccttgtgatccgcctgcctcagcctcccaaagtgctgggattacaggcgtgagccactgtgcccaccctcatcccctcttttaatagatggttcccaattttggatttgtctcctattaacttttgattagatgcaggttagtcattccctgatggaaaactgtataagtgattttgtctcctgaggatatcacatctgatgatggcatgtgttatccatctgcatctcattggtgatgttaatttttgtcatctggtcaagatgttgtcctatttctctactgtatattaatttttttcaccttgcagctactctatgggtctcagatacatcttttacttactctagtatcaagcatatagaattatttggctggataggaaacaaaacaaatttagctatccagtttggattcatgctaatattctttgtttctgggacaaaactatttgtggtcattgtctatttgctattcctgtgtttccagaatagaagaggagcaaagtttaaagccctattcagaaatggcaaataggttttagttgatgctaaatttaaatttttttttatttttattttttgagacggagttttgctcttgttgccccggctggagtgcaatggcctgatctcagcctccccagtagctgggattacaggcgcccgccaccacgcctggctaattttttatatttttaatagggagagggtttcaccatgttggccaggatggtttcaaactcctgacctcaggtgatccacccgcctcggcctccctaagtgctgggactatagacgtaagccaccgtgtccagcctaaaaaaaatgtttttaaacaactttggttctaaaaataaaataagatgataaaaattaaatgaagatcaatggggttaattttttaattgagcaagacattatcattgttagtataaaacaatctgatctttttctgtcaatgtttgtcattgttcatataatttcaaaaatctttgtaatgacagattctgggggaactaaacaaaaaagaattataacaaaacaaatgtagagcagtacatggcaggagaatcacttgaaccttggaggtggaggttgcagtgagctgagatagcgccactgcactccagcctgggcgacagagcaagactccatttcaaattaaaaaaacaaggctgggcgcggtggctcacgcctgtagtcccagcactttgggagaccaagccgggtggatcacaaggtcaggagatcgagaccatcctggctaacacagtgaaacctcatctctactaaaaatacaaaaacaaaattagccaggtgggcgcctgtagtcccagctactcgagaggctgaggtgggagtatggcgtgaacccaggaggcggcgcttatagcgagccgagattgcgccattgcactccagcctaggtgacacagtgagactccgtctcaaaaaaaaaaaaaaaaaaaaaaaatcaaatttcaaataatgaaacaaactctggagatggacagtggtgatggttgcacagtgtgaatgtacttaatgctactgaactatagacttaacagtggttacaacggtaaaggttatgtatgttttaccacgcacacacacgtacacacaaatgtattttcaaaaattttaaataatacagaaggcttataagtagaaagcagtatccttggccacgcacagtggctcacacctgtaatcccagcactttgggaggctgaggcgggtggatcacctgaggtcaggagttcaagaccagcctggccaacatgatgaaacaccgtctttactaaaaaatacaaaaaaattagctgggcgtggttgcgggtgcctgtaatcctagctactggggaggctgaggcaggaaaattgcttgaacccagggaggcgaaggttgcagctagcagagatcgtgccattgtattccagtgtgggtgacaagagtgaaactccatctcaaaaaaaaaaaaaaaagaaaagaaaagaaaaacgtctccttttggcactctccgtaattaaccattattaataatttcttctggccaggcgcagtagctcatgcctggactccccagcactttggaaggcttagacgggcggatcacctggggtcaggagttcaagatcagcctggctaacatggtgaaacctcatttctataaaaatacaaaaaattagtcgggcatggtggggcacacctgtaatcccagctactcgggaggctaaggcaagagaatttcttgaacccaggaggtggaggttgcagtgagccgagattgtgctattgcactctagcttgggcaacaagagcaaaactctgtctcaaaaaaaaaggtcttcctatgtacaaatatataaacttgttttttggtattttttctttttattttcttttctctttatttgtttgagacagagtcttgctctgtcactcaggatggagtgtagtggtgtgatcacagctcactacagcctagacatcacaggctcaagcgatccctcacttcagcctcccgagtagctgggaccacaggtatacaccaccatgcttggcaaattttatattttttgtagagacgggtctcaccatgttgcccaggctggtgttttttctttttaaaacataaattatactatatgtgttgctctacagttatttttctttatattttggaaattcttccatatcagcatatgtagttctacctcattaatttttttaatgatactaggatattttagggtataaggatctttcatctatttagccatgccttatggccatttcgattgtatccagtcctttgtagttgcggacaaataaacatcattgtaaagatgatatttctgataaattccaaaaatatgtatgattcctaaaaatgggtcaaaagatgtatcttttttggtcaggcccagtggcacacacctgtaatcccagcactttgggaggccaaggcgggcagatctcttgaacccaagagttcaagaccagcctgggcaacagggtgataccctgtttctacaaagattagccaggcatggtggtgcatgcctgtaatcccagctactcgggaggctgaggtgggagaatcacttgaacccaggaggtggaggctgcagtgagttatgatgatgcaactctactccagccaggctggtaaagcaagacccactctcaaaaaaaaaaaaaaatccattaaaaataattacaaacttatgaaaaaaaagaaaactaagtctttttaaaatgtagattgatattctcaaagtccctttcccccaaaatgtttatttttttttgagctagaatcttgctctgttgcccaggctggagtgcaatgcacggtctctgctcactgcagcctcctcctcctgggttcaagtgattctcctgcctcagcctccccagtagctggggctacaggtgcatgccaccacacccacctgtattttttttttttttttttttttttgtatttttagtagagacggggtttcgctattttggccaggctgatcttgaactcctaaccttgtgatccatccacctcggcctcccaaagtgctaggattacaggtgtgagccaccgcgcccagcctgtttttatcttttttattttttgtttgtgttttttgagacagggtctcaccttgtcacccaggctggagtgcattgtcgcgatctctgctcacttgcaacctccgccttctgggctcaagtgatcctcccaccacgccctcctgagtagctgggactacaggtgcatttcatcacgctcaggtaatttttgtatttttagttgagacaggatttcaccatgttggccaggctggtctcaaactcttggcctcaagtgatccacccgcctcagcctcccaaagtgctaagattacaggcatgagccaccgcgcccagccttccgcaaaacgtttttaagtgtcaaatttttaatgctaaaagagcagttacccagcatcaatgtgttcattcagagaaataaacaaaaatttcaaatgattttgtttgctttgacttataataatttgggctgttttcaaaatttcaacttaaatataatttttttaacttttattattatttgagtcagggtcttactctgttgcccaggctagagtacagtaacatgatctcagctcactgcaacctctgcctcccagattcaagcaatcctcccacctcatcctcccaagtagctgggactacgggtgtgtgccactatgcccagataatttttgtagctctttttttttagagatggggtttcaccatgttccccaagctggtcttgaagtcctgagctcaagtgatccacccatcttcgcctcccaaagtgcagggattacaggggtgagccaccacacctggtcccatctctagattatttatacctaatacaatgtaaatactatgtcagtagttgttacactgtatactttagggaataatcacaagaaatgaagttggtacatgttcaatacggacacaaccatcctttttttccaattatttttgatgtgtggttggttgaatccatggatgtggaactcacagatatggagggtaaactctagagagagagagagtgtgtgtgtgtgtgtgtttgtatgtgtatggtgttggtggtggagtaaaatatatataacataaaattcataaagttgacaatttttaagttcagcataccttcaccttcacattgttcaaccaacaccaccaccatttcccgaactttcttatcttcccaaactatacacattaaatggtaactcagctgtttagctgttagtccagcccagctctgcctcagtgaactatgctgtgctctgctccactgaggtgcagggctgactgtatcatcaccagcaggggggatggctggccccaacctgaggaggagaaaaagaaggaggtacgcaggtccctggggtttctggttgtattcttgtccctaggcccctgcgttgtcccttagtgagggagaaaccttatgatcctggcccagccttgcaggctcccccggcatagagacacatgctctgtgctgtcttctaggggctgctgctgccctatgtctcctggccagttgacattttggcaaccatgaagtgacctgaagcgagcctccatttactgatattataattggagccttggtaccattcacccaatctcgctgagccagcaggggtctctggtgagtctcctctcagatttcaaatcttcctaattttggtttgagattcatactttgttcaagcaaccaattccacacttgatggagctggaattaaagttctgcttctaaggacacaatcatagacactggttattttacctaggctttgattggaatggcaaattttcagatatgaccagactgctttaaaacattgaggttgtttttgttttgtttttgttttttagagacaggcttttactctgttgctcaggctggagtgcaatggcatgatcatagctcactgcagcctcaaacttgggggggtcaagctgtcctcttgcctcagtgacctaagtagctggggctataggtgcattccaccatgcctggctaagtttttgttttgttttgttttttgtcttttcttagagactgggtctggctttgttgcccaggttggtcttgaacttctggcttgaggagatcctcctgcctttgcctcccaaagcactaaagcactgggattacaggtgtgagccaccgcaccagccaaggtttactttatagagctgataaaaaagatttgggaagattgactcgccattgcagaacaatcatgtatttgggtcatgtttaagtcaatatctcacaccattaggaaggttcattcctaagaagttgagtctcatggaggggggaatattacaaaggaccaaagctgaattttaaacaagagagaagtggtcctggaaactgtttcagactacatgactgtccctttgatcaaagcaattccttgagcaatcattattgttcaaaggttccctaacaaggtccctgaccttgcagtaagtaaaagatgtcactttctgacaagcccaggaacctcaagatatttttggggacttcaggaagagaggatttcacccaatgcatacaggtattatgggaacagtctgatgatggatccttggcttgacttcttagcctcaaggcttttaaaagtctaatccaaaattccttatgaatgttccaacaaaaccaacttaaaagagcctaggtggccactcactattcttattgccccctatgcaaagaatcaggccaaatatattactaaaccttattttgaaagtagattgcgagccaggcgtggtggctcacacctataatcccagcactttgggaggcctaggcgggtggatctattgaggtcaggagttcgagaccagcctggccaacatggtgaagccctgtctctactaaaattataaaaatttgctgggcgcaatggtgggtgtctgtaatcccagctacttgggaggcttagaaacgagaatcacctgaacccaggaggtggaggttgtagtgagccgagatcgcaccactgcactccagcctgggccacaaagtgagattccatctcaaaaaaaaaaaaaagagagagagagtaaattgcggcgggaccaggcacaggcagcattttgggaggccaagatgggcagatcacttgaggccaggagttagagaccagcctggccaacacagtaaagccccatctttaccaaaaatacaaaaaacagccgaacatggtggtgcttgcctgtaatcccagctacttgggaggccaaggcaggaaaattgcttgaacccagtggacagaggtggcagtgagccaagattgccactgcactccagcctaggcaacagagcgagactcttgtctcaaaaaataaaatcaaataaataaataaaataaatatttttaaaaagaaagtaaattggtcccactaagattaatctttggtaaaaatggggaattgaagaggaaaaaaaaaagtacattctatcaaaattatagcatacctattattaaattccagccttgactatttttttaaatttattatttgcatagaatttggactaagtcctgaattctttcctgtctgcaagtcttgaaattgatgtttctaaatttttctcccacttttctgacttgaaatcactaaaattaaaactgctttttcctgaagcctggcaaactgaaactggacaattttacgtaaacttcagaaaagtcaccatagtagcttacatatagaaacctttgtgggctgggcgtggtggctcatgcctgtaatctcaacgctttgggaagccgaggtgggaggatcgcttgggagggagcccaggagttcaggaccagcctgggcaacatagtaagagactactttttagtctctacaaaaaaattttacaaagaatgttagtgaagtgtggtgatatgcacctgtagtcccagctatcttgggaggctgaggtagaggatcacttgagcccaggagttccagactatagtgagctatgatcatgccactgcactccagcctaggtgacagagcaagacccttctcaaaaaaaaaaaaaaaaaaaatgctttaagcccagcatctaaaaatctcaactggctgccccctgttctcaaaaactaagtatctatatcccagataaatcagataacatcactaagttaatggccgatataaagacccaaataaaagattggctaaacagctggtttagatcttgggaaacttgataacaaaaaaagtttctttttctaaaaattataatcatttgttattttttgtctacactgctgttatggcatttgagggttttttttttttttttttggctgagacagggtcttactctgtggcatcagctggagtgcagtggtgccacctcagctcactgcagtctctacctcctgggctcagtcctcccacctcaccctcccaagtagctgggacttaacaggtacacaccatcatgccaggctaatttttgtagtttttgttttatagagatggggtttgccatgttaccaaggctggtcttgaactcctgagctccaagggtctgcctgcctcggcctcctaaagtgctaggaacccatgacagttacatcttcagtgtgaaatgttaaatataccttccccctgcccgccccccaaaaaaagaccatcttgactaatcagatcattgtaactatacattaagccttacataggaaaatattagtgttaaacttcaaataaaaccaaaatgaaaactgcccatttcacccttacccccagcctcagcaaccaccattctactttttcttcctctatgaatttgattactctgagcatctcttagaagtgtcatcctacaatatttgttcttttgtgacatgcttatttcacttatcgtaatgtcctcaaggaaatggctgattccaatgcttagcagacgtgttttctctgatgcatctggaacagcttcttatgccagaaagtaaggagtgctcaacaaaatggtggaggtgtgtcaaggaacttagaagctaggttgaaaagactcccattggtagactcccgttattagaaaggaatgctgcttacattagaatgccagctaataaatgtagaaaaagtggtagaattagaaaatagtcaccattttgcaacctcatagtaataattgatacagtcaaagatcatcaatggatattaaaactagtgaataaaagtttgatgaagaacagaatattcacgtaattgcaaagtgtctcctatgaatcactaattacaaaggaaaaaatagaaactttgaaatggaaaacatggcacataccacctaaatcaagtacaaagttatcagtaatgggactaatggatatgatcctctgacaaggatatgacatcacttaggtaatactcttgtcaaaaatacatagcctaaatctaataatgagggaagcatgagacaaacccaaattagggacatactacaaataactgaccaattgtcttctaaaatgttcgtgttacaaagaagtctgaggaactggttccaggctgaaagaaacagaaaggaaatgacacctaaatgcaatacatgctactggattaggatgtttaaaattgctccgaaagaacatttggacaattggtaaattttaaatttaagttgaaatatggactaatattttatcaatgtaaaattttctgattttgataattgtactttggttatgtaagagaatttttttttttttttttcagaaaatagaaactgaagtatttttgggtaaagggcatgaaagctaaacgtgactctcaaatggttcagaaaaaaattatatgtatattgcaataactaggattatccagagaaaaagagccaacaagctatatatagagaaaaatttattttaaggaattggctcacacgatggaggcttggagagttgaaagtctgatggggtaggccccatgttggagactgcactttgagtcttcatcttgagggaagagctgcagtttgagtcttgaggcagtcttgtggtagaatttcttcttactcaagggaggtcagtcttttttctattaagaccttcagctgattggatgagttccacctacattatgaagagtaatctgctttactaaaagtccaccaatctaaatgttgatttcatctaataaacaccttcacaaaaagatccagaatatttgagaaaatatctgggcatcgtggcccagccaagctgacacataaaatttactaccatatatgcatatgtatatacagtatacatgtatatatagatggctgggcaaggtggcccacacctgtaatcccagcactttgggaggccaaggtggggcagatcatcgaggtcaggcgtttgagaccagcctgaccaatgtggtgaaacccagtctctctaaaactacaaaaaattagccgagcttggtggcaggcgcctgtagtcccagctattcgggaggctgagacaggaaaattgcttgaacccggaaggcggagattgcagtgagccgcgattgtgccactgcactccagcctgggcgacagagcaagactctgcctcaaaaaaaaaaaaaaaaaatgataaagcaaatatgcaaaatgttaatatttggtaaagggtataaaggacttcttatgctctccttgcaagtgtaggtttgatggtatttcaaagtgaaaagtttaagagataaaaggaatggtatacaatggaataaactccagctgttaaagtgatagaaggggttttactgatgtaaaaacatgtccaagataaattagaggaaaaagcaaggtgcagaatattgtaggtacattaatccttctttatccttggtttcactttccatggtttcagtagcccatcagccatggtttgaaaatattaaatggaaaattcgagaaataaacaattttaagttttaaattgtgtatggttttgagtagcataatgaaatcttgtgctatccactccatcctgcttgggacgtgaatcatctctttgtttactgtatccatgctgtgtatgctacctgcctgttggccacttagtggccctctcagttatcagagattgacagatcacaagaagggtgagtacagtacaataagatattttgagaaagagagagagaccacattcacataacttttattatagtaaattgttataattgttctattttattattgttaaactcttactgtgcctaatttgtaaatgaaactttatcataggtatatgcgtataggaaaatatatactctatatatggttctgtactatttgcagtttcaggcatctcttgagtcttgcaatatattccctgaggataaatggggggactactgttgtagtatgacatcatttgagtggaaaaaattatgtatgctggtatatgtttataaattcccaaaatacctctgcaaagataaacaaaacctggtgacagtctattagtccctaaggcaaccatgattgccttagtggagaaaaactgggaggcaggtgatgagaaagagaattttcattatacatgctttagtaacttttagaattttgtgcttgtgcatattacttattaaaaaacaacaccttcacacaaagtatcatgatatgcatctttgtatttttgcctgtattttttactttcttcttaggttagagtctttaaaaagtaatttctggatgaaaggacttgagcatttttaaggctttttattcatgttgccaaattgcctctagaaaagtgaacaaattaggccggtgcagtggctcacacctgtaatcccagcactttgggaggccgaggtgggtggatcacctgaggtcaggagtttgagaccaccctggccaacatggcaaaaccccatctctaccaaaaatacaaaaattagtcaggtgtggtggcatgtgcctataatcccagctactcaggaggctgagggaggagaatcacttgaacccaggaggtggaggttgcagtgagccaagatcgcgccactgcactctagcctgggagacagactgagactccatctcaacaaaaaaaaaagtgaacaaattaatatttctaacatatttacatgtatttactgtaacctctttggagtagtgttgtggggaggtattttttaatagcctattgagatattatgacataccatataattcatcctttaaactgtacagttccatggttttttgtattttcacagagttgtgtaccaccaccacaatccattttaggacatttccatcaccccaaaaagaaacccctgttagcattcacttcgtattccaacccccacacccagctcttggcagccactgatccaacttctgtctctatagagttttctattctggacatttcatataaatggaatcgtataatatgtggtcttctgtgttggcttctttaggataatggtgtcaaggttcatccatgatgtagcatgtatcagcagttctttttatggttgaataatattccattgcatagatataccacattttgtttatccatttatcagttaatgagttatttctaccttttggctattgattagtgttgctatgaacatttgtatacaactttttatgtggacatatattttttcttttggatatatatggagaggagtggaattgctgagtcatatggtgattctatgtttaacttttctttgagacagagtctcactctgtcacccaggctggagtgcagtggcatgatctcggctcactgcaacctgcgcctcccaggtttcaacgattcttgtgcctcagcctcctgagtggctgggattacaggcgtgaaccaccgctcccagccctgtgtttaacctttttaggaactgtcaggcttttttccaaggtgactgtaccagtttacgtccccaccaggagtttacaagggttccagtttctccacattcttgccaattcttcttgttatccatcttttttattgtagccatcccagttttgatttgcatttccctgatggctaatgatgttgagcaccttttcatgtacttgcttggatagtgtattctcttctctctctctctcttaaattttttttttttttttttctgagacagggtcttgctctgtcacccaggctggagtgcaatggcgcaatcatggctcactgcactctcaacctcccaggctcaagcgatctgcctacctcagcccctcgagtagctaagatcacaggtgcatgccaccatgccaagctaatttttaaactttatatagagacaggttctctctatgttgcccaggctggtctcgaactcctggactcaaagctatcttcctgcctcagcctcccaaagtgctggcattacaggtgtaagctaccatgccagcttaaaatttgtttgtttattttgagacagtgtctcgctctgttgcccaggctggagtgcagtggcgcgatctcagctcactgcaagctccgcctcctgggttcacgccattctcctgcctcagcctcccatgtagctgggactacaggtgcccgccaccacacctggctaatttttttttttgtatttttagtagagacggggtttcactgtgttagccaggatggtctcgatctcctgaccttgtgatccacccgcttcggccttttaattttttttataagatgagatcacactatgttgcccagactcatctcgaattcctcagctcaagcagtcctcccacctaagactcctgagtagctgggactacaggtacatgctgccacacccaacttgagtagtgtattctttttttttttttttttctttttttgagacaggatctcactctgtcacccagactggagttcagtgatgtggtcacagctcactgcagccttgacctcctgggctcaagcaatcttcccacctcagcctcttgagtagctgggactataggtgcacactaccaagtctagctaatttttaagttttttgtagacatgaggtcccactatgttgcccaggctggtctcaaactcctgggctcaagcaatcctcccacctcagtcacccaaagtgctgggattacagatatgagccaccacacccagcagtagcatattctttgtaacagaatcccaatgaattgaaagctgtgaagtttactttgcttcttattttagttttaaaaactgtaattatgatttaagttataacagtgctataaggtttttttgttttcaaacaccctgatgcattttgttccaggttaggaaagccattcttgggagagtagtatgtacaatggattatatgatgatgtagtcaaggctcttgtttataaaaagcaagtatcagtctaggcaacaaaaagtgatacccctgtctctaaaaaacattttaaaattagctgggtgtgggggcacatacctgtggtcccagctacttgggaggctggagcgggaggatcgattgcttgagcccaggaagtcaagcccgcagtgagccacaatcatgccactgtactgcagcctgagtgacagagcgggaccctatctcaaaaaaataagagatatcacttaccaactttgcctgacctaaaagaagtattggataggtgataaaatctttaggatgacttaagaaaactacgcttagaaaaggccaggaacaaaaggatgctggccacacagccaaagagcatatcacagaatccatctagcagggacatagtttgcatggctagcaatgctgtccctggacattgccactttatttgccccaggagattgatcctgctctaagaattcaccacttcttcacttctctgcaccagcagcttcagattcaaaatctcaagcagatgtatctgataaaggatatcagattatatgccttcatcctagcttccagtaaagctgatctgtttagtggtagacaaggctcaaaagtggaaatgtcctcaaagcagagggtttcacatgcaaaatgtgatcatccaaaaataaaaacagtcttttttttttaagacggagtttcgctctcgttgcccaggctggagtgcaatggtgcgatctcagctcaccgcaacttccgcctccccgcaacttccacctccccgcaacttccacctcccgggttcaagcaattctcctgcctcagcctccggagtagctgggactacaggcatgtgccaccacgcccggctaattttgtatttttagtagagacagggtttctccatgttggtcaggctggtctcgagctcctgacctcaggttgtccacctgcctcggactcccaaagtgctgggattacaggcgtgagccactgcacccggccaaaaaacaaaatttttaaagtcctctgtaagggagcataattttttgtaagccaaaaaatatttagtaatctgacaaattttttgctgctgttggtaagaatcttttaatgaggtccttaagagtctcagattatatcagcatgtccagagtttgaatgctgtattaggacgttttacgttgctatgaaggaatacctgaggttgggtgacttatttaaaaaaagagatttatttggcccagggttctgcaggccgtataggaagcatggggctggcatctgctcctggtgagggcctcaggaagtttacagtcacggtaggtgaagggggaggaggcacatcacatgatgagagcaggagcaattgagggtgggaagtgccacacttttaaacagccagatctcaggtgagtgacaactaaactcactaccatgaggagagcaccaagccattcatgagggatctgctcccatgacccaaacacctcccactaggcccacctccaacattggaggtcacgtttcttttttatttttttgagacgggctttcactctcttgcccaggcagtagcatgttcatgactcactgcagcttcaacccctcaggctcaagtgatcctcctgcctcagcttcctgagtagctgggcccacagtcacacaccaccatgctttgctaacttttaaattttttgtagagacgagatctcactgtgttgcccaagctggtctcaaactggtgggctcaggtgatcctccagcctcaccctcccaaagtgttgggattacaggcatgagctaccatgcccagccaaggaaattacattgcaacatgagatttggaggggacaaaacatccaaaccacattaaatagctttggatgatttgctattaatgtcttctgtcaccttaaaaagaaattataagtattggccaggcgaaatggactcaagtaagcctttccaatctacatgaaataatcagaacatagggccgagtgcagtggttcatgcctgtaatcccagcactttgggaggccgaggcaggtggatcatctgaggtcaggagttcaagaccatcctggcaaacatggtgaaaccttgtctctactaaaaatacaaaaattagctaggcatggtggtgtgcacctgtagtcccagctgtcaggaggtagaggcaggaaaattgcttgaagctgggatgcagaggttgcagtgagccaagatcatgccactgcactccagcctgggtgacagactgagactccatctcaaaaaaaaaaaattacaagtattattctgtatatattgctagacctttaattaagtgagctttgacatgacaagttttctatctaagaccacgttaacatagggacataaaaaaatgtacccagaattggcctgggcacggtggcttgcttgaacacaggaggtggaagttgcagtaaaccaaggtggtgccactgcactccaacctgggcaccagaactattaagtttttttctgagtatgtgctaccttctttacttttggttgtggaaccacacattggaactcaaactcttgaattttactcctaacctgtaacaatctggtgctttgtaatcaaattcccatttggaaaatggaattgtctttccatttgggagacttctgttttccctcaaactaattttattttattttatgtttttttttttaaatttatttattttttattgataattctcgggtgtttctcacagagggggatttggcagggtcataggacaatagtggagggaaggtcagcagataaacaagtgaacaaaggtctctggttttcctaggcagaggaccctgcggccttccgcggtgtttgtgtccctgggaacttgcgattagggagtggtgatgactcttaaggagcatgctgccttcaagcatctgtttaacaaagcacatcttgcaccgcccttaatccatttaaccctgagtggacacagcacttgtttcagagagcacagggttgggggtaaggtcacagatcaacaggatcccacggcagaagaagttttcttagtacagaacaaaatgaaaagtctcccatgtctacttctttctacacagacacggcaaccattcgatttctcaatcttttccccacctttcccgcccttctattccacaaagccgccattgtcatcctggcccgttctcaatgagctgttgggcacacctcccagacggggtggtggccgggcagaggggctcctcacttcccagtaggggcagctgggcagaggcgcccctcacctcctggacggggcggctggccgggcggggggctgacccccccacctccctcccggacagggcggctggcctggcagggggctgacccccccacctccctcccggatgggggtgctggcctggcggggggctgaccccccccacctccctcccggactgggtggctgccaggcggagacgctcctcacttcccagactgggtggctgtcgggcggagaggctcctcacttctcagacggggcggctgccgggcggaggggctcctcacttctcagacggggcggttgccgggcagagggtctcctcacttctcagacggggcggccgggcagagatgctcctcacctcccagacggggtcgcagccgggcagaggtgctcctcacatcccagacggggtggcggggcagaggcgctccccacatctcagacgatgggcggctgggcagagacgctcctcacttcctagatgggatggcggcgaggaagaggtgctcctcacttcctaggtgggatggcggccgggcggagacgctcctcactttccagactgggcagccaggcagaggggctcctcacatcccagacgatgggcggccaggcagagacgctcctcacttcccagacggggtggcagctgggcagaggctgcaatcttggcactttgggaggccaaggcaggcggctgggaggtggaggttgtagcgagccgagatcacgccactgcactccagcctgggcaccattgagcactgagtgaaccagactccgtctgcaatcccggcacctcgggaggccgaggctggcggatcacttgcggttaggggctggagaccggcctggccaacacagcgaaaccccgtctccaccaaaaccagtcaggcgtggcggcccgagcctgcaatcgcaggcactcggcaggctgagtcaggagaatcaggcagggaggttgcagtgagccgagatggcagcagtacagtccagcttcggctcagcatgagagggagaccgtggaaagagagggagagggagaccgtggggagagggagagggagagctcctaattttgtatttgtagtagagacggggtttcttcatgttgctcaggctgtgtcttgaactcccgatctcaggtgatctcaaactaattttataacctgtcaatctgttaactaacattaactttgtaaattttatgcaaaatattgtctaggtaatatagagaataaaggaagtagataggtgctctcgctccctccatagcagtaaactctatgtgatgaccactaattaataacctgtattcccctggtgatcctgggaacgaaagtgatttcatagtgaggactttttttttttaattaaatttaggcttgagggatggtgtttgttctttgttcatgtaagacagtgtcttgctttgtcacccgggctggagtacatgattgaggctaactgcagtctcgacatcctgggctcaagcaattctcccacctcagcctcccaagtacctggggctacaggcacatgccaccacacccagctaattttttaaatttttgtagagatggggtcttaactatgttgcctgggaaatctggctttttaataaagagtcttagtcatgaatagaatatttcctttcaatccattatttaaatgaattttaaaggtgccttttttctcctcctttttttttttagtttaatacaattttttagtaaaatgaagaaatggatggacatgtcaaatctaccacaagaatttcgtgaacgtatagaaaggctagagagaaattttgaggtgtctactgtaatattcaaaaaatatgagccaatttttttagatatatttcaaaatccatatgaagaaccaccaaagttaccacgaagccggaagcagaggtgagcccttaatccttatataattgacataaagattatgatacaaactaagagaatatacttttttgaaagtctgttttttatgaaaagtattcctgcaaagaacttaattattttctttttaaatccatgtacaattatccatatttggaaattcaggataatacttttacttatttttctttctgttgttgtttttttttttttttttttttttttgaggagtctcattctgttgcccaggctggagtgcagtgtcctgatctcggctcactgcaacctctgtctcccaggttcaagcaattctcctaccttagcctcctgagtagctgggatcacaggtgtgcaccaccccgtctggctcattttttgtatttttagtagagaccaggtctcaccgtgttggccaaggtggtctcgaactcctaacctcaggtgatctacccacctcggcctcccagagtgctgggattacaggcatgagccaccacacccagccctatgttctgattattttatgcaggttggaaaggcttacttaagtccatttcataaataatagattacttttcttcatgaatggaatttcatgtgtaatttgatctatttgatatttacatttactatttcagtttacatgatatttagcgagctagtcagacaaaaagtaatttttttccctttttaggaggattccttgcagtgttaaggatctgtttaatttctgttggacactttttgtttatactaagggtaagatgacactttcagtggtcttacatttctactctgggaacttggtgctatttgacatgagaggtttctggtttttgtgtcttttttttttttttttcccttataaaggtaattttcggatgattggggatgacttagtaaactcttatcatttacttctatgctgcttggatctgatttttgccaatgcgattatgtgcccaaatagacaagacttgctaaatccatcatttaaaggtaagaccttttatttatttttgaaaactgattatcagtttttggaaaaagatttttaaaagttgactatttttttttccctctgcccttcctacactgtcaaactaggtttaccatctgattttcatactgctgactttacggcttctgaagagccaccctgcatcattgctgtactgtgtgaactgcatgatggacttctcgtagaagcaaaaggaataaaggagcactactttaagccatatatttcaaaactctttgacaggaaggtactgtacttataattagatgactgagatgtttacagatcaccagtaatgtgaaaagaaaaaaatgttttaagcaagttctcagcattatagaacttagggtcaggattcccaggctttagcctctactgtgattcagaatttccttatgatcttgtgtgatgtgagaaacagagctgttgaaaaatgtgaccaactatatgtactgttgggtaaatgtactgtcagaggcaaccgtaggaggtactgataaagaattgtaaagaatagaacatcagagtagggctgacaaataattaggaaaaacaggaggtcagaataagctgactaatttactgccacaatttgaataactgctgactgttgactaaaagtaggatgatgtataacaaccacagttttaattccatgtaaatcgagcagaaaatccatgatagttttgtagccacttgtaggctatctgtgtgcattctggacattgtctccttggtaattaacttagctatttctacatttatgaattggcttgttcctttgggtttcaatttcttatttccccaacgtcgagccattaaatgtagttaagcctcaagatttctctttggtaaaaggaggggtttggattatggatcccacttttcaaatattatgagatttttctttaagcataaattcttcccttactggtttcttcttcttttatacaaatttttgtattcagtcttgtgttcctcagatatctatattatggcccattgtctgtatgctaaacatctctagcaaagtaaactttttttaaaggatcccagggactgggcgcggtggctcacgcctgtaatcccaacactttgggaggccaaggcaggtggattgcttgagcccaagagttccagacgaacctgagcaacatggcaaaaccttgtctctacaaacaatacaaaaattagttgggcatggtggtgcacaactgtagtcccagctacttggcacgctgaggctgcagtgagccatgattgtaccactgcactgcagccctggtgacagaacaaaaccctgtctcaaaaaaaaaaaaaagttaaaaaaaaaagttatttgcatgctaaatagtttatcctagtctgaaagaaatatttaataattctgttttgtgtgtgtgttataacaatatggaaatttagataaatttcacgtttgtgtgtgtattaatatgcttaattatatggtgtcccaaaataattttttgttcacagatattaaaaggagaatgcctcctggacctttcaagttttactgataataggtaaatatctagtactaatggtgcctggcttatcacaagctgtcatatttgttgatttgttgaaatttgttaagcataacagtatatcaaagtaagacctccaaattcaagttctctctgctttagtggcattgaatgtttattatcactaagacttgttggctttaaatacatttattttaagaaatcaaggccaggcacggtggcccacacctgtaaacccatcactttggaaggccaaggcaggcagattgcttgagctcagaaggttggagaccagcctgggcaacatggtgaaaccctgtctctacaaaaaatacaaaaatcagccagacgtagtggtgtgagcctgtggtcccagctacttgggaggttgaggttggaggatcgtttgaatctgggaggttgtggttgcagtgagccgtgattgcaccactgcacttcagtctaggtgacagagtgagaccctatttccaaaaaaaaaaaaaaaaagaaagaggccgggcatggtggctcacgcctgtaatcccaacactttgggaggccaaggcgggccgatcacttgaggtcaggagtttgagatcagcctggccagagatcagcctggccaacatggtgaaaccgcatctctactaaaaattcaaaaattatctgggtgtggtggtgcacacctgtaatcccagctgcttgggagactgaggcaggagaatcacttgaacccaggaggcagaggctgcagtgagctgagatcatgccactgcactccagcctaggcgacagagcgagattccatctcaattaaaaaaaaaaattattgatacttacgtatttatttttatttttttagagatgggatctcactgtgttgcccaggctggtctctaattcctggcctcaagcaatcctctcaccatagcctcccaaagtgctaggattacaggtatgacccaccacacccggccaattggcatttaaaacagctactcagccaggcgtgcaatggcttatgcctataatcccagcactttcggaggccaaggcaggcagatcacgaggtcaggagattgagaccatcctggccaaaatggtgaaacccggtctctactaaaaatacaaaaattagctcggtgtggtggcacacgcctgtagtcccagctacttgggaggctgaggcaggcggatcgcttgaacccaggaggtggaggttgcagtaagttgagatcgcaccactgcactccagcctgggcagcagagcaagactcatctcaaaaaaaaaaaaaaaaagaaagaaaagaaattaaggccgggcacagtggctcacacctgtaatcccagcactttggaaggccaaggcagccagatcgcttgagctcagaaggttggagaccagcctgggcaacatggtgaaaccttgtctctacaaaaaatacaaaatcagccagacgtagtggcgtgagcctgtagtcccagctacttgggaggctgaggtgggaggatcatttgaatctgggaggttgaggttgcagtgagccatgattgcaccactgcacttcagcctgcttgacggagtgagaccctatttccaaaaaaaaaaacaagaaaaaaagaaagaggccgggcatggtggctcactcctgtaatcccaacactttggggggccgaggtgggctgatcacttgaggtcaggagtttgagaccagcctggccaacatggtgaaaccccatctctactaaaaatacaaaaattatctgggtgtgatggcgtgcacctataatcccagctgcttggaagactgaggcaggagaatcacttgaacccaggaggcggaggttgcagtgagcccagatcacaccattgcactccagcctaggcaacagagcgagattccatctcaattaaagaaaaaaaatcattgacacgtatttatttttatttttttagagatgggatctcactgtgttgcccaggctggtctctaattcctggcctcaagcaatcctctcaccatagcctcccaaagtgctaggattacaggcatgacccaccacacccagccaaatggcatttaaaagagctactcagccaagctcgaagtgactcacacctataatcctagcactttgggaggccaaggtgggccaacatggtgaaaccccgtctctactgaaagtacaaaaactatccgggcatggtggcacaagcctgtagtcccggctactcaggaggctaaggcaggagaattgcttaaacctgggaggtagaggctgcagtgtgccaagactgggccactgcattccagcttgggtgacggagtgagactctgtcttaaaaacaaaaaacagccactctcttgagaaactcataaacagacccaatgactctgtatttgattttacattctttcattaatcacatgttggcagtgcccatatttttttttggagacggagtctcgctctgtcgcccaggctggagtgcagtggcgcgatctcagctcactgcaagctccgcctcccaggttcatgccattcttctgcctcagcctcccaagtagctgggactacaggcacctcccaagtagctgggactacaggcgcccgccaccacgcccggctaattttttgtatttttagtagagatggggtttcaccgtgttagccaggatagtcttgatctcctgacctcgtgatctgcccgcctcggcctcccaaagtgctgggattacaggcgtgagccaccgcgcctggcccattttttttttttttttttttttttttgagacagagtcttgttctgttgccaggctggagtgcagtggtgtaatcttggctcactgcaacctccacctgccatatttcaaagccactagtgtttccttagtgatcagaaaccattttcataattagattcaactagttttcagattaagtatatgtagtctctcacttttgaaagtaatttattggttgtatatatgaatttgaagaatgtccataatcaggtaggaccctctgatattgttagatggtcagagttaataaaaattagaaagttgtcaagttttctaagctgtaaacactaaatctatcttcaagtcaaaataaatccattgtgtaacttagtattacagcttataataattctctttgcagcaaagcagtgaataaggagtatgaagagtatgttctaactgttggtgattttgatgagaggatctttttgggagcagacgcagaagaggaaattggaacacctcgaaagttcactcgtgacaccccattagggaaactgacagcacaggctaatgtggagtataaccttcaacagcactttgaaaaagtaatataacctagcctggcctcaatcttgaatgatctttttctctctgtgtgtgattctactaacagcagaagcatctttcaagttaaatcttgagcttcttctactaattcatatttctcatgaaagccttaaaaggtaatttttaaaactggcatttagtatttttacctcatttcttactattcatattttatatccattttcccagcatgactgggtttattagtagagtatatgtcttttgacatgaagaggaagttttgctttcttacagttctttctttgcttcaacttaggctccgttacgttgctttaaattttagtttgctttcctacccgtgacacaaactatgtgtttttctgtaacttcagccataaaactctggacttgattgttaatggccaaggcttaactctgtatttatgtgtaaaatgggttggaggaagagatctaatggaaaattcacttgtctagaacatagtaaaacctaagttttagtccaagctttaccattaactttgtcaactgaaataagtttttaaatttctctgttcctatttcctcatatataaaattaaattatgtatacattatctttcaaatcagtggtgtgaagattaaatgaaattatatgtagaaagtgcttttaaaaagtgttattcaaatataaggatgttattagcatagtattgctaaaaatttcatggatattacaaatatgaatagagaagatggtatatgcactgaattaaacacataataaggaagatggtaacttttaaaaactcacggatttttcttttctgacagaaaaggtcatttgcaccttctaccccactgaccggacggagatatttacgagaaaaagaagcagtcattactcctgttgcatcagccacccaaagtgtgagccggttacagagtattgtggctggtctgaaaaatgcaccaagtgaccaacttataaatatttttgagtatgtacaatactgttatttttccaaatgtctttttaaaattagatttcttgttccattctatttttagtatattcagaattctcaagatagtggatgttcatctggcaagttttactataccatttcaatcacaaaatatattgacctaaaaccatattgaagtacctattaaaaattatgtataacagtcaggcacagtggcacacacctgtagtcccagctacttgggaagctagtttggccaacatagtgagactaattccagcttggccaagatagggagaccttatctctccctttttttttgttttttttttgagacagggtctcgctatgtctcccaggctggagtgcagtgccgcaatcacagctcactgcagcctccacctcctgggctcaagcaactctcccacctcagtcccccaagttagctggaactacaggtgcaagccaccatgcctaattttttatattttttgtagagacagggttttgccatgttgctcaggctggtcttgaacttctgagctcaagtgatccaactgcctcggccttccaaactgctgggattacaggcatgagcgaccatgccaggccaactttgtctcttaaaaaaaattatatataatgttatttcatgggagtatagacttttagagataagtgtaccttaaagattatttagcactgatatttcactcttataactacccctgagttatgcatgttttgattttacattgactttatttttaatttatttttatttttgtttgtttctaaagatcacctgtataaggacatacattaactttaaatggggccattctaaatgtccattagataggggactaattgcatattggtggtacagccataaaaatggatttatttatttatttatttatttatttatttatttattttgagacagagtttcactcttgttgcccaggctggagtgcaatggcatgatctcggctcactgcaacctccacctcccaggtccaagtgattctcctgcctcagcctcccgagtagctgggattacaggcgtgcgccaccacgcccagctaattttgtatttttagtagagacagggtttctccatgttggtcaagctggtctcaaactcccgacctcagatgattcgcctgcctcggcctcccaaagtgctgggattacagacgtgagccaccgcgcccagcccataaaatggaattttatacagtttttttttttgttttttaaggaagcatgattcctggtaaagatggtagaatgaagccagatcagagaaccttctttcctaatacctaataaaataagagaatagtcaaaaccagcaaaatatttatcaatggcaaccaaatgaggagagagatatgatttcatgacaaatttccaaagtagagatcaaaaagaaaattcatgattctggtattcccatccctaagcagtgttggggaaagagggtatagtgatagatcttgagaattctcatcaatacttcagatttggagggaaacaaatgggggagtaggcagacagataaaaagtcatacaaaccttcccaattgaaagtccgtatgtaccaccagcaggatcccagcagaacaactgccaagggctgccattttccaacattccatgatgatttggggagagatcctcatatacctagacgtccctgactaggaatagtgaaccctagaataggaatatttaactaaatctcagaagacaaagcgaagccctggtcctccaagaaaagctgaacatagctgagctctcccccattcctcaaaccttcaggatacaagaaagtagacagaacaatctccagcctcagaaatagctcagaagaaaagcatactgccagtaagataggaagactgtcacggatctaccttccatatcatttgagtaaatagatctggattgaactactgttcaaacatgaataagttgaaaagcagtgacaaagcaaatatacaaatatgtcaataagaaaaaggaagtatagaatgcaaaagaaaaaaaatctagacacaaataaatggaaacgctgggtgttgtggcccatgcctgtaattgcagcactttgggaggctgaggcgagaggatcagttgagcccaggagtttaagaccagcctgagcaacatgatgagaccctgtctctacagaaaaaatttaaaaattagtcatggtgatatgcattccagctacttgggaggctgagatgggagaatcacttgagctcagccatgatcacaccattgtactctagcctgggcaacagagcgagaccctatctcaacaaaaaaaaaaaaaggaaagacatctgtgtttgtggactggaagacttaatattgttaagatatccatattagaggccaggtgcaatggcacatatctgtaatcccaggactttgagaggccagggtgggtgtattgcttgagctcaggagtttgagactagcccgggcaacatagcgacacctcatctctacaaaaacaaaaaaacaaaacaaataaaacctggtcattgtttctttctttccttttttttttttttttcttttgaggcggagtcttgctctattgccaggctggagtgcaatgacatgatcttggctcactgcaacctccacctcccaggttcaagcagttctcctgcctcagcctccaagtagctgggactacaggcgcctgccaccatgcccagctaatttttatatttttagtagagatggggtttcaccatgttggccaggatggtctcgatctcctgacctcatgagctgcctgcttcagcctcgcaaagtgctgggattacaggcatgagccaagggctgccattttccaacattccatgaagatttggggagagatcctcatataactagacgtccctgactaggaatagtgaaccctggaataggcttttttttttttgttttgttttgttttttttttttttagacagagtttcgcccttgttgcccaggctggagtacaatggcccgatctgcagccttcgcctcccaggttcaatcgattctcctgcctcagcctcctgagtagctgggatgacaggcatgcaccaccacgcccggctaattttttgtatttagtagagacggggttttaccatattggtcaggctggtctcgaactcctgacctcaggtgatccacccaccctggcctcccaaagtgctgggattacaacaggtgttagccaacaggcctggccaatttttgtatttttagtagagacatgtttcaccatgttggccaggccgatctccaactcctggcctcaagtgatccacctaccttggcctcccgaagtgctgggaatatagatgtgagccaccatgcccggtgtcaaacctaaaagctttaacatagcaaagaaaacaatcaacagagtaaaaaaaacaacctatagaatgggaaaagtaattgtaaaccatatattagttaaggggttcatactcagaatatgtaaagaactcctgaaactcaagaacaacaaataactcaatttaaaaacgtataaaggattcagcagatatttctccaaagagtatatgcaactggccaaaagcatatgaaaaaatatttgatatcactaatcagggagttacaaatcaaaatcacaatgagataatacctcacatatcagcatagccacttcccactcatcaccccaaaaaaaccaaaatagcaggtgttggtaagaatgtgtaaaaattgggacccttacacactgttggtagaattgtaaagtggtgcagccactatggaaaacagtacggacgttcctcaaaaaattaaaaatagaactaccatataactcagcaataccacttctgggtatacatccaaaagaattaaaaacagcatctcaaagggatatttgcacatcatgttaactgcagcattattcccaatagccaagttgtggaaacaccttaagtgtccattgatagagaaagaaaatgctgtgggtgtatgtgtgtgtgtgtagataggtagataggtaggtaggtaggtaggtaggtaggtaggtaggtaggtaggtagatagatagatagaaagaaatagagatatgagatggaatattattcagccttataaaagaaggaaatactgccatttgctacaacatggatgaacctttagtacattatgttaagtgaagttagtcaatcacaaaaagacaaaatactgcatgattccactcatataaggtacatagtatagtcaaacttacagcagcaaagttttattacatgtgtatacaatctgtatttttattatataattttacgtgttaaaatattttatcatataaagctttgcttacatatgtagatttccaactgagaatacaactttggctgctaaaaactaattcttgaaagaaggcatgttggccgggcatggtggctcatgcctgtaatcccagcattttgggaggctgaggtgggtggatcacaaggttaggagatctagaccagcctaggcaacatggtgaaaccccatctctactaaaactacaaaaattagccaggtgtggtagtgcgcgcctataatcccagctacttgggaggttgagacaggagaatcgcttgaaccctggaggaagaggttgcagtgaactgagatcgcaccactgcactccagcctgggttacagagcgagactccgtctcaaaaaaaaaaaaaaaaaaaaagaagaagaaggcatgttagtattctggtgtggagtcttttttgtttgtttgtttttgtttggtttggtaattggttcctcttgtattttgtagatcttgtgtgcgtaatcctgtggaaaacattatgaaaatactaaaaggaataggagagactttctgtcaacactatactcaatcaacagatgaacagccaggatctcacataggtaagaaaagaaaactacagttggcatagcattgaaaataagtaatccccccaaaattagaaattcacggtttttcctctcccgttattcttatttcttttttttttttgagaccgagttgcccaggctggagtgcaatggcatgatctcgactcactgcaacctcctcctcccaggttcaaacgattctcctgcctcagcctcccaagtagctgctattacagggacccaccaccacaccggctaattttgtatgtttagtagagatggagtttcaccatgttggttaggctggtctcagactccggacctcaggtgatctgcttgcctaggcctcccaaagtgctaggattacaggcgtgagccaccattcccggcctgccctgctattcttaatgtatcagatttaagtttatatataatttttgcttttcagtccttaacaactaaaattcattaacacatgttttctctgtatttccctgatagactttgctgtaaacagactaaagctggcagaaattttgtattataaaatactagagactgtaatggttcaggaaacacgaagacttcatggaatggacatgtcagtaagtaaatccactctctgagctactggcaaggtccaaaagtcagcctggaagcagtgttttgagaggctctgtaaggcgttgtgggagtcaccaatctatgacacacttggccaggatggcatttagttgactttagcacatgcaaggctaatcaatctaggcagaaatgtgaaataacgtaaagttcatctttggtacacatcagtgttttttaagtgttttttttttttttttttttttctgtccttcattcccagctagtgatccctccacctgttaaagcaactgttaattaagacatttgtccataccttccaaggattttggattataaaatggtatgggtttttcttgttttgttttgtttctttaactatgaccaagtcagaccactgtctccaataagatgtgtaaaagaatttttctacaaattcagacctatcatatgatctttgtttcctcctccttcattatttccctctgcagtcactcttggagtcttctaacttttctatcccaataggaacaggttgatgtcttaaggatgctgcgtaactattgtaatagagtttctctttgtgtttacctggaaatttttttcatgtcttttctgtgttggtttctcttttctgtgtctttctttttcatagtttacgctaatatcttgatggtgcatacacttccatggcttcctgagaaagaagtaaatttttttttttttagactgagtcttgctctgttgcccaggctggagtgcagtggcacgatctcggctcactgcaacctccatctcctgggttcaggtgattcttatgcctcagcctcttgagtagctggggttacaggcgcccgccaccacgcctggctaatttttgtatttttagtaaagacagggtttcaccatgttagccaggctggtctcgagctcctgacctcaagtgatctgcccacctcagcctcacaaagtgctaggattacagccatgagccacctcacccagctgaaagaagtaaattttttaacttttatttattttaatttttttaattttatttatttatttttttagatgtagtctcgctctgtcacccaggctggagtgcagtggcgcgatcttggctcactgcaacctccgcctcgcgagttcaagcagttctctgcctcagcctcccgactagctgggattacaggcgcctgccaccacacccagctaattttttcgtatttttagtagagacggggcttcactgtcttggccaggctggtcttgaactcctgaccatgtgatccacctgccttagcctccaaaagtgctgggattacaggtgtgagccactgcacctggccaactttttattttgaaataattatagattcacagaaagttgcaaaagtagtacagagaagtcccacacatcctttatccagtttccctaatggttacaattttatatactgcagtatcagaactggggaattgacattaaaacagtgtgtgtgtgtgtgtgtgtgtgtgtgtgtataaaattgtatcatatgcatagattaaccataaccaaaataaaaatactgaactgttaaagatctccttcctgctacccctttatagttagttacacttactcctctcagccattattgttttccacttctacatactctgtatgaatttagttcttttcaatttgttttagttatattgtagcccaggatatgttttatcatggtgaatgttctgtggccacttgaaaagaatgtatacagtaaatcctcacatttaaccttgtcagtaggttcttggaaacagtgactttaagcaaaaacaacatacaatgaaaccaattttaccataggctaactgatataaacaggagtttaagttcttttggcatatgtctagtcacaaaaacctcaccaaacttctaaataaagacaaaacacttataatgttaaacattgaaataaataagagaaagtaataaaaataaggaagattattacttatccagttattcctgttcagggtcatgagagcctacctcagcagctcacgatgaaaggcgggccccaaccctagtcaggacaccatttcatcataggacacacacacacccacacttacactgtcacaatttagatatgccagttaagctaatgtacatatctttggaatgtaagaagaaaccagagtacccagagagaactcatgcagacgtaggagaatgtgtaaatttcatacagtggccccagctgggaatccattatttttcattgttacaacaaactggtgttgagcgaaatggtgttattcaaggatctgctgtattctgctattgttggatggagtgttctgtaaatgtcagttttatcttgttggttgatgttgttattttatattcttgctgatttccagtctagttgttatatcagttgttgacagaggatgttgaagtgtccatgtatgattgtagatttgtctatttctttcaagtctgtcagcttttctccacgtattttgaagctctgctgtttgatgcttacacatttaggattgctgtctgccttcttgatgaattgactctgtaatcattataaaatgttcctccctggccaggcgcagtggctcatgcctgtaatcccagcactttgggagactgaggcaggtggatcacctgaggtcaggagttcaagaccagcctggccaacatggtgaaacactgtctctactgaaaatataaaaggctgggcatggtagctcacatctctaatcctagcactttaggagactgaggcaagtggatcacctgaggtcaggagttcgagaccagcctgaccaacatggcaaaatcccgtctcaactaaaaatacaaaaattagccaggcgtggtggcgcatgcccgtagtcccagctactcaggagtctgagacaggagaatcgcttgaacccaggaggtggcagttgcagtgagccaagatcgcaccactgcactccaccctgtgcaacagagtgagactccatctcaaaaaaataaatatatgaaaatacaaaaattagccgggtatggtggcaggcgcctgcaatcccagctactcgggaggctgaagcaggagaatcgcttgagcccgggaggaagaggttgcagtgagccgagatcacaccactgcactcccacgtggaagacagagagagactgcatctcaaaataaataaataaataaggctgggcacggcggctcacgcctgtaatcccagcactttgggaggccaagccgggtggatcacaaggtcaggagtttgagaccagcctggccaacatagtgaaaccccatctctactaaaaatacaacaattggccaggcatagtggtgtgcacctgtaatcccagctactcgggaggctgagacaggagaatctcttgaacctgggaggtggaggttgttgtgagccaagattgcaccactgcactccagcctgggcaacagagcgagactctatctaaaaaaaaaaaaacttaaaaataaaataaataaataaaatgttcctctctgtccctggtaattttctttgcatctacctgatgtttatgaataaccactcctgccttcttttcattaatgtttgcatggcatatctttttccatcctttttcaagtgacctttgaagtgaatttcttatagtcagtgtgtagttgggtcatttttttttttctaatctgtgctaatctctgtcatttaattagtaaatttagatgacttaaaattagtaattgttatgttagcacttaagtctgccattttatttttgttttctgtttgttctcactcttttttttttaattttgttttctttttcctccctctctgttggttacttgaacattttttagagccttgtaaagatttttttttgtatagatgttttgtatagccatataaccaatttaagtaaagtatagaaatcttacctcacttaaagtccctttttaaagattttgcataagtaactttattttagactcataattgattgatagttgtctatgtacagaattcaagattggtgggagaggccaggtgctgtggcttacccctgtaatcccaacactttgggaggccaacgcaggtggatcacctaaggtcaggagttctagaccagcctgaccaacatggtgaaaccctgtctctactaaaaaataccaaattatccaggtgtagtggcacatgcctataatcccggctacttgggagaggctgaggcaggattgtgttaacccaggaggcagaggttgcaaggagctgagatcacgccattgcactccagcctgggcaacaagagcgaactccatctcagaaaaaaaaaagaaaaaaagatctgtgggaggctgaggcatgaggattgcttgagcccaggagtttgaggttgtagtatactgtgtattgtatgtatgctgtgtagtatgattgcactgtgaatagctactgtcctccaacctaggcaacatagcaagaccccatccctaaaaacaaaaaaaaacttaaaaaaagaaaagaattctagattgacaatcattttcctttatgagtttgaaggtactgttgcattattttctattatagattccactgttactaatgagaagtccagtgacattctcattcccacttagtagtatgtgacctgttttttttttctgaaatctttgagtatcttttatcactgatgttcttaaatttataaaaatgtatcttactgtgttttttttcattcatgtgtctgtcattcccacagacttgcccgtttagtctagaaattcatgccctgcagttcttggtcgttttattttgttatttcttagatggtacattgcccactgatttatctttctggaactttcatttttcagatgatggaccttctgaattgaccttcttaatttcttctcttgttttccatttctttatctcttttattgtacctttttttttttttttttttttttttttgagacagagtcttgctctgccacccagactggagtgcagtggtgcaatctcagctcactgcaagctccgcctcccaggttcacgccattctcctgcctcagcctcccaagtagctggtactacaggtgccagccaccacacctggctaatttttttgtatttttagtagagatggggtttcacccatgttagccaggatggtctcgatctcctgaccttgtgatctgcccgtctcggcctcccaaagtgctgggattacaggcgtgagccactgcgcccggccttattctacttttaaagatatttactcaacttttcatctagtcccaatgaacttttaatttcagctatattttcatttctctttcatgttctctaaagttactaatttagatttattcgaaattttcttgactgcttcgtctctgtttctcctgaatttttctccattttttttctctctctctcttttttttttttttgagatggagtttcgctcttgttgcccaggctggagtgcaatggcacgatcttggctcaccgcaacctccgcctcccaggttccagctattctcctgcctcagcctcccgagtagctaggattacagggatgcgccaccacacctggctacttttgtattttttgtagagacggggtttctccatgttagtcaggctggtctccaactcctgacctcaggtgatccacccacctcagcctcccaaagtgccgggattacaggtgtgagccaccatgtctggccttttttctctctctaaaaaatattttaaatttttttaaatgttagtttatatcttttattaactcatacacagttagttatcttctggtttgttgaagcagtaagtcagacatttgccacaataatgtctgtcaaagtggcttgccataaacactccagcaccacattcatcagaagggcactctcgacgaaagcaactaattttgccgttctcatctaccttataatatttcaggatagccagcttaaccttctttctcttgtgcttactcttcttgggagtggtgtaagacttcttccttttcttagcaccaccatgaagtctcaacacaagatgaagagtagactccttttgaatgttgtagtcagacatcttccagttgcttgccagcaaatattagtctttgccgatcaggaggaattccttccttatcctggatcttggtctttacattttctgtcgtatccgagggttcaaccttgagggtgatggttttccctgtaagggttttcacgaaaatctgcatttgcagatggcggatctttaaatttttttttgttttttgttttttgttttttgggacagagtctcgccctgtcaccctggctggagtgcagtagcatgacctcggcccactgcacctccatctcccgggttcaaatgattctcctgcctcagcctcttgagtagctgggactataggcatatgccaccacgcccagctaatttttgtgttttttggtagagatggggtttcaccatgttggccaagctggtctcgaactcctgacctcaggtaatccacccccctcggcctcccaaagtgctgggattacaggcttgagccaccgcacctggctttttttttttttttttttaatacgatggtgtctcgctatgttgctcaggctagtgtcaaaactcctaggttcaagtgatcctcctgccccagtttcccaagtacctgggactacaggtgcatgctgctgcacctcgcttttctgtttgttttgacctatgtttttcaggtaagaggttttcctcaaatgtcagataattcttagtggtccacttaaatttgaatgagacactaaaaacgtgttcaaagctctgtgaatgaggcagtaaaagtttgttttaaagctcttttatttcaagagtggaagtaaaaaatccattgacctcaggtgatcacatagtattagagacttatctgctggtatccgtaagacttttctggaatatctcagtttctccagagacatatctgtaaatctcttgcctggctgttggtgttgtggatcagaagaaggaagggaaacttggtcttatggttcagtctgcagagtttcacctaaaaccctagtcttttctgtgcctaatgttctctacctctgagtctccagttcaatttctctagagaataatcctgtagattcctgtggagacagaatagaggtctgtcatctgatcccatagagtgggggttgtgtggggacctgaggatcctaagactttcagatcacccacccaatgcttcacccccacttcccattctgcctgtgtcctcagttgctatgtattttagatcagattcttttgttttaagtgtctcactgcaggtccttatgcttgatcatcgtcccttctgctgagtaatttgtcatccttcatatattgtggtttacagttacaaatgactgctagttttactgatgatggagtttctgttttttatcctcccttgatttggggcgatacttgttttttgtttgtttgttttagttttttgttttttctgagactgagtctcgctgtgtcgcccagtatggagtgtggtggcgtgatcttggctcattgcaacctctgcctcacaggtttaagtgattccactgcctcagcctccggagtaactgggatcacaggcacgcgccaccacacccagctaatttttgtatttttagtagagacggggtttcaccatcatggccaagctggtcttgaactcctgacctcaagcaatccacctgcctcggcctcccaaagtgccgagattacaggggtgagccaccacactcagccaatctagggtgatatttgaaagaaagaaggcaacaaataccatttttaaaactgaaaacttatattaaacttaatggtaaagtaggacttttactttctcagtgaagtatttctttttctgaacagttttgtctaaactgtgacatattacctttcatttctgtgttttgataaataaacccttatgttgacaaaacaattaactgtcattaagaaaaataaccaattctaatgcttttctgttgatgggaatactgacttttattatttgttcagatttcaaagcagattgttatgtacaccttatttaaatttattccctacccactgagcaagaataggtattataggaaaactaccaatttgagaactcaaatttttatctccagtaatctagtgtaatataatttgcacgttattttttcttgtttttataggtttctttatggaatggcaaagactgaaattgctgaaaaatattaaactgtggtctttctcttcccccaggttcttttagagcaagatatatttcatcgttccttgatggcttgttgtttggaaattgtgctctttgcctatagctcacctcgtacttttccttggattattgaagttctcaacttgcaaccattttacttttataaggtgagatgaaaacaaagttctgttatgagatgaaaacagtgtttctcacagaaacattgtatttatcttagtgctgaagaaaaacactgttgtgatatctggaaagtgtttccagatgtgttctgaaaatatatattcctggctaggcatggtggctcacgcctgtaatcccagcactttgaaaggccaaggtgggaggattatctgaggtcaggagttcgagaccagcctggccaaaatggtgaaactccgtctctactaaaaataccaaaaaaaattagccaggcattgtggcgagcacctgtaatctcagctgcttgagaggctgaggcaggagaattgctttaacctgggaggtggaggtttgcagtgagcggagatcatacaattacactccagcctagacgacaggagcaaaattctgtctcaaaaaaaaaaaaaaagataatatatattcctcttgggtgaaaccaagaacacaagagagagttgagcatacagtggctcacacctataatcccagcactttggaaaactgaggctggaggatggcttgagtccaggagtttgaggttacagtgaggtatgattatgccaccacactccagcctgggcacctaagcaagaccctgtttcaaagaaaaaaaaagagagagagaaggtgagagtatcagtaaattaagtcaatcttacagcttcagttcctttgttaacacggacttgaaaatgtgacctggaactagtacttaacttcaaattttccatatttatgaatgaaaattataatcctattaaacaaatgcatgatgaagaacaaaaaacgctttctaccaagaggaaggaagacctaaaattgattttggtggtggtctaactaataaagccgtaataatagattatgcttcttccccaagtttgagctaattcagtgtgaatgaatcttacttaccttacctttatttttcttgctagaactatttttgttaatcttttcaaaataaaacagaggtcatagctattgaactacatcatcaccctcaataacgtttagtcatcacagtcaataacgtttaatgttacatagtatcgaactttaagactaatgctactgttacgcttcttggcatgatttagttaatatttagtcatctaggtacttttctactggtgatagaaaaattggtttgaagagttaaatttttatacctaaagtatgcctgaattaaagttgtagaaaatgcaggtcattggaaagcttatctgtgtgaattactgagtgtgattaaagtatttttaggtttcttagggagaagtgattctactatacactcactttaatgttaatgtgtgtattcaacttttgccattaggaaaaagtttagttttgtcaacaacctcatagtaattggtttttatttataacatccttattttattcaagcagctaaatgccttttttttcaatagagactcggtttcactatgttgcccaggctggtctcgaactcctggtctcaagcaatcctctcactgtggcctcctaaagtgctgggattacaggcatgagccactgtgtcggcctcctttgtttttttaaatgacataaatgatatgtgctcattgaagaaaatcataaacataaatgtgggccaggcacggtggctcatgcctataatcccagcactttgggaggccaaggcgggcggatcatgaggtcaggagattgagaccatcctggctaatatagtaaaaccccatctctactaaaaatacaaaaaattagccaggcatgggggcacgtgcctgtagtcccagctacccgggaggctgaggcaggagaatcgcttgaacctgggaggcagagattgcagtgagccgagatggcgccgctgcactccagcctgggtgacagagtgagactccgtctcaaaataaataaataaataaataaataaataaataaataaataagtaaataaatgtgaatattaaagtcatacatcataatctattaacaatcatattattaatattttgtgtatataaactttattctagatacttcccttataaaatggaattatagtgtatatacgcaaagtcactttaaatagttcattcattctgttattttgagttagtggaaaaaatagtctggaaaggagcaatacattcaaaatagaactagacttggaacccaagacctgacttctcccactgttggtctgttgaccagttttcacctatcgttgcctcaagttgtcatttataatataaaacgtgaaaaacagaaatatatgtgaacatattttaaagaacttaaaaactcctttataaattagaagatgttagtaagccacagaattatggttcaaagatgactttggttctgtgccacagaataaggccacagtggccgggcgcagtggctcacaactgtagtcccagcactttgggaggcctaggcgggcagatcacctgaggtcaggagttctagaccagcctagccaacatggtgaaacctcggctctactaaaaactacaaaaattagccaggtgtggtggcaggtgcctgtaatcccagctactcgggaggctgaggcaggagaatcacttgaacctgggaggcagaggttgcagtgagccaagatcacaccactgtactccagcctgggcaacagagggaaactccgtctcaaaaaaaagaagaagaagaagaaagccacagctagtcctacatgcaagtccagactagaactaactgcttgaaaccacattgccttctcactttctcctctgcaggttattgaggtggtgatccgctcagaagaggggctctcaagggacatggtgaaacacctaaacagcattgaagaacagattttggagagtttagcatggagtcacgattctgcactgtgggaggctctccaggtttctgcaaacaaagttcctacctgtgaagaagtgagtctgggcaaggctgataatcgtatcattaaaaaaaaaaaaaaaaaaaccagctttattgagagataattcctataccatagagttcacccattttaagtgtacaattcagtggttttagtatataaatagatatgtgcagccataaccacaattttagaatatagtcatcacttcaaaaagaaacctacatcctttagctatcacttccctacccccgaatcttctccctagctgtaagtaaccactaatctactttctgtctccataaatttgcctattctagacatttcatataaatggaatcataaaaatgtagtcccttttgactgggcatctgtcacttagcataatgtttttaaggttcatccatgttgtagaatgtatcggtatttcatttcctctctttttttaaggcggggtttcactcttgcccgggctggtgtgcagtggacaaagatggtgcactgactacaccctcaacttcctcggcccaaactgtccttctgcctctcaagtagctgagaccacaggcacataccaccacacccacacccggctaatttttttttctttctgtttttctttttttgagatggagtcttgctctgtcacccaggctggagagcagtggcacagtctcggctcactgcaacgtctgcctcccagttcaagcaattctctgtctcagcctcccgtgtagctgggattataggcacccaccaccacacccggctaattttttttgtactttttttagtagagacggggtttcaccatcttgtccaggctgttcttgaactcctgacctcatgctccacctgcctcagcctcccaaagtgctgggattagaggctagaggcttgagccaccgcgcctggccacacccggctaattgtgtgtgtgtgtgtgtgtgtgtgcacgcgcgcatgtgtgtgtagagacaggatcttgccatgttgcacaggctgatctcaaactcctgagctcaagcagtcctcccatctcagcctcccaaagtgctagaattgcaagtgtgagccaccacatctggctcatttccttttgttgctaagtaatattccattgtatggatgctacattttatttatccattcatcggttgataaatatttgagttgtttccaccttttgacttttttttttttttttttggagggggggggacaagatctcactctgtcacccaggctggagtgcagtggcgccatcacggctcactgcagcctcaacctcccaggcacaaatgatctccccacagccttctgagtagctgggactacaggcacacacaccacacctggctaatttttgtagtttttgtagagatgggatctccctatgttgcccaggctagtcttgaattcctgggctcaagcgatcctcccacctcagtttcccaaagtgctgggattacaggcatgagccaccacaactaaccccttttggctattatgattgatgctgctatgaacattcaggcacaagtttttgtgtgaacatatgtacatatgttttcatttttcttggagtggaattgcaggttcatatggtaactctgtttaagcttttgggaaactgtcagactgctttctaaaatggctgcaccattttattgttcctacggtcaatgtagaaagattccagtttcttcatatccttgctaatgcttgttattatctgcctttttaatcctgccattctagtaggagtgaagtaatatctcattgtggttttatttgcatttccctggtggctaatgatgatcaacatctttttatgtgcttgtaagctgtttgcatatcttctttggagaaatgtctattcagatcttttgcccattttgtaattgggttgtctttttattattgaattataggagttcttcatctattctagatacaaatcccttatcagataaatgatttgcaaaatgtttctcccattttctaggttgtcttttcactttctttttttttttttttttttgagacaaagtcttgctctgttgcccaggctggagtgcggtggcgtgatctcggctcactgcaagctccacctcccgggttcacgccattctccagcctcagcctcctgagtagctgggactacaagcacccaccaccacgcccagctaatttctttatatttgtggtagaggcagggtttcaccgtgttagccaggatggtcttccaaagtgctgggattacaggcatgagccactgcacctggcctgtcttttcactttcttgatggtgtctttgaaatgcaaaaatttttaattttgatggtgtccaattcagatattttttcttttgcttctgctttttgatatcatgtctaggaaaccattaaacttacttaaaaattttcaaatgtctgtataaagattgaacacttttcattggtggtattcagaattaaaaaataaaaaacagaggctggtgcagtggctcatgactataatcccagcactttgggaggccaaggcaagtggattgcctgaggtcaagcgttcgagaccaggctggccaatatggtgaaaccccgtctctactaaaaatacaaaaaattagctgggcatggtggcacacacccataatcccagctacttgggaggctgaggcaggagaattgcttgaacccaggaggcggaggttgcagtgagctgagatcgtgccattgcactccagcctggacaacagagcgagactgtgtctcaaaaaaaaattaaatgaataaataaataaaaattaaaaatgtgtgcccagagttgtgcacaaattacatttttaatagtagtatcgtgagaaattgtggggttttttttgtctacttctgttattcttttgtaactcgtgtcttttgattctttgttttgtctccttatgtacttcattaatcttcttgaatttttccctaatcccaaactactagaactgtccaaggccaggaggaattggaaagaagatggtttcttgaaatctctcttccatacttctttggtcttttgcagcagacagtaacttattgggccactcttcagtattcatcagtttatttccattgaagaacttcagactccttcaagttcaaaaaagctgtgaacttgaagaaggattagtattgaagccgttgctcttataacttactagttgtgtgaccttgggcaaatttcacattcagatcctcaattttctcatccctaaatggagaatgatactgcctacctcagaggtttagttcttgtggttggtaacttacctatataaattataaggttaaatgaaatgaactctttccatacgttcgttaacattaagaattgagcactttatccaagttgtattttgtgaagaagtgagaaagaaataaaatagtaaaaaaaagttaagaaaacactttttcggccaggcacagtggctcacacctgtaatcctagcactttgggaggctgaggtgggtgaatcatctgaggtcaggaattcgagatcagcctggccaacatggtgaaacctcgtctctcctaaaaatacaaaaattagccgggcatgatggcacacacctgtagtcccagctactcaggaggctgaggaaggagaattacttgaaccccgggcgttggaggttgctgtgagctgaaatcgtgccactgcattccagcctgggcaacagaatgagactttatctcaaaaaaagaaaagaaaacatttttaataagttttaatcagcaagtttatctatatgtaaatcaaagggtttttgttttctacaggttatattcccaaataactttgaaacaggaaatggaggaaatgtgcagggacatcttcccctgatgccaatgtctcctctaatgcacccaagagtcaaggaagttcgaactgacagtgggagtcttcgaagaggtaggttcaacattggtaaaggaatgaaaaagtaacaaagggcatttggctttttttcagggaaaattttaagtcttgtgagtatgttattaagaaatctaatttattcagcagggttcgaaaaggagcttgatgcttgtgccagcacccctgtgtagctcattgtacactatattatatactatagtgtattctatattaatagaattttaaatgtaatttatttaataaatatatgtaatctttcctgaatgctaatggagaactgtttaaataagctaaagtcaggcacgatggcatctttctgtagtcctagctactcagaaggctgaggcaggagtattgaggattgtgtttgaacccagcctgggcgaaatagtgagacccccctcatgtcccagaaaaaaagaaaaagaagaaaggaaaaaacaagataagtgtattagcctgttctcacactgctaataaagacatacccaaaattgggtaatttataaaggaaagaggtttgatttactcacagttccacatggctggggaggcctcacgatcatggtggaaggcaaagggaagagcaaaggcacatcttacatggcagcaggcaagagagcttgtgcaggggaactcctcttgataaaaccatcagatctcatgagacttattcactatcaggagaacagcatgggaaagacccacccccatgattcagtgacctcccacctggtccctcccatgacacgtgggaattatgggaactacagtcaagatgagatttgggtggggacacagccaaaccatatcactaagctaaatacctacttttccaaatttcccaaatttatattcttcctttgcctgtgtatgtctctgtagaaaaacatttaaagcaaaataaaatttgtattctctttggaatgcttaagttcatctaataaactagttatttttattcttaaaatagttcattttgagacttaccaatggaaagattttagttcattcttccttattttctcttgtgatgtagcgagctgatgtgtgtatcttgtggattatatagcgcttggatttttaaaaatcagttaaaatctcctgaccacatagtatcccttaacaaatcttagatgaacaagtattcaggttacatagtacggtacatccatttttggactctgtgtgattgtgtatgtgtgtttgtctgtctgcaatctttgctttacatgcaatgcaggatcataaaaatgactgcaggccaggtgcggtggctcacacctgtaatcccagcactttgggaggccaaggcaggcggatcacctgaggtcaggagtttgagaccagcctggccaacatggtgaaaccccatctctaccaaaaacacaaaaattagctgggtgtggtggcgggtgcctgtaatcccagctactcaggaggttgaggcaggagaatcacttgaacccgggaggcagaggttgcagtgagccaagatcacaccactggaccccagcctggcggacagagcgagactctgtttcagaaaaaaaaaaaaaaaaaaaaggccaggcacagtggctcattcctgtaatcccagcactttgggaggctgaggcaggtcaatcatgaggtcaggagttcaagaccagcctggccaagatggagaaaccctatctctactaaaaatacaaaaattagccaggcatggtggcaggtgcctgtaatcccagctactcgggaggctgaggcagggaatcacttgaacctgggaggcagaggttgcagtgagcaaagatcgtgccattgccctccagcctgggcgaaagagcgagtctccgacccaaaaaaaaaaaaaaaaaagattgcataaggtcaggcacagtggctcacgcctgtaatcccagcagtttgggaggccgaggcaggtggatcatctgaggtcaagagtttgagaccagcctggccaacatggtgaaaccctgtctctactaaaaatacaaaaattagccaggcatggtggtgtacacctgtaatcccagctgctcaggcagctaaggcagtagaattgcttgaacccaagggatggagtttgcagtgagcggagatcgcaccactgtactccagcctggggacagagcaagactgcatctcaaaaaaaaaaaaaaaaaaaaaacaatggccgggcgcagtggcttacacccgtaatcctagcactttgggaggccgaggcgggcagatcacgaggtcaggagttcaagaccagcccgggcaacacagtgaaaactggtccctagtaaaatacaaaaaattaggcaagcatggcagcatgcgcctatagtcccagctacttgggaggctgaggcaagagtgaggcaagagaattgcttgaacccaggaggcggaggttgcagtgagccgagattgtgccactgcactccagcctggtcgacagagtgagactccgtctccaaaaaaaaaaaacaagattgcataagatgtgaatactcagtcattttaatcagtgggaataattataattattataattgttttttgatctttacgaatcttgtcaaaatgttaaaaaaaaggctcttctttctgtcagttattaatgtttagagaaatgaaaaaatagtaaaaatatttagtatactataatttaaaacttacgaaatattgagaattattttcttttttaaaaacttagcaagaatagtttaaactgtgcttgccaccttcctctcatataatttataactaagtgagcatcttttctgtaccttgacagattgtcatgtttctaaatttggatccgctttacatttgtatattcattacattcttattgagcatccaccatagctgttccagtactgtgctaagaaaagatcatttcaatggatttgcagctaactttatggcttcaactcgagtcttgccttgaaatgtcacctttaaacatgcctagtcagattcaagggcttgcgtggatttcttagatataaggcattcacatggactcttgtaaaagagtaatggaaacaactatagaaatttgcacttgtttactgaagacaggagaagtaaaagctgctttcataagcccaagaattacggagatttttattaaactataactattttcccaatcacctcactaatacagagagcttctaaatcattgccaggggtcattttcataccttttgaacatgttttgaaaatagattacagggccaggcgcagtggctcacgcctgtaatcccagcactttgggaggccgaggcgggcagatcacgaggtcaggagatcgagaccatcctggctaacacggtgaaaccccatctctactaaaaatacaaaaaattagccgggcatggtggcggttgcctgtagttccagctactcaggaggctgaggcaggagaatggcgtgaacctgggaggcggagcttgcagtgagctgagatcataccactgcactccagcctgggcaacagagcgagactccatctcaaaaaaaaaaaaaaaaagaaaagaaaatagattacatgactatctaattatctagtgaatgtaaaaataaataatgaaggccgggcacggtggctgaagcttgtaatcccaaatgaggcaggtggatcacctgaggtcaggagttcaagaccagcctggccaacatggcaaaaccctgtctctactaaaaatagaaaaattagccaggcatggtggcacatgcctgtagtcccagctacttgggaggctgaggcaggagaatcgcttgaacccaagaggcagaggtcacagtaggccaaaatcgtgccactgcactccagcctgggtgacagagcaagactccatctcataaataaataaatacttttgttttaaaagcatattattgacctacctgtaaggaataattggttgagggaagaattgtgaaaaaagatgtagaaaagatgtagggttgtaaggggctagaaaaacccgtgcagctggtagagagggaatggaaagcagatcctgtgaaaggatagcacaggaagagaggcaaaatccataatccttactttatttttgatcaacacagtactgccaaccctcagattaaggcaaggtaagcagatttatatcatctttactcatatcttctgatagatttactaaagatgattccatatctactaaattagaaagccagagctaccgccttaaactgcttggagtgcaaatattcacaaagaggcaaaactgtgacccaaattcctgatttttgcttttgcttcccttcttctcaggtgctctctactaggtaagattgggagatattggactactactaaaatttagtgctcacttcattctacctctcaacctctactttgtccttaatgttttgctcctttaatgtaggcagaggttcaagaaaccaggaagatgagtgatcataattttcacgttttatcgtagtgacttatttcatgcctctttctcccagtagactacatattccatgagggcaaaggccatgttattcatatctagctagtgcccagcataagtaactcactatctgttgagtgaatgagtaaacctaatttattattttggaatacatttctgttttaaatttattatttttttttagatatgcaaccattgtctccaatttctgtccatgaacgctacagttctcctaccgcagggagtgctaagagaagactctttggagaggaccccccaaaggaaatgcttatggacaagatcataacagaaggaacaaaattgaaaatcgctccttcttcaagcattactgctgaaaatgtatcaattttacctggtcaaactcttctaacaatggccacagccccagtaacaggaacaacaggacataaagttacaattccattacatggtaacgttatagtgcatttgttttgtactttttctgagataaaaatttaagaaatgtcttagtggattagatcacatggtttttctaactcattattttttcttgaacctatactttttttttttaaatagatttgaattttttagagcagttgtagattcacagcaaaattcagaggaaggtacagacatttctcatagtcccccttccccaaccagaggcatataaagcctccctcattatcagtattccacaccagaatgctacatttgttacagttgatgaacctacattactgacacattacccaatgcccatagtttacattagggttcactcttggtgaatagtttattgattttgagaacgtataatgacatgtatctgtcactatagctccatacagagtagtttcactgccctataaatcctctgtgccccacctttttgttttgaacctatagtggttttttttttatttttaaattttataaatttactaccctctctgtttgtttagacttattttactttttcttttcttctttttttattttttgagacaggatctcactctgtcacccacattggagtacagcagcatgatctcatctcactgcaacctctgctcccaggctcaagtgatcgtcccacctcagcctcctgagtagctgggaccacaggcaagtgccaccactcccagctaattttttctatttgtggtacagatgaggttttaccatgttgcccaggtctcaaactacttttaaaatgttcttatctgagctttccaatatgtatgtattgagcaaaaattctgttttttgactaacagctcaagtgctcaaaatgttaaaaaaaaaaatgcttttttttccaataaatttaaactataaatgtatcccaggcaaatacaaaatagagaacaaaatttgcttttttttccataaatttaaagtataaaaacaaaaccgaatattcttgtttctagaaaataaggatttatgcggggcatggtagctttcacctgtaatcccagcactttgggagaccaaggcaagaggatcactttagcccaggagtttgagacccagactgggcaacatagcaatatcctatctctacaaaaaattaaattagctgggcatggtgatgtatgcctatggtcccagctacttaggaggctgaggcaggagaatcacttgagcccaggaatttgaggctacagtgagccatgatcacgctactgtactccagccaggacaacagagcaagacattgtcaaaaaaaaaaagaaaaagaaaaaaaaaagggggcccggggggcgccaggcacagtggctcacacctataatcccagcactttgggaggctgaggcaggtggatcacttgaggtcaggagtttgagaccagcctggccaacgtggtgaaaccccgtctctactaaaaatagagaaaaaacattagccgggtgtggtggcgcatgcctgtagtcccaactattcaggaggctgaggcaggagaattgcttgaacctgggaggcagaggtctcagtgagccaagatgaggccactgcactcccacctgggtgacagagtgagactgtctcaaaaaaaaaaaaaaaaagtccagctgcagtggctcatgcctgtaatcctagcattttgggaggccaaggcaggcagatggcttgagctgacgagttcgagactaacctgggcaacatggcaaaactcccatctctaaaaaaaaaatacaagccgggcacagtagctcactcctgtaatcccagcactttgggaggccgaggagggcagatcatgaggtcaggagatcgagaccatcctggctaacatggtgaaaccctgtgtctactaaaaatattttaaaaattagccgggtgtggtagcatgtgcctgtagttccagctactcaggaggctaaggcaggagaattgaacccgggaggcagaggttgcagtgagccgagatcacgccactgcactccagcctgggcgacagagcaagactccatctcaaaaaaaaaaaaaaaaaatttaccaggcatagtggcttgcacctgtagtctcagctatttgcgggggttgaaatgggaggatcacttgagcccaggaggtcgaggccacagtgagctgagatggcgccactgcactccagcctgagtgaccaagtgagaccctgtctcaaaaaaaaaaaaaaaaagaattcagtcataacctagaattactattttgtagccttcttatacacacagatatatgtatatataattgtcaaaatatatatagttgacaactttcctagaacatatgcagattatttctaataatgcttatacattcaggtgtcgcaaatgatgctggagagatcacactgatacctctttccatgaatacaaatcaggagtccaaagtcaagagtcctgtatcacttactgctcattcattaattggtgcttctccaaaacagaccaatctgactaaagcacaagaggtacattcaactggaataaacaggccaaagagaactgggtccttagcactattttacagaaaggtatgtgtttttatagcactttagaagaatttgtttaatcaatggaagaaagattgagtaacagagacagactttggtcttttttttttctaatatacataacacaaaatttaccattttaaccatttttaagtgtacagttcaatggtattaaatacattcacattgttgtgcagctttattactaccgtctatctccagaactttttcgtcttcccattctgaaattctgtatccatttctccctttccccagcttctggcaactactattctactttctgtttctgtgaatttgactactctaggttcttcctatgagtgaagtcatacgatatttgtttgtttttgtgactggcttagcgtaatgtcttctaggttcattcatattatagcttgtgccagaatttccttccttttcaaggctgaataatattccattgtatgaagaagagaaaaaaagaacaaaagaaaaaatattccatcatatgaatatacttttttttaataccacattttgtttattcattcatctgctgatgggcatttgggttgcttctaccttttggctattgtgagttatgctgctatgaacatttgtgtacaggtgtctgttcaaaccaggcgtggttgctcatgcctgtaaacccagcactttatgaggccgaggcaggaggatcacttgaacccaggggtttgagaccaccctgggcgacacagtgagaccctatctctattttaaaaaaaaaaaaaaaaaaaagcagccaggtatggtggcagatgcctatagtcttggctattttggaggctgaggtgggaggatcacatgagcccaggaggttgaggctacagtgagtcgagatcacaccactgcgctccagcctgggcaacagaacgaggccctgtcttaagaagaaaaaaaaatagcaacaaatatctattcaagtctctgctttcaattcctttgggtatattcccagaaatgggagagtaatttagtatttcattttctgaggaaccaccgtaccattttccacagtgggtggaccattttacattaccactagcaaggcacaagtgttccaagttcttctcatcgttgccaacgtttcgtgttttctggtttgtttgtttttttgataatggccatccaatgggtataaagagacatcttactatagtttcaattttcatttccctaatgattagtaatattgagtatcttttcatgtgcttttgcccatctatatatcttcattatagaaatgtctattcgagtcttttgcccatttttttaattatgagttttgggttttgtttttgttaaattgtaggagttctttatgtattctagatattaatctcctataaaatatactatttacaagtattttctcccattctgtgggttgccttttcattccgttgatagtgttcttgacacatgaaagtttttaatcttaataaagtcaatttattcttttcattttttgtctgtgcttttggtgtcatacacaagaaatcattgccaaatccagtattataaaacttttcccctatgttttcgtctaagagttttatagtttttagctcttatatttattatgtctatttttttttgagacagagtctcactttatcacccaggctggagtgcagtcacgcagtcacagctcactgcagcctccgcctcccaggttcagatgatcctcccacctcgaccctctgagcagctaggactacaggcatgtgccaccatgcccagctaattttcgttttttgggttttttgtttttgttttttttttttttgagacagagtctcactctgttgcccaggctggagtgcagtagcgcaatctcggctcactgcaacccctgcctcccgggttcaagcaattctcctttctcagcctcctgagtagctgggactacaggaatatgccaccacgcctggctaatttttgtatttttagtagagacgaggtttcaccgtgctggtttggctggtttcaaactactgacctcaggtgatccacccaccttggcctcccaaagtgctgggattacaggtgtgagccaccacgccgggcctgtttttgaacttttttgtagagacggggtttcaccatgttgcccaggctggtctcaactcgtgagcttaagtgatctgcccacctcagcctcccaaagtgctgggattacagccgtgagccaccacgcccagcccattttaatttttgtatatggtgttagataagggtctaaagtcattcttttgcacatggatatccatttttcccagcacgatttgttgaaagactgccctttcccattgaatgagcttagaatccttgttgaaaagtcacttgagcatagatatgggggtttaattctgggctctctattctattcattggactatatgtctatctgtattcagtaccacactgttttgataaccatagctttgtgtcataagttttaaaatcaggaggtgtgagacctccaactttgtttttctttcttaagattgttttagctatttaagatttcttgagagtctgtatgagttttaggatggatttttctctttctgcaaaaacattgtggaattttgacagagattgcattgaatatggagatcgcattggctagtgttgacatcttaagaatgtcaagtcttccagtccatgatcataggatgtcttttcatttgcgtcttctttaatttctttcagcaacattttgtagttttctgtatatgtcttttgcaagacaagtccttgcttaagattattcctaagtattctttttgatgctattgtaagtaataagtaagtagaattgtcttaatttcattttttagattgttcattaatgtaaaggaacacaagagatgttgttgtattgattttcttgcagctttgctgatttgtttattaattctatcagtttttatggattctttaggttttttgagttttccatacacaagattatgtcatctgtgaacaaagataattttacttctttctttgcaatttggatttctttttcctgccttattgctctagctaggaattcccgttctatgttgaataaaagtggtgaaagcaaacatccttgtcttactcctgatcttagaggaacacctttcaggttttcaatttgagtatgatgttaactgtgggttttttatatacagttgacccttgaacaacatgtttttgcactgtacaagtccacttatatacagatttttttcagccaacacagaatgaaaatacagtatttgagggatgtgaaacctgtgtatatagagggccatctttttgtacatggggattctacagggccaaatgcaggacttgagtatgcatacattcaggtatatgcaggggctcctggaagaaatctcctgtgtataccaagggattactgtatatcctttattatgtttaggtagtttccttctcttcctagctttttgagtatttttatcatgaaagggtgttaaattttgtcaaatgctttcctgtatcacttgaaatgattatgtggccattttccctttgtccttttaatatggtgtgttatactgaatgatttccttgttttaaattatccttaccttctaaaaataagttctacttggtcatggtgtataaccctcttcatatgctgttgaatttgttttactagtatttagttgaggatttttgcgccaatattcgtaagagatagtggtctgtattttttcttatgctttctttgtctggctttgctatcaagtaatgtacctttagccacttaaaaaatacatttgacctttcaagagaacattatgatcctggtgagctataagtttagactcaggctcacagggtttgattctgttttcagatctaacttatgttttttgccagcttgtattcttttctaactttgagtaagtagttggccagcctctggaatttactgaaactcttttgtgttatgttgccgtagaatggagttcactgtgggacaaatacatgttggatctcatgggtgaattttaattagcgaagaatcattctaaagattgctgggatactgtgagaaggctatatattttttattattattatttttagagacaaggtcttgctctgttacccaagctacagtgcagtggcatgatcatggcacactgtagccttgaactcctgggttcaagtgatcctccctctttgacctcccaaagcactgggattactgtgtgagtcaccacccaagccattatttatttatttatttttgagacagtcttactctgtctaccaagctggaatgcagtagcgtgatctcggctcactacagcttctgtctcccaggttcaagcgattcacctgcctcaccctcccaagtagctgggactataggtgtccaccaccacacctggctaatttttgtatttttagtagagacgtggtttcaccatattggccagcctggtctcaaactcctgacctcaggtgatctgcccaccacagcctcccaaagtgctgggattacaggcatgcgccaccatgcccagctgttactcataatttttattataaatctaggccaggcatggtggcttatgcctgtaatctcagtattttcagaggccaagccaggagggttacttgaggcttgcagttcaagaccagcctgggcaacatagcgagacccagtctctaccaaaaaattaaaaaattagccagcatagtggcccatgcctgtagtcccagctactcaggaggctgaagtgggaggataacatgagcccatgatttcgaggctgcagtgagctaagaaggtgctactacactccagcccaagcaacagagtaagatcccgtctccaaaactcaaaaataaataaaataaatctaatgtgttaccctttaaattagcatatgaccagttcttattataatgcctaaattattttaatattaatggaaagggactaaaaacggttgaccttagacataacttgaatttgtcctatctcttacgagcacattttgaatcatcagcttctgataagatagacatgttaatcagatatttataaccaaacatgactgcagtgcatcccacagctagatggttggctagcccattctattgcccaggttggagtacagtgactattcacaggcacagttatagcacgctagagcccaaactcctaggctcaagtgatcctctttcattaccctccgagtacctgggtctacaggcaaatttaagtgtatttctctactaatcattctttttttattattattttgagacagggtcttgctctgtcgcccagactagagtgcataggcacgatcatgtctcactgcagtctacctcccaagctcaagagatcctcctgcctcctgagtagtaggaccacaggcatgcaccaccccacccagctaaattttttttttttttggtagaaatggagtctcgctgtgtttcccaggttcatcttgaactcctgggctcaagcgatcctcccacctcagcctcccaaagtgctgggattacaacaggtgtgagccaccatgcccaactaattgttcttgtaataattttttggtttttttttgttgtttttttttgttgtttttttttaagatggagtctcactctgtcaccaggctggagtgcagtggtgcaatctcagctcactgcaacctctgactccctagttcaagcaattctctgcctcagcctcccgagtagctgggattacagggacgcaccaccatgcccagctaatttttttatttttagtagagacagggtttcaccacgttggccagaacagtctcgatctcctgacctagtgatccaccacctcagcctcccaaagtactagtattacaggtgtgagccactgcgcccagcctaataattttttttttttttgagatggagtcttgctctgtcacccaggctggagtgcagtggcacgatcttggctcactgcaacctctgccgcccgggttcaagcaattctcctgcctcagcctcctgagtagctgggattacatgtgtgtgccaccacacccggctaatttttgtatttttagtagagatgggatttcatcatcttggccaggctgatcttgaacttctgacctcgtgatccacccgtcttggcctctcaaagtgctgggattacaggcatgagccactgcgcccggcaataattttttatatgtccttttttctctatgctaaataaatcttctttaatttatactcttcctcaatcatgtttttctccattcttttgtcacttgatgtcatggaaggtctcagcccacactctgaattagataattttacattaagataaaacatgaggattattttttacatttttatatcaaatcctatttctttcacagtacctctaatgtgttttctgacctcgggcatagtgattatctatttatttcttagatttcagtttagctgtttgaaaataatagtagcttaaacaagagaatttatctttcacataaagtctgtgtaaatagtatgggactgctgtggttaccacgaccattaagaacccaggtcctggccaggtcggtggctcacgcctataatcctagcactttgggaggccaagacgggcggatcatgaggtcaggagttcgagaccatcctggctaacatggtgaaaccccatctctacttaaaatacaaaaaaattacccaggcatggtagcaggcacctgtagtcctagctactcgggaggctgaagcaggagaatggcgtgaacctgggaggcggaggttgcagtgagccgagatcacgccaccgcactccagcctgggtgacagagcaagactccatctcaaaaaaaaaaaaaacccaggtcccttcaaggtttttttggccattttcaacacaaggtttctaactcagtccatgatgactgcttcccttccagatatcatatctgcattctagccagcagaaagaaaaagagcatgcctcctcaccttcagaacctgtcctagaagttacatacaccaatgctgtttatttcccacttagtcatatagccacttgtagaatgtttttttttttctttttggagacaaggtcttgctctgtcacccgtgcaggggtgcagtggcaagatcatggctcactgcagcctcaacctcccgggctcaagcgatcctctcacctcagcctcctgagtagctgggactataggcacaggctaccacacccagcttattttttaattttttgtagagaaggggtttcgctatgttgcttaggatggtttcaaactcctggactcaaccagtccgtccacctcaccctcccaatgtgctgggattacagatgtgagccaccgtgcccaggcagaattttcaaaggggcaaatatagtctttattacaggaaggtgggtgtaaatgttaagggttctgttattgcagaagaggagacagacactggaaaacaactcatttatagcttctacaaccattctttgtcttctgttcctttcaattatagctcatttattttcattacattgtgggttttggagcaactgattctccaaggaatttcatcttttagggaaatcccttctttgaatgaaatagtcttcagaagtataaacaaaatatatgaaagcagagctgctttggttggcagttgggatggttgagggagagtcttgctcttttcaccacctttactggcttctctcctctgtcccttcaccccctcctatgcctaaggactgttttaacaacagagcttgaaaatatagcagtttccccatttacttaccatttttaattttcaaaatggcaaattattgcctctgataattaacctaagtttgacagaaataagactttttggtgaattctttattttgaatgttgttttagaatctaacatccttttcctttcatttaattataacctgctcatagattagaagctagaaaatataaaaggaactgaaatgtctgaatctataataaattcaaaataaccattcattgagtaaattataacgattatctatgctgaactcagtgtgatgctggtgttctatgcctaaatagaatttactgtgaatgttagaatcaaaagccttccagcgtatgtgtatcctgtaagcattggatcagctctgtaaaagatactttaccaagtattacttaactacatattatttttaattattctagctaggactatatatcttatcttctcctttcatgaatataaagttctagcatctttctctctgctcttaccctactatttactgagcatggctggaccagaaacaaggggagaggatgcagaaaatttgtttgctgtaaaataaatcactggtggctttggagtcaactgtttgtctctctttatattagatcactgagtagcttaaattagtttttaagctcggtttgtaggtatttttctgccaaagataattttctgtaaggggtaactttttttttccatctggaaatttaaagacatagtttgggccaggcgcagtgactcatgcctgtaatcccagcactttgggaggccgaggccagcagatcacctgagctcaggagttcgagaccaccctaggcaacatggtgaaaccccatctctactcaaatacaaaaaaaaaaaaattagccaggcgtggtggcacttgcctgtagtcccagctactcgggaggctgagacacaagcatcacttgagcccggaggtggaggttgcagtgagccaagatcatgccactgcactccaacttaggctacagagtgagactccgtctcaaaaaaaaaaaaaaaaaaatagtttgaatagaatagtctggtttaggaataccacatcacggttatcaagtcttaaaataaaaaaacaatcttgcaggatctagggccagggaattgaactgaatttattttcacaggctttaaaaaaaacaacaactttgtatcttacttattttaacattcctgtttcgttcccattgtgctcctaaaaagtgtagaatataggagcaattttttaaatggttttgctttctgactcatttttggagtcaaatatttcatttattatttggcatgttagaccccctagcaattttacctgaacccaaagagaatagacagagacttctgagctttgaaaaattatgcattcgagccgggcacagtggctcacacctgtaatcccagtactttgggaggctgcagtgcatggattacttgaggtcaagagttaaagaccagcctggccaacatgatgaagccctgtctctactaaaaatacaaaaatttagctaggcgtggtggcatgcacctgtaagcccagttactcgggaggctgaggcaggagaattgcttgaatgcagaaggcagaggttgcagtgagccaagattgtgccactgcactccagcctgggtgacagagcgagaatccacctaagaaaaaaaaaaaaggaaaaattatatgttcataattgtcatgatgcaggtaaatcctatatttcattttttcttactttacatagttggcagcatagagtaatagatgacatctttaaaaaattttttcaagtagttttgctttaatctatatcctcctgccatagcagtgaactagtgctatagaacagaaattttatttaatttagtatatcaacagcctatgttttttaatcttggtcttggtaagacataaaaatttgagaaatgatttacttggtgttttgcatcaatgtgttaccttctattttaggtctatcatttggcaagtgtacgcttacgtgatctatgtctaaaactggatgtttcaaatgagttacgaaggaagatatggacgtgttttgaattcactttagttcactgtcctgatctaatgaaagacaggcatttggatcagctcctcctttgtgccttttatatcatggcaaaggtaatgtataaattgggagaagaggctgggcatggtggctcacacgtataatcctagcactttcggaggtcaaggtgagcagatagcttgagcccaggatttcgagaccagcttgggcaacatggtgaaacctcatctctataaaaaatataaaaatcagctgggcattgtggcttgcacctataggcccagctacttgggagactgaggtgggaggatctcttgagcccaggaggccaaggctgcagtgagccgagatcatgacactgtacctcagcctgggcaatagagcaagaccctgtctcaagaaaaataaaagtttctgtaccatatcgcatattgctttctcgtgatttattgtgctgcctcagaagagcattttactttctagttgctacaacgtgttttaagtcatggaataacatatcttgcttgttttttaaaattctcatatatctgatacaatcatttgtcttgactgtactggccacactggcagtcctagcagatgtatacagttaagacttgatttttcagctttttgagacagagcatatgtttttaaactcctttgtgacccctcctcccacaatgcctctttgaaatctctgtaaaaaataggtcttaataattgttactgcagcactatggtggttgacgagaaaatgcaccatacaaaaggcaacaaaaagggagcaaagaagaaaatggttgattcattttttaagaaagattggtttgatgtaaaaaagcaccgactatgttcaatacaagaaatactggaaagacactagttaccaggactcaaggaaccaaattgcatctgatagcttcaagagtcatgtgtttgaagtgtatcttgctgatttgcagaatgatgaagttgcagttagaaaactcaacctgaagggccgggcgcaggctcatgcctgtaatcccagcactttgggaggccaaggcaggcagatcacgaggtcaggagatcaagaccatcctggctaacacagtgaaacgctgtctctactaaaaatacaaaaattagctgggcatggtggcacgcgcctgtagtcctagctactcgggaggctgaggcaggagaatcacttgaaaccgggaggcagaggttgcagtgagccaagatcatgccactgcactccagcctggatgacagactgagactctatctcaaaaaaaaaaaaaagaattaaaaaattaaaagataaatgttactaactaatcgtgtgttttccagaagactgttagagttcaggctttgccatttctagctcatcattatagagaacaggtttagcactaatggacagtgaagcaggggaaaagagtgacttaagtgaagtttatgatcacagagatcccagaaggaattcctttttggatcactaatccattttcttccttttggccaccactgtgacttctgtctaagcattagaaaccctacagtctgtcctgaaatgttaaaacctaatcctgtaatagccactcagtttgattgagaatcatcactgtaagatatttttaatccttcgtatgtggttaatttacttttaagtaagtacttaaaaattaataaaactggagactgcagggaattaaacagatctgagttttcttatatctttttttatataaagaaatggattttcagtagagtcacaccatagcagtttcactgctttttgattaatgaaactattaagtgagtccccacaggccacaaagcctgaactttaaaggtagaaaaaatcataaatgttagtggtttttagtcatggactggcctggggttaatggttttctgcaaggttgctctcagtgccaacttataattgaagttttgttcagagccatttttctttcaaaaagcagttgataaatgcggtttttattttccttaggtaacaaaagaagaaagaacttttcaagaaattatgaaaagttataggaatcagccccaagctaatagtcacgtgagttacattatttttcctactgtccaaaaatagatttactcttttccactgacaagttatataaaaggtaaacttattttatagttttaatatacttcagattttctgttttaatggataacattaaactcaagagataatttcattgaaggacagtttcaatagaagccaggaagtctgactgtttccgactcatccatatactttcatatacttctcataagttctgccattccatttgttcatttaatgaaagatatgtataatggctgggtgcggtgtctcacgcctgtaatcccagcactttgggaggtggaggcaggtggattacctgaggtcaggagttcgagaccagcctggccaatatggtaaaaccctgtctctactaaaaatacaaaaattagccaggcgtggtgtcacacgcctataatccctgctactcgggaggctgaggcaggagaattgattgagcccaggaggcagaggttgcggtgagccaagagcattccactgcactccagcctggccgacagagcgagactctgtctcaaaaaaaaaaaaaaaaaagttatgtataataataataatattctttaattatatgactttattttttaatgatatttaaacccagtgaaatttgaggattcattaacctaactacagcttcttttgccatctgctaagcatcctaatgtttgcatctttgaatagatgttaaacatttctgattatattgttctgaccgtggtgaaaattccatgaaacctttcagtcatggtagcagagtggactggcacacaataagcatttaatgaatgttcatgtcatattgttgttattattgtacctgaagaacacaagtaaattaccttaagggtttgatcattcaagaacctagttgctctgctcttaggaagcataatggcctcttctctggccctggaaattgtagacagaaagagagaggtagtggcctagactgcagaccaaaatagagatgtggcctcagtattagtagttatatccccttctaagagagctttgtttaagccctaaaatacattatagcaagcaatatagagacatttgaagaaccaagtacaggtatttgttatatcctgtgataagctaagagtttctgggcttcttcaggaaaatccctcaggaacagagcctagaaagctctagattgtccttgaagatcattaaggtgaggttagtgtgagtcaagaatgggccaagccatggttccctgaatatcttcttaataccagtaacctataatacagtacaagggggaatggatcatgcctttccagctatctcagaggtgagaaatagtttaggggcagggaagggaaaagattttcatgtggccatctgaaaggagatgggaatgggctgggggcagaaaaacaagctgcattaagaacaaatgactctggtccaggcgcagtggctcacgcctgtaatcccaccagttaaggaggccaaggcagacagattgcctgagcccaggaggtcaaggctacagtgagccatgattgtgccactgcactccagtctgagccatagagtgagaccctgtctctaaaaaaaaaaagaaaaaaaagaccaattgattgttgtgtaaggaattaagaagaaggaggaattaattcaggtcttttgttttttgtttgtttgttttattttgttttgtatttgagcagagtcttgctctgttgtccaggctggagtgcagtggtgcgatctcagctcaatgcaacctccacccactgagttcaagcagttctgcctcagcctccctagtagctggaattacaactgtgcgctaccacacccagataatttttgtatttttagtagagatgggctttcaccatgttggccagctggtcttgaacgcctggcctcaagtgatccacccacctcagcctcccaaagtgctgggattacaggtgtgagccactgcacctgaccaaattcaggtctttaaagttgctttcatttagtaaaacctgatcatcagtctttagttgctatttcttctgttttataaactaagcccatcttagatggtaggctcttctccagtatcccctcttttatggtatgtgttataatctatacttactagagctaataacattttacccttgagtatcacttatacagacaaatagtttttaattggtttgatattttgctcttctcactttgattttgtttaacctgtacctctgtgactgagctgtccttttcttcccctctggcatgtaggtatatagaagtgttctgctgaaaagtattccaagagaagttgtggcatataataaaaatataaatgatgactttgaaatgatagattgtggtaagttatccaatttaacatattatatgtaaaacacattggatcacactgtacataatacagtgggtgtcagacaacatggaaatgtgaatcataaggaggtgaggtggacaatgcatatgttttgaaaacaaataagtttgagattagaatgtgctggtatagtttattgaaaccattaatttgtcccctgttaattgtgttttggaagaagttttctagtctacttatacatgttaatgaaacacgtaaaagagacttaataaaattctaaaatctgaatgacagggaaaacaaggtagctgacagtaatcttcccgaggagtctgttaagaaaatgtcccggctgggcatggtggctcacacctgtaattccagcactttgggaggccaaggcgggtggatcacgagttcaagagatcaaggccatcctggccaacatggtgaaaccccatctctacttaaaaaaaaaatacaaaaattagctaggtgtggtggtatacgcctgtagtcccagctactcaggagcctgaggcaggagaatcgcttgaaaccaggaggcggaggttgcagtgagctgagatcacgccactgcactccagcctggcggcaaagtgagactctgtcacacacacacacacacacacacacacacacaagaaaatgtcctgttcatataagtattacttataggtaattctgctaccacaggcaagactgcaccctcttgccaccatcatgctaagacttcaggcactagtaatctttttttttcaaagaaagaaaaatcaaatggttagtattcatacacctcttctgcctacctcctttcccttgtctcatctttccatgtatttcaggtgtatgtaatatatacatgtgtatatactatgattttttttttttgagatagggttttgttctgtcacctacactgaagtgcagtggtatgatcatgactcactgcagcatggacatcccaggctcaatcaatccttccacctcagcctcccgagtagctggaactgcaggcatgcaccatcaccctggcgaatttttatattttttgtagagacgggattttgccatgtttgctcaggctggtctcgaaatcgtgagctcaagtgatccgcccaccttggcctcccaaagtactaggattacaggcatgagccactgtgctaagcctaggtactgtgatttctttaatgccacagtgtgagacatttaggtcatttctccttttcttgtctcgtcttgtctcgtctcgtctcgtcttctctcctctcccctctcctctcctctcctttcctctcttcttcccatccccatccccctcctctccccctcccctgccctcctttctcttttattttttcttttcttttcttttctgagacaggatcttactctgttacccaggcaggcatgcagtggcacaatcatggctcactgcagccctgacctccggtgctcctttcatctcagtcttgtgccacacccaactaattttttgtagaggtgggattttgccatgttgcccaggctggtctccaactcctgggctcaagcagtctccctaccatggcctcccaaagtgctgggatgacaggtgtaagccaccatgcctggccaggttgcttctaattatgcacagctctgtgatgagcatcatttgtagcttaatctttaggccacatccttaggataaattcttaagagaaaatctgatgaattaaagcaaatttttaaattataaaaatatccataatcattatggtgtccactgggatataaacttttaagatttcattcaccaaaaagatcttttaataatgtcctagaatctgactccgtttgaggataataggccaaactcaattctttttacataagtgtattattctggagccttttcaaggcaacgaggagtatataagacagtaaccctagccgggtgtggtggctcacacctgtaatcccagcactttgggaggccaaggtgggtggatcatctgaggtcaggagttcgagaccagcctggccaacatggcgaaaccttgtctctactaaaaatacaaaaattagctgggcatggtggtgagcacctgtaatcccagctacttaggaggctgaggcacaagaattgcttgaacccaggaggcagaggttgcagtgagccaagatcacaccactgcactccagcctgggtgacagcgtgagactccatctcaagaaaaaaaaaaaaaaaaaaaaaccgctgggcacggtggctcacgcctgtaatccagtactttgggaggccgaggcgggtggatcacaaaatcaggagttcaagaccagcctggccaagatggtgaaacccgtctctactaaaactacaaaaattaccaggtgcagtggcagacacctgtaatcccagctactcaggaggctgaggcaggagaatcacttgaacttgggcggcagaggttgcagtgagccaagatcctgccactgcactccagtctgggcgacagagctagactctatctcaaaaaaacaaacaagcccgggtgcggtggctcacgcctgtaatcccagcactttgggaggccgaggcaggtggatcatgaggtcaggagatccagaccatcctggctaacacggtgaaacctcgtctccactaaaaatacaaaaaattctccgggcgtggtggcgggcgcctgtagtcccagctgctccagaggctgaggtaggagaagggcatgagcccaggaggtggagcttgcagtgagcggagatcgcgccactgcactctaccctgggcgacagagtgagactccatctcaaaaaaaaaaaacaacaacaaaaaaagccattttctatatttgttatacatgttgcttacctatccagggtggtttttctgttcctacaaaaccagacatcagaggttagctagaaagctgtggatcacttgcctgttttgtgttttttctatgagaaactaactgctagcaagtatctgagctacaagagcagtgaagttccagagagtagaagtaagcaaaagataatagacgatgtcgttttctgttttgttttctttttgataagtatctgccaaagaaacttgggtgactgagagtttgccacttcctgtatatataggtttcagatcaaattctgctacacaatttctttctttctttcttttttttttttttttttttgagatacagtctcactcttgttgcccaggctggagtgcaatggtgcgatctcggctcactgcaacctccgcctcccaggttcaagtgattctcctgcctcagcctcccgagtagctgggattacaggcacctgccaccaggcccagctaatttttgtatttttagtagagatggggttttgctatgttggccaggctggtcttgaactcctgatctcaggtattccacccgccttggcctcccaaagtgctgggattacaggcgtcagccactgcacctgaccttttgtttgtttgttttgagaccatgtcttgctctgtcacccaggctggagtacagtggcacagtcacagctcactgcagccttgacctcccaggcccgagtgattctcgactcagccacgtcctggctaatttttatattttttgtagagatggggtttcaccatgttgccaaggccagtcttgaactcctgggttcaagtgatccatctgccttggcctcccaaagtgctgggattacaggcgtgagtcaccgcacactgccttacatacggttattaactagatatatttattagcaagtaagcaaacaaccattgttacagatcctgtacagtggtggtggcacagggcagggagaatatccagtgataatgaactcaggaattctggcactcaaaaagagagaacacagtggcttacatctacaatcccagcactttgggaggccaagccaggagggtggcttgaacccaggagttcaagaccattgtgggtaacatagtgacagcctattgctacaaaaaattttttaaaatagccacacatggtggtgggcttctgtagtccaagctactcaggaggctgaattgggaggttggcttgagcccaggatgtcaaggctgcagtgagccatgatcttgccgctgtactccagacagagcaagaccctgtctcaaaaaaaaaaaaaaaaaagagagaaagttatgtaggaggatatacagtcagacaagtctatattcagataagtcaccttccagttcttagagctatggttagatgctatgacccagatttggacacaccaaagaacaccaacttgggaaaaacagttctggttctataaacaaattcattatgagttgtaaaataattactgtttaaaaagcacacacacaatttatatatcctatgcagtaagttcatatatcccagttctatgtctgaccagcacccatagaaaagatttgctcaagaacaggtgccaagatttcagatgcaggattcagtcaaccttaaggctaccatcaagcaaataccgtggatcagaattcagggctggacacaggacttctcagagcttttagccttaacattattatccctaagagtaaagctgagagacttcactggatctttcatccctttcatggctattgagggtagtgtctcaaattttttttttttttttttttattgatcattcttgggtgtttctcgcagagggagatttggcagggtcataggacaatagtggagggaaggtcagcagataaacaagtgaacaaaggtctctggttttcctaggcagaggaccctgcggccttccgcagtgtttgtgtcccggggtacttgagattagggagtggtgatgacttttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaataatttttcttagtacagaacaaaatgagaagtctcccatgtctacctctttctacacagacacggcaaccatccgatttctcaaatcttttccccacctttcccccctttctattccacaaaaccgccattctcatcatggcctgttctcaatgagctgttgggtacacctcccagacggggtggtggccgggcagaggggctcctcacttcccggtaggggcagcagggcagaggcgcccctcacctccccaacggggtgactggccgggcggggggctgacccccccacctccctcccggacggggcggctggctggcgggggggctgaaccccccacctccctcccggacggggcggctggccgggcagaggggctcctcacttcccagtaggggcggccaggcagaggcgcccctcacctccctgacggggtggctggccgggcagggggctgacccccccacctccctcccggactgggtggctggccaggcggggggctgacccccccacctccctcccggacggggcggctggcctggcgggggttgacccccacctccctcccggacggggtggctgccgggcggagacgctcctcacttcccagacggggtggctgctgggcggaggggctcctcacttctcagacggggcggctgggcagagacgctcctcacctcccagacggggtcgcggccgggtagaggcgctcctcacatcccagacggggcggcggggcagaggcgctccccacatctcagacgatgggcggccgggcagagacgctcctcacttcgtagatgggatggcggccgggaagaggcgctcctcacttcctagatgggatggcggccgggcagagatgctcctcattttccagactgggcagccaggcagaggggctcctcacatcccagacgatgggcggccaggcagagacgctcctcacttcccagacggggtggcggccgggcagaggctgcaatctcggcactttgggaggccaaggccaggcggctgggaggtggaggttgtagcgagccgagatcacgccactgcactccagcctgggcaccattgagcactgagtgaaccagactccgtctgcaatcccggcacctcggcaggccgaggctggcggatcactcgcggttaggagctggagaccggcccagccaacacagcgaaaccccgtctccaccaaaaaaatacgaaaaccagtcaggcgtgacagcgcgcgcctgcaatcgcaggcactgggcaggctgaggcagggaggttgcagtgagccgagatggcagcagtacagtccagcttcggctcggcatcagagggagaccgtggaaagagagggagagggagaccgtggggagagggagtgggagagggagtcaaatattttaaccaatctgcttatcttaaatacttttgatttcctgaacatgagctcatttttagcattagtcacacttaataaacattcattattttcatcagtaaaaacccatttctggctgtacatggtggctcacacctgtaatcccagcactttgggagaccgaggcgggcagatcacttgaggtcaggagtttgagaccagtcttgccgacatggtgaaaccccatctttactaaaaatacaaaaattagccaggcatggtggtaagcacttgtaatccctgccacttcggaggctgaggcaagagaattgcttgaaccctgggggctgaggttgcagtgagctgagattgtgccactgcactccagcctaggcaacagagcaagactctttctcaaaaaaaaaaaaaaaaaaattctgaccttgagtatgttaatgagcaaagcattggtcattgactgagatatgcctagcagaaactgttggagtggagaatgaatttcctgattaaaacaccagctcactcctcatgggctgtgaattcttcaatgtcatgttagcagactgctccagagtggcagtcttgattagaatacttgtgagacccaggttatagcttaacctaagtaacacaaacataacactgtactcaagtgtattgtagttaattgaaaactttacattgcttccttagaaacttgttttaaggattaaaaagaattatatttaggctgagtgttgtggctcatgcctgtaatcccagcactttggaaggctgaggcaggaggatcccttgagcccggaaattaaagaccagcatgagcaacacagcaagacccctgtctgcaaaaaatgaaaataaaaaattagctgggcatggtggctcacacctgtagtcccaactacttgggaggctgaggcaggaagatcacttgaatccaggaatttgagattggagtgcactatgattgcaccactgcacttcagcctgggtgatagagcaagatcttgtctctaaaaataaaaaagataattatatgtatatgtatgtatgtgtggacacacacacacacacacacacacacacatagtcatgtgccatataatgatgtttgagtccgtgatggtccacacatacaacagtggtcctataagattatagtgctgtatttttactgtaccttttctatgtttagatatatttagatgcacaaatacttgccattgtgatacaattgcctgtggtattcaatacagtaacatgctgtacaggtttgtaccttaggagcaatatactataccatccagcctaggtgtgtagttggccatacaatctaggtttgtgtaagtatattctatagtattctcatgacaaaatcatttcaacaatgcatttctgagaagataacccatcattatgcaatacacaactatgtatacatatatgcatatatataatatttaatacagggcttgttcatagtaaggccttagtaatagctattatttataagcaatatcaaatttattgtattaatgagtatggcttttttagcattagtcacacttaataaacattcactattttcatcagtaaaaacccatttctggccggacatggtggctcacacctgtaatcccagcactttgggagaccgagatggggtctcactgtgttgcccagactggtcttgaactcttgggctcaagtgatcctcccacctcagcctcccaaagtgctggaattacaggcatgagccaccatacccggccaagtatgtttttttaaatgtcttttttttcttcagtttttttttaattttagagatgagatcttgctctgttgcccaggctggaatgtaatggggcaatcatagctcactgcaaccttgatttcctgggttcaagcgatcctgtcatctcagcctcccaagtagctagggctaaaggtgcatgccaccacacctagtttttaaatttctttaatttttaaaaaaatttttatagagacagggtttcaccacacccagcctcccacaattttaaatgtttggttcattcaagtaaagtatagctccttaccttatgttagtattaacagctggaattggaatgacacagaaatatagagacactatagtctctgtctcaagaaatttctaatctaaggaggacattaaataattttagaccaggcgtgttcgctcatgtctgtaatcccagcactttgagaggccaaggtgggaggatcacttgagcccaggagttagagaccagcctagaaaacatagggagaccctgtctctacaaaaagtaaaaaaaaattagctcggtgtggcagcgtgcacctgtagtcccagctactcgggagactgaggcaagaggatcaagaacctttcataaaaacaaaacaaaaaaataattttaattgatccatataatgagaataacctagaagagctgttaacaagccagtatcctttgaaacagtgtttcccagaatggtagtataagtgttttggggggtccaggcgcagtggctcacgcctgtaatcccagcactttgggaggccaaggcgggcagatcacctgaggtcaggagttcgagaccagcctttccagctggcgaaacaccatctctactgaaaatacaaaaattagccagacgtggtggcatgcttctgtaatcccagctacccaggaggctgaggcaggagagtcgctggatcccagcgggcagagactgcagtgagccgagattgcaccactgcactccaggctgggtgacagagcaagactccgtctcaaaaaaaaaaaaagtgttttgggggaagagagactatacacaaaaaactggggaagtatggaattaaagtgaacatgagagttattttttttccccaactgcagtacttctcagagccttatactaacatgaatttctgaatttccaatataatatacagcatttcctcaactttatttaaccacatagctcccctcccctcccaccctcgtcaagatcctttagaaatagcagaagtgaaaaagacatccaaattaagactgacatcccctggggctgtttggtttttgaaccatgtttgtgttttctggttttcctaaggtgaaggcattgcttctacccatgttctcaatgtttgtaggccagtgtattgagaatgagagcttttttcatatatgtgctaaattctttttaattggtagtggttttcttagcacatggttcttgtgtatacaagtaaatgatagtttgtaataccctgtaatactcttccttccccaaaaaatagtaggacaaagttctgcctggtttcacaagctatcccagagttgcaccattaagtaggaaactatgttggggtaagctgttattttacaattgagggtgctcagtaaaacctgaacactggttcctgatcagggttcctgttgtatgtggtacaataaggctcttagaacacctgtcacctgccatgtatttgcagagaaataaatgtaattcattttgcttcttccttaacctctcaggatatgctttaccttttagaatctttccacctttctcaaagacacaagaagaatatctgcaggccttttagttgtctgaagctgaggtttgccactgcctcccatactgtagaacttagctaaacaccagcccagggctgttacccctctaagagccactagtgacagtgagctcaacagctatggttgtgaaaacattctgaagtggaatctagagaaaagagcaccaccttcagttcatatgtttgcatttctctagattccaatttgacttataagtaatacagatggattgctgaaccttctctgaaaatattaatttctctacataaagatttgtgggttttttttaatattgtagaaaggtcatttaaatcaccaacttgtatattaaagtatgctttgtggctgggcatggtggctcatgcctgtaatcccagcactttgagaggctgaggctggtggatcacttgagcccaggagttggaaaccatcctgggcaacatggcaaaaccccgtctctactaaaaataaaaaatagccaggcatggtggcacgtgcctgtggtcccagctactcaggaggctgagatgggaggatcacttgaatccaggaggtcagggctgcagtgagccaagattgcaccactgcactccaccctgggtgacaaagtgagaccctgtctcaaaaaaataaaaagtatgctttgtatcacaacattgcattctttttaacagacttagaagatgctacaaaaacacctgactgttccagtggaccagtgaaagaggaaagaggtgatcttataaaattttacaatacaatatatgtaggaagagtgaagtcatttgcactgaaatacgacttggcgaatcaggaccatatggtatgttctatgttttactactttattattatttgctgtcatagttggattactataagtttattttgctagataaatatgtccaagtaaaattactagcaattaatcagagcatgtccagtaacttaatcagtgattaaggctatggtacaacagagaccagaggaaatcatgggatctgttgcccaggctagagtgcagtggcgagatctgggctcactgcaacccttgcttccaggcctcaagcgatcctcccaccccagcctcccaaatagctggtacgacagccacatgcccccacgcctagctaatttttttgtatttttagtagatacggggtttcaccatgttggccaggctggtcttgaactcctggactcaagcaatctacccacctcagcctcctaaagtgatgggatcacaggtgtgaaccaccacgcctggcatgaattttatctataccatgattatgttgctagaaattccgtatacatatgggtaagaacttgatgggaacatgaatattaaaacaactaatttgttttttttgttttctttttttttttttttttgagacagtctcaccctgtcacccaggctggcgtgcagtggtgcgatctcagctcaactgcaacctctgcctcccgggctcaagtgattctcctgcctcagcctccctagtagctaggattacaggagtgtgtcaccacacctggctaattttttgtatctttagtagagacagggtttcaccatgttggccaggctggtcttgaactcctgaccttgtgatccgcccacctcggcctcccagagtgctgggattacaggcatgagccactgcacccagcaaatttggtaaatttttctgttgttatattgtgagattaatgtttttctcaagtcaaagacaaaaggggccaggtgtggtggctcatgcctgtaatctcagcactttgggaggcctaggcgggcggatcaccagaggtcaggagtttgagaccagcctggccaacatggtgaaatcccatctctaccaaaaattagctgggcgtggtggcaggcacctgtaatcccagctactcgggaggctgaggcaggagaatcacttgaacccagaaagcggaggttgcagtgagcagagatcgcgccactgcactccagcctgggtgacaagagggaaactctgtctcaaaaaaaaaacaaaaggaggtcaggtgctgtggctcatgcctgtaatcccagcactttgggaagctaagcctggaggattgcttgagcccagaaatttgagaccagcctagaaacacaggaagaccctgtctcttaaaaaaaaaaactaaaaactagccgtgtagtggctggtacacacctttagtcccaactactcagcaagctaaggtaggtggatcgcttgggcccaggaggtcaaggctgcaatgagccacaatcgcaccaccacactccagtctgggcaacagagcaagaccctgcctcaaaaaaaaaaaaaaaaaaagaaagaaaaaaaaaaaagaaaagaaggccctagcagaagctgcagccggacagccaatagctgtttctatgtatctatgtgcctctgtagatttctgttcttcctcttttcatggaatatggtctatgactatcctcagaggtcataactgttcatcctgcttcagtttcacttcccctctgtcatgtgctatactcggaatatctctaccatcttaatttatttccattatacaggatattaaaaatgaaatccttgctcatccaacttatttataaatcttttccatttccatatgaagtctttcccatttcattaacagattttttccacgttggaatcatcctgctggctaatagaattctctgcctcttttattctctctgctactgctttggttgtgagcaggtatgtgtgtagagagagcttgttacagcaagtgttagaagattggttactctttgtccctactttttttttttttttttgagaaggagtctcgctctgttgcccaggctggagtgcaagtggcacaatctcagctcactgcaacctctgcctcctgggttcaggcaattctgtaactcagcctcctgagtagctggcattacaggcgcctgtcaccacgcccagctgattttcgtatttttagtagagacagagtttcaccatcttggccaggctggtcttgaactcctgacctcatgatccacccgcctcagcctcccaaagtgttgggattacaggcatgagccaccgcgcccagcctgtccttactttttaagcatgaatatgaggttctcatgctcgtggcttaactcctggtgtcttgtccagaattttttttttcttttgagacagagtctcactctgtcaccccaggaggagtgcagtgacataatcgcagctcactgcagcctctgtccccgggttcaaacaactgtcatgctcagcctcccgagtggcagggactataggcgcacgccaccacacctggctaatttttatatttttaggagctactcaggaggctgaagtggggtttcaccatgttggccaggctggtctccaattcctggcctcaagtgatccgagcaccttggcctcccaaagtgctgggattataggagtgagccactgcacccggccccagaattcttttttttttttttttttttttgaggcagagtcttggtctgtcacccaggatggagtgcagtggcacaatctgggctcactgcaacacctctgcctcctgggttcaagcaattctagtgcctcagcctcccaaatagctcggattacaggcatatgccaccacgcccagctaatttttgcatttttagtggagacggagtttcaccatgttggccaggctggtctcaaactcctgacctcaggtgatccgcccatctcagcctcccaaagtgctggcattacaggtgtgagccactgtgcctggccagaattcttaatactagttataggacttcctgaaagatccaggaaaataggccgggcatagtggctcacacctgtaatcccagcactttgggaggccaaggtgggtggatcacctgaggtcaggagttcgagaccagcctggccaacatggtcatctctattaaaaatacaaaattaaccgggcgtggtggcacatgcctgtaatcccagcacatgcctgtaatcccagctacttgggaggctgagggaggagaattgcttgaacctgggaggcagaggttgcagtgagcctagattgcgccatcgcactccagcctgggcaacaagagcaagagatactccatctcaaaaaaaaaaaaagattcaggaaaataaattctagtttatctattgttgttaaaaaaaaaaaagaagaagtaaaggatcattttttttctcaaccataaatgagctttttacagtataactgttttctaactagaagataccataagaataaaaatatgggattcaaaaacaaagaaaaacttttatctaaaaaatctgacttttgggttattttagatggatgctccaccactctctccttttccacatattaaacaacagccaggctcaccacgccgcatttcccagcagcactccatttatatttccccgcacaagaatgggtcaggccttacaccaagaagcgctctgctgtacaagttcaatggcagcccttctaaggtaaggtgaataggctaaaagttggatttcagattaacagtcagtaactgttaatcctgcctctttttttttttttcttttttggccaagttactactatactaataaaatatgaaatgttaactatggcatgtctcctctcatcaagagcagtatattcagtttgaggtagtttaatccattattattgacatggtatttgtggagttcactttgaaagtccagcatgttttcctgttcaagcaagatcttgagaagggaccagtaaggcaacacctgcaagtggtcagacctgggggatgtcaagttgaaagaaaggcattggaagtgaaagtgcatttggtagatggcacccaggataggaagatgtctgaaaacacaagcctcctcttacgtacatagacaactctgtgatcatctccatccttatccttgttcagtggtgaagatgtggtatggacatgattgctgttttcagagacttcatggactatcaagcagatatgttcagtatgtctccagaagtcagaatcagtataaactggaagaaattgtagtggggcagattgtaactctgtccaaatacagtggctccttcttattactttcctattcagttatacagataactacagagttcctactatacttgacaaagttggctaagataatatacctgactggacacagtgactcaagcctgtaatcctagcactttgggaggccaaggcgggcagattgcctgagctcaggagttcaagaccagcctgggcaacatggtgaaaccccgtctttactaaaaatacaaaaaattagccaggcatggtggtgcgcacctataatctcagctactctgctgtggaggctgaggcaggagaatcacttgaacccggcaggcggaggttgcagtgagccgagatcacccctttgcactccagcctgggcgacagaacgagactctgtctcaaaaaaaaaaaatgttgaaaatcattactctaaggaagaagatctcaaactgtagggagctttaaaatcattgggagggcttgttaaaacagattagggccgggcacggtggctcatgcctgtaatcccagcactttgggaggccgaggcaggcagatcacgagatcaggagttcaagaccagcctggccaacatggtgaaaccccgtctctaaaaatacaaaaattagccgggcatggtggtgggcacctgtaatcccagctacttgggaggctgaggcaggagaatcgcttgaacccaggaggcagaggttgcagtgagccgagatcgtgccattgcactccagcctgggcgacaagagcaagacttagtctcaaaaaaaaaaaaaaaaaaaaaaaacagataaggctaggcacggtggctcacacctgtaattctagcattttgggagcccaaggtgggggaacacttgaggccaggagttcaagaccagcctggccaacatggcaaaaccctgtctctactaaaaagacaaaaaaatagccaggcatggtggcatgtgcctgtagtcccagctagggaggctgaggcaggagaatagcttgagcccaggaggcagagcttgcagtgagccaagatcatgccctgcactccagcctgggcaacagagagagactgtctcaaaaaataaaaaattctagatgcttctgctgcttctggtctgggtactacacatcgagagctactgttatacagtaaattcagttgttttggtttggattggtttggtttgttttttttttttttttttttttttattgttctgcaacctgctattttaattcaactctacctcatggacatcttttcacagatttagactcttagttcacagggtaggaaagcacaaaggccataggactcttgcataatgggaagcttatttttctttttttttttttttccattttttttcttttttattgatcattcttgggtgtttctcgcagagggggatttggcagggtcacaggacaatagtggagggaaggtcagcagataagtgaacaaaggtctctggttttcctaggcagaggaccctgcagccttccgcagtgtttgtgtccctgggtacttgagattagggagtggtgatgactcttaacgagcatgctgccttcaagcatctgtttaacaaagcacatcttgcaccacccttaatccattcaaccctgagtggacatagcacatgtttcagagagcacagggttgggggtaaggtcacagatcaacaggatcccaaggcagaagaatttttcttagtacagaacaaaatgaaaagtctcccatgtctacctctttctacacagacatggcaaccatccgatttctcaatcttttccccacctttcccccctttctattccacaaaaccgccattgtcatcatggccggttctcaatgagctgttgagtacacctcccagacggggtggtggccgggcagaggggctcctcacttcccagtaggggcggccgggcaggggcggccgggcagaggcgcccctcacctcccggacggggcggctggccgggcggggggctgacccccccgcctccctccgggacagggcgactggccaggcggggggctgacctccccgcctccctcccggatggggcggctggccgggtggggggctgaccccccccacctccctcccggatggggcggctggccaggcagaggggctcctctcttcccagtaggggcggccgggcagaggcgcccctcacctcccggatggggcggctggccgggcggggggctgacccccccacctccctcctggacggggcggctggccgggcagaggggctcctcacgtcccagtaggggcggccaggcagaggcgcccctcacctcccggacggggcggctggccgggcggggggctgacccccccgcctccctcctggacggggcggctggccgggcggggggctgacctccccgcctccctcccggacggggcggctggccgggcagaggggctcctctcttcccagtaggggcggccgggcagaggcgcccctcacctcccggatgtggcggctggccgggcccggggctgacccccccacatccttcctggacggggcggctggccgggcagaggggctcctcacttcccagtaggggcggccgggcagaggcgcccctcacctcccggacggggcggctggccgggcgggggggctgaccccccccacctccctcccggacgggcagctggctgggcagagggatgacccccccacctccctcctggatggggcggctggccgggcggggggctaacccccccacctcccttctggacggggcggctggccgggtggggggctgacccccacctccctcccagacggggtggctgccaggcgaagacgctcctcacttcccagacggagtggctgccgggcggaggggctcctcacttctcagagggtgtggctgctgggcggaggggctcctcacttctcagacggggcggttgccaggcagagggtctcctcacttctcagacggggcggccgggcagagacgctcctcacatcccagacggggcagcagggcagaggcgctccccacattgcagaagatgggcggcctggcagagacgctcctcacttcctagatgggatggcggccgggcagagacactcctcactttccagactgggcagccaggcagagaggctcctcacatcccagacgatgggcggccaggcagagacgctcctcacttcccagacggggtggcggccgggcagagtctgcaatctcggcactttgcggggccaaggcaggcagctgggaagtggaggttgtagcgagccgagatcacgccactgcactccagcctgggcaccattgagcactgagtaaacgcgactccgtctgccatcccggcacctcgggaggccgaggctggcggatcactcgcggttaggagctggagaccggcccggccaacacagcgaaaccccatctccaccaaaaaaatacgaaaaccagtcaggcgtggcggcgcgtgcctgcaatcgcaggcactcggcaggctgaggcaggagaatcaggcagggaggttgcagtgagccgagatggcagcagtacagtccagctttggctcggcatcagggggagaccgtggaaagagagggagagggagaccgtggggagagggagagggagaggagggagagggagaggagggagggagaggagggagagggagaggagggagacgggaagcttatttttctattcttggtttggtttttgagacaaggtctcactctgtttcccaggcatgatcactgctcactgcagcttcaacctccccaggctcaggtgatgctccttaacctcccgagtagctgagactacaggcacaagccaccacacctggctaatttttgtattttttgtagagaccaggtttgccatgttgcccaggctggtctgaaactcctgggctcaagtgattgaaccatcttggcctcccaaagtgctggtattacaggccaccacacctggccttaaatctaatttttaaaccacctgaaaagattagttcaagccatcccttattaggttgttctaagttttaaaaagagtccttatcccagtgttaagatttggatagaggatagagcacaggaaaaaacaattagcttggttgtttgctgccatttcccctctccctcttttactcacacacgttctctatttctgcacagagtttgaaagatatcaacaacatgataaggcaaggtgagcagagaaccaagaagcgagtaatagccatcgatagtgatgcagaatcccctgccaaacgcgtctgtcaagaaaatgatgacgttttactgaaacgactacaggatgttgtcagtgaaagagcaaatcattaatgttgttcttgtttctatgataaaagcactttcagattgttctgcagaaagttggagctctgtccttcaaaccttttagccctatagatgataaatatcactgggttataagaaaaaattgcacaaaaattatgtgctttttaaaatatttatccaaaatgtagttgacagagatgtattttgagttggattggaaaggaatattttaagtgccttttaaaaatactaatagtccggccaggcgctgtggctcacgcctgtaatcccaggactttgggaggccaaggcgggcagatcaccggaggtcaggagttcgagaccagcctgaccaacatggagaaaccccatctctactaaaaatacaaaattagccgggtgtggtggcgcatgcctgtaatcccagctacttgggaggctgaggcagaattgcttgaacccaggaagcggaggttgtggtgagccaaggttgcgccactgcactccagcctgggcaacaagagtaaaactccatctcaaaaaatatatatatatatataaatagggaattttttttaatgtttgctccttgagttttcaagatgaaataaggagaaaccccataactttttagctctcttttaaaaataaatgtctccttctgtgttctgtaatatgaggataaataatctacttttgatagcatgctttgagatatttgtattcttaatttaatattgaaggaaggggttggttcccatagtacctggccagagggttatataccatcctgtctctggcccactgtggtaattccacatccaggtaccaccgccattcagagttgtctcaccccttctcgtgccttttctctccttgagctttataaacagatttgtacctgagccccagtgctacactcatccttgctttccagccctaagccatctcagcctgatgtcacaacccaataaatggggcactttcttcttttgtaaactattatcattttggtttctgtgacattaacttaattatatatgatcgtattaactcatgtagttctcaaaataggcagctgcttctgaagccagtaaaataaaattcagttagttattaaaaactaaattcctattagtaaggtaacaccatgattatgtgtgatatactgtttttgagatcatagttatcagtcattctcaatatctaattgagtccctaagaatattttaaaccttttaaaaatcacataaatatcatctcatgcctcataattctaatatatttaatacatcagtaaaatagctgcttattacttcccacactttgttctcagtattgttagtgcatcatgagtttcctgctagtgtttgaccactgggtactcctgaagatgttttttagtactagggatgcttttcagtattagggatgcttttttcagtactagggatgtactagggagtactgagtactcctgaagatgtttttcagtactagggatgcttttttcagtgttagggatgcttttcagtactagggatgcttttttcagtgctagggatgcttttcagtactagggatgctttccaaaatatcacctctttaacgtttactttttctagtgtgtgtctggaatccaaaggacatgaataagccactcataattaattttgagaagttttatcaaatgtttatgtttctaactgcaaaccttaattttggaaaggcacaatgtttaactcacctatgtttaaccatggctaatttaaaatagtctaagatttggccgtcactaattagtattctcaagaatttcatttttcaattttaagaagaaaagggattttggtcacattttgcttgtaaatgaaaattacatcctcattctttgtgtagtatctacacattgttataagccaaaaaacaaagtctgtctggaatctttgtacatatttgtatgttgctataattgttatttttatcttcattattgtgcaaaatataaatgagcatttgtacattgactgtataagaaaccatgggccaggtcctgtggctcatgcctataatcccaacactttgggaggctgaggcaggaggattgcttcagtccaggagttcaagactaacctgggcaacatagccctcatctctacaaaaaataaaaaaattagttgggtgtgatggcatgtgcctgtagtcccagctactcaggagactgacatgagaggatcacttgagactgggagattctgaggctgcagtgagctgtgattgcaccactacactccatcctaggtgagagggcaagaccctttctcagaaaaggaaaaaaagaaattctggacatgtttttatcagttttcaggacttggtatcaatgtacatagaatggctaataaaaattggaattgagattattgaaaaaaaa

SEQ ID NO: 398 - DNA, 149432 bp, Homo sapiens
ctctttagtaggtcgggtgagtgtagtgtgcagggaagagacgcgtcagcgccagggccaggcccgcccgggggcagcccggcagccgaatcttgggctactctgtcccaacagccggagcagatcagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaaggtaagaccctgtccggcttcgcggcagccgggcagctcgttatcgagcggcccagagaacataccccgcttgttggccctcgagctcggagtcggccctgctgctgaggtctttgctgctcctctagagctgggtgagaagtcaattaggctttttgcaaaaggaataaaatagccttgccctcgggggaccgagtctcccctgcactctcattccgcgagtttgtgtgtgtccaaagttgagttaccggttttgcttctctcattcccttcttgaggctgcaagagcctgcctggaaaacatgtttggaaggcttttcttggtcaagtacctgccgcaacgtcctcgggcacatcgcttgactttagttgagggggctgttttgtctctgaatagaaggagggcagtcacttcctctcttttacccccaccccctttttctttccctggaagctcagattgcaggtttgggacttaacccctgctagggccagatactacggtcagtcagcagctctgcctgtatgcttgacttgacttgacttgcacttattaaataactttgtcccagagagaaagagagagtgggcagacatcgaagccaaacagcagtatcccggaagcactcatgcaactttggtggcggccactcagttttctctgccagtgtctggtaaattcctctattttgtcctaatctgacaatagtaaatagtaaatttccaaaactgtcgtttcatcatcagtttcagcaccgtgggcagctgctcgggtcctctcttgttgccccaaacctgcccggctattactgttcgtcagtgatgcagcagaaacagtgaaaactgatgcattcctttcaacaatgatgtgtttgttctccaaggagaacatctgcagtttttgatacaatataaataagtaaggtggctgtgcctccaaagagttcttctggagaaacagatcaattcaagatttaaggtagggctttcaagagtttatgctatttaagcacagttttttaatgggtggacattagctccatctcgaagtaacaaaactggacagtgatagcaattaaaaagaactttaaacaggaggtaagaagtgtagtgcagtgctgtagtgcaggaagtgtagtgcagtgctgtagtgcagggcccataaggattcattaatagattttagaatcaatttagtacattgacataagctttataaagaaagaaaaaataccagaggacattgtatggaataaaagtaaatattatggcaagaagcttttgtttcagtttttaacagtatgtgtgtgtcaagaggaagatggaaatgtaaagtgtattatggattatggcaaaaacaaatgtttcaaaatactaaattccaaatttgggagtcaagctgggttcagctctgccatttactaattctgtgacattttccgtaaataagaaatgagttgttatgaggattaaatgaaacaaaatttgtctattacataatttttttttgttttgttggaaactgttggagagaggcacagttatttttctctatgtagggaatgagaactgttttattagtttttttttttttaacctctgcctttgtttgaagctaggcagcttgacatcttgtctctatgtgtaatgcaaatcatagacagaatcttggtttgagaggtataatactgaagggtttgggataagttctcatctatgcttgtataaagctaattttctcaataattttggaggggcataaattgttgctagcattcagctttcttcccttgatatttttctgcattccagaataacgtagatttatcagaacttttacaggcactaactttagctaagtgagggtaggcctgagggtatgactaaagggatagatttatgtctttgagttaagttggctaggaaggcattttatgccttatagttcttgccataagagatgtatgaaatgaaatagtttggtcaactatcatggtatgttttgcttacttcatgtaggtgtgacctagaaatggttggcatttaaataacaatatttttaaatctgggaattgatgtttagcaggaggcaaatgagtttcagtcaaaacagtgttttgcaccatttgtcatgtttaccatatggcattgcatatgatagtttcacatgacataaaaaggggaagaaagttggtaagcattgttacttttcccaaaagaggaaacaaaattagaagcgaattccttttaataaagcatactggtgagtcattgttcaaaaatgtatgtattctatagatatttattgagcatatataaaagtaaaatattaaacttttatgaatcttttacattacacaaaagttgatttgggaacaacacagcatatgattggtattgtcaaagtttatatagcatagtatatcaacaacaacaaaacagtaatgtagctaatattgattggttaatatgagccaaatacaattctaagtgctttataatatctcaggtggttcttacagtcattgatgtggtagatagtaagttgtttcctttttatttttttttgggacagggtcttgctctgttgcccaggctggagcaattatggctcactgcaccctcgacctcccgtgctcaagggatcctcctatcttagcccgacaagtagctgggactacagtcataaacccccatgcctggctaattaaattttttttttttttttgtagagacaaggtctcattatgttgctcagtctggtatgaaactttagggttcaagtcatccacctgcttcagccttccaaaatgctgggattacaggtgtgatacatcatgcctgtcttatccccattttctaagtgggaagtgggggaattaaggcatcacagatacataacttctgagttcacacaagtagctggtggagtagctggaatttgatcacaggtattctgactacagaacgtctgtctcttttgtgtcttatttcattaaaaaatatggaatgctgtggggctattgtggattcgtacttgctggtgaccttggggaagctcctcctcaatttccttaactccttccttacttgtttttgtggggattcagataatttgtgaagcaatcagatggcgtatatgtttagtaaattatatgccttagcctttttttttttttcattgaggatgaggtcatttgaaagattgttagcagttgaaggagggtggaaaaaaaaaagttccacataaggacactgcccaagcaaaggtatagagataggaaaagcagaatacatttggtaaggatatatgtttaaggaccagactggtaaagatagatggatacagattatggagattcttaaatgtcagactaaagattttatatatgatttttagttaagaagaaactctctttatggataataatttgtgaacaggtccaatggaagagtggaagcctagaagtaggaataccatgcaatttaattatagtagttgaggcaagaagtgatgatcgtagtgaaggtatagatttgaaagatgttgacattataatgacattgacactgggaactgaccagagtataggcctaggacaaatttttgggaggatagtgatgttattaacagaaataaggatattatcatgaagaacaggttttggtggaaggagatttaggaggagagaggatgatagggagtttacttttggagctgaggagttgttcagacgtttggaaatgtagaatgaaaactggaagttctgtgtattctatgaaaagggaagagaacaaatgcttacattgtaaggaaatgacctaaaagtaaccactcctctgtgggtcagagtttcacaagagggatgtgactccttaaattactcacaagtacagatttctcaatgaagatgcacccattatttttccctttagtgtattttgattcgtgtcctgggagatcaggaggtaaggtagtggggaggaaaaacttttagacctagcaaggctcccatttattcaaaaaatagctagtaaattggaggctagggattctcaccgtaagaattttgagagtctgatttttgtgtggtaccaggcatttataaacatatgttgaatgctgaattgttgaacatttgaacatctccagatttgttatttttattatcctgtctttgttaccttgaattggttaatagcaaaacctttagaatcagagactctgtgtgcttgttatggggggcaacaatgaaagtcagggtgcagctaatgagattgtattttacttatagccaggattgtggaagaagacactcaaaggataagaggcttaccatttttcccattctgtaaaaccatgttgatgacaataccaattctgagagttgttttgaaatactgagttaatatatgaaaagggtctggtacatgatagatagtaattgagatgtttttgttaccagtattattatcttcacaagtggggggcaaacacagagatcccagaacctattataagaaaaaaaggaaaacatctggagaccctttgtacttgaaaaagggctcaggactaagtcatagaaggactgtaggtttcctttcttggaaggttttctagggtttggtacaattgggtagagcatgatgttgaattaagtagtaaaatatatccatctcaactattttcagtttcctgtcaagttctcagtaaaccaacagaaaaatgttgttgagcatgagaagaaggtttacttttcttgtcataccatttttggaaacattacttggatcctactacttaggggtttttctgtagcatttattcactcaaatatttgttgagtaccttctttgtcaggcactgttctaaagagaaaaatccttgcctgcatggagcttatctgctaatgggagaaataaggtgcattttcataatagacggtaattagatttttctcgtactatgtatttgtacctatttaagcagatggtaataatgaatactataccagattgtaactaattttgcagagcatttgaaggaagggaccatgtctttcttattcgcatttgtctctcccttttccccttcctcccagtggaatggcttagatgtgtttaatgctcaacaaacgtaggtactcatcaaatgtttattacagggagaaggtgttaaggcagaggctacatcttaaagattaaaggagtcagttaaatgtggcatgtattaaggacccatataccccctagattgagggtgagaagaagagaatccggctgggcactgtggctcatgtctgtaatcccagcactttgggaggctgaggtgggcagatcacttgagaccagagttcgaggccagcctgggcaacatggtaaaaccccatttgtactaaaatacagaaattagccagatgtggtggcgtgctcatgtaatcccagttacttgagaggctgaggcaggagaattgcttgtacctgggaggcggaggttgcagtgagccaagaccgcggcactgtactccagcctgggtgacagagcgtgactctgtctcaaaaaaataaaataagataaaaataaaaagagaatcccctggcttatctatgaggttggaataggaataaagttatattgtagctgaaagcatcaacattatgggagtctgggtgtcacccaacattcccactaattagctgggtgattttgcataaatatcttaacctctcagttcatttcctcacctgtaaatgaagtagttggaattgtccagttaaaatctgtttttacgacttcttgtaaaatatctcttgcactaatgtttcacttcactaacgtagataatatagagccaagcatgagcttccattgaataagcatcaagctaaatatatactcttagttaataaactaatgtttaagaaaagatgtctacaaaatttgttgatgctatttaccggtaagattacattgtaattttttaaaatagagcaaaatattacctaatatatagtttcccccattgccattatgtaaaggaaaaataagccatagtattttagaccttaataatggatcataatactcactttcatactttaatttatacaacagtcacttgcctctgatattgtgctagatgctaggtattgtatacagaattagaaaatgtatagctcctaactttaaggagcttaaggaataatgggagtgacagaccatttagttgtgttgcattttggtggcatagagaagcatataatgagagtctgggagaagagaaagtgctcatggttacagagaaaaagactggaggaatggcaagggactaagctaaatatacagagacgagccagtttatgaagaactttgtgctaaaccacagtttagttctgagctgtattctgaaaactgcttaatctgttaaggaattttatgcaggcagtaacataatcaggcatttttatatctacctttatattccttttaagagaaggtgttccctgaggaaggtatttgttatttctagttgtttcaacgatgtagatcttcctgaggaaatcagtctttttaactttgaaataaagtctgaggaacattgtcaattttgtggttatagagttaataattattaaatattaataattatgaaatattcagacattaaaacatttaaatgtttattgccacattaatgtaaactgaaaagaaaactgaaattttgggatgttttgcgctttgatgtaagagagctcttggtcagctacaagaatttggcttagaatcatttttaaggagttagaaatacgttgaccttgaattgattgaaagtgaatgtagttcaggctcagtttctttctttcttttttttttgtttttttaaagagaccgtctttttctgtcacctggtatggtctcaaactcctggccccaagcaatcctccctcctcagcttcccaaagtgctgggattacaggcgtgagtcaccactccctgcccgggctctgtttctaatgatagaaatatccaggtaaactttatagagggaatgaatttccaccgggaaataatcctagtgaggagctggtgataaatgaatatttctgaatgaagtcatgagggagaaacatctactttatttagatgtgaaacacctcattaaatgttgaagaatactttatttgcatacttactatgtttgtcatttactcttttgaccctcaaagaggaagagctgcttataatttccacatttatccaacatggattataaatgttaattgctttttttggaaaaaaaattgaggtaaaaattcacgtaattaaccattttaaagcaatagttcagtggcatttagtacctttgcagtgttgtgcaaccatcacttctgtctagtttcaaaacatttttatcactttgaagtaaaatctcatacctattaagcagtcattccctgatgcccctagctcatggcaaccacatctgttttctgtttttatggatttacttattctggatattttatataaattgaattttcaatatttgagtttttatccctggcttctttcacttagcaaaatgttttcaaggtttacccacatgtagcatatatcagtacttctttccttttcatagcagaagaatattcctttccatgtcagaagaatattcctttccatgtctatatatcagtttgtttatccatttatccatcgatggatatttgggttgtttccaccttttagttattatgaatatgttgctgtgaatatttgtgtccaaggatttatttgagaacctgttttcactttttcgggtatataccaagaatggaatgctgggtcttatggtaattttgtttagctttttgaggacctgccaaactgctttccacagtagctaaaccattttacattcccactggcaatgtgtgagggttccaatttccctacatccttgcctacacttattttctgtttttaagaaattataattgccatccttatgggtatgaagtggtatctcactgtggttttgatttgcgtttcccagattactaatgattttaagcatcttttcatgtgcttgttggccatgtgtgtatctgctttagagaaatgtctattcaagttctttgcccttttaaaaaactacattgttggtgtttttgtattgagttgtgtttttatatactccagatactagactgttcattatcaaatatataatgtgcaaatgttttcttccattatgtggattttttttttcaattttttgataatgtcctttgatagataaatgttttgaattttgatgaagtccattttatttatttgacccatgcttttggtgtcatatcaagaatccatttccaaatcccaggccatgaagattaaccctatgttttcttccaagagttttataattttactccttatatttaggtcactgattcattttgtgttaattgttgtatatggtataaattccaacttcattgtcttgcatgtgaatagttgtcccggcaccacttgttgaagacactgttcttttgccattgaatggtctttggcatctttaaaatcaattggctatagatgtatcagtttatttttggatgctcaattctactcctttggtctatatatctatcactatgccagtgccatgttgttttgattactgtagctttgtggtaaggttttgaaattgggaaatgtgagttctccagctttgttcttctttttaaaaattgtttggcctgtttagggccccttgcaattccatatgaatttgagaatcagcttttccatttctgcataaaaggccatagaaattttgataggtaatatattgaatctgtagattgctttgggtagtattgccatcttaataatgttaagtctttgagtacctggatgtgtgtttgatatccttcagcattgtttttgtgttttatagttttcggtgtacaagtctctcacctcctttgttatatttattcctgggtattgtattcatttggatactattatacatggaagtttttcttaatttaatttttggatagttcattgctggtatgtagaaacacaatggattttgtgtgtaacatttattgcctttaacagtcatttactttcttttttccatgtgcaagctgaatcacgtgggtaaataagaaagtggaaagtggaacactaaagaacttgatctgtaagatgtctgatttccctgaatgtgaaaactatgaaatatgtttttagcatagtgttgaactattatcttactatacttgggctattccatttctggtatcacgttacatatatttggtcattattaaagaaggtagatcatttcattttctttaggtttggagagaagtgtcaatacgtaattcattttcaaagttacaattattttgcaacttaattttgatgttacacagaaagcctcagggataaaccatatttatcgcagagtctggtacagagatccatgaataataaagataaaattagaacagaagctaatttgaatatgtaaattaccattaatatacattagtttttctgttttttcttgaagtttccaaatagccttaaaatttcattatgaatagaaatgtgaacaatttcaacctcataagtaattaaagaaatgcaaatttatgcaatacttggatgatttgggaagggcagtatttcatgacacagacttttaattgaatcctagcttcactatttaagaggtaagtattactgggcaagtaactgaacacttaaaacacttaaaaataagaggaaatatttataaagtgcttgctgtgtgttaggcactgttttaagcactttatgctgttgatctaagtttttattcctatatttatggaaagacagtggaacctactatagagttgtgaggattaaaataaataatgtatattaaggacttagccagatatgtagtaagcatttgataaatattagctatttttgtcatttataatttcacctaacaccaacaaaagaccaaaaaaggagaatcgatacaatgaaatgcacatttatttggaaatataaataggaatgttcttttctggaaagcaattgggcaatatgtatgaagtcttaaaatgtttctttggtgtagtgattccatgtcaaggaatctatcccaagaagataatcagaagtatggaaagatttatattcattggaaaattatttgtaatagtaagagttcaattcaatgttgtacagcaagaaaatagacaaagtcatgtgtcagccatataaagcagtacaaagtagctgttaacatagtggttatgaagagtttgaacaacaagggaaaatctttgttataatttcaagtaaaaaagcatacaaatcataatacaatatgatacaagtgattactttgaactttggaagacattatattattaaaataaaataacatgttaaaattttgaagtagctacggagttaaagttgtaaaaacaatacaaagacctttatgttttttgttatttgagagaaagttgtttctctgatgctgtatattcctataaacaacaatattctctttaaagaaatggctgatttcagggctggggcaggaaaagtacaaggcaggactggaaaatcttgtgccagaaaacaaggaggtgctcaagaatgttgggaacatatcaaaaagacacaaaagctagcttgaataagcctccattggccaaacaattggacatcaaaatgataatacaatagcagattataacccattgaataaaacagtaatctgtgattccacactgatataaataagtaaatgaataaattagaatgttgccaagaaatgtgataattaccgtggtaggcagaataatgactgcccaaagatgtccatatcataatacttggaatctgtgaatatgttaccttgtatgagaaaaggaactttgcagatgtgattaaggacctcgggttgggaagattatctgtgtgggcccagtgtaatcacaagtgtccttaaaaatggaagagggaggcagaagaggagtttggaataatgtgctataagaaggaattaatctgccattgctggctttgaagatggaagaagaggctacaagccaaggatgttggcagcctctagaagctgataagtataacaatcaaattgttgtataatgtaaaacattttcatttaaaaacatacatgaataatatcctagactagaaaaaatatatggtttttttttgtgaaaggaaatgacctctgtcctagttttcctttggggctttttttttttaaagatatacacacaaatatagttaggtagattgataaacacatacaggattatatgattatgtctagttaatgtccatttgtaagtatgtctgtatcaaaaagctccaaaagaactaggtcagaggtcatcctcttttttttttttttaatttaacttattttaagttcaggagtacatgtgcaggtttgttatataggtaaacttgtgtcatgggagtttgctgactagattatttcatcacccacgtattaagcctagtacctgttagttatttttcctgattttttttttttttttaagatacaaagtctttccgtgttgctcaggctggagtgcactggcgatcatagctcactgcagcctcaaatcctgggctcaagcaatccttctgccttagccttctcagtagctgggactataggtgcatgccaccacacctggctaatttttgtattttttgtagagacagagtctagctatgttgcccaggctccagcaacccttttttttttttaaggcttagtcttgctctgttgcccaggctggagtgcagtggcacattctctgctcactgtaacctctgcctcctgggctcaagtgattcagcctcctaagtagccgggattacaggcaccaccacgcctggctaatttttgtatttttagtagagacagggtttcaccatgttgtccaggctggtctcaaactcctgacctcaggtgatccgcctgcctcggcctcccggagtgttgggattacaggtatgagccaccatgccccgcctccagcaaccctcttgatgcagatgttgtacattccaggcctggtgcctgcagctgtgccctgactgcctctgcacacctacccatcagcaccccagtgggctgtttattgtttaccgggcaaccttggaccagctctggtctggtcaacccagtgagattctctgttacctggtgtgctgcaaccacacctgctccagtgaaaactgaatttcagcctcaggctctcttccaagtttgtccctttgtaatgtctccctcagtgttactctcttatagtttaataattccttttctctaaaaaattgaaaacagctttactgacttataattcacatacaataaactacataaaagtgtatactttgataagttctgatatatttatataatcatgaaaccacctatataatgaagttaatgaacatattcatcactcttagaagtttcctgatgcccttttggaatccctctctcctgcccctccctacccctctttgtatctttatatttactgtcctatcatagcttaataatcatttatattgaataccttttgtttaacttactgaatagtttctcctgtttgaatctctactggtacacaattggtgtctggagtggctccagcagatagatctgaaattctgagattttggcatttgggtggttatgcctttgggcctgagcgcagtgctgagctccttgtcagagggaaatggaatgctggtaatccatggcatcacaattaattaagctatcacctgtggttgattataatgtgttgctaatgaatgcagatgcctcagagcccaagtggctgctacatttgacctttatggcaataataactgtaaggactatagtgtaggatagagtcttttgagtataattaaaggcttacagacagaaaatgactgctcagatttgttaactctgctcaagatctgccctttctcttttttgatcatatattttacttcaaatcatttcatctcctccaaattatgaataaacttgtgaattaaaagacttgttgcttgctcatttaagaaatattttgctgtgtaaaagtaatgcacacttagaaaacttgagcaagtagaacagatttctcttaatattttcgtgtattttcttctagtctcctgtatatattatgcaaaatgaaatagtctagggagttttagttttttattatgaaacatgcagataaatataaagaagaataaaaaccgcagagtcccaccatccagagcttacatgattcagcaaattaatttattatttcatagtatttatgtttcgttttgagatagggtcttgctctgtcacccaggctggagtgcagaggtgcaatcttgtctcactgcaacttctgcttcctgggctcaaacgatcctcatgcctcagcctcctgagtagctgggactacttgtgcatgccactatgcctagctaatttttgtatttttatgtagagacagagttttgccatcttggccagggtggtcttgaactcctgggctcaagcagtccacctaccttagcttcccagagtgctgggattacaggcattagccaccatgcctagccatatttatatatttttaaatattaacgtacagttggccctctgtatccatggctctgtatctgtggattcaaccagtattcaaaatattcaggaaaaaaaatggatggttgcatctgtactaaacatgttaaacaatatggtataacaactatttacatagcatttacactgtattcagtattataactaatctagagatgatttaaagtatatagaaggaggtgcgtaggttatatgcaaatagtataccatctgtggtaaggaacttgaccatccatagattttagtatgagcgggcagtcctggcaccagtctctcacagacaccgaggatgactgtatatataaactatatataaacttttaacatttttaatgttacggtcttaaattttttttttgagcatagaggctctgcagaagatatcaagagaggctatgtaggcattcagtctataaatattaatattaaacacctaatacattataggcactctttaggtacttgtgatacatccataaaataaagattcctgtctttgaggagcatatgtttttgtggcaaagctgaacactaaacaataaacataacaagtattatagtgtgatagaaagtcatattataataaaaaaaggaaagatgattataagaagagtgaggcatgataggtgcataggcaggctgcaaacacttgtcaagggagagtgtggtgtccagaaaagaccaagaacagggctgtgggtgatgttttaaataaacagttgttataggctgagtgtggtggctcatgcctgttatcctagcattttgggaggccaaggtgggaggatcgcttgaggccaagagttcaagaccagcctgggcagcaaggcaagaccctatctctctattttttttttttttttaaagaaacagttgttataatcaatgggaatgctgtaacttgatctggtgctccaccattaacatggtaagccatgttaagtttcatgtttaacacctgaactaagtgcgagtcattggacttctcagctttttgttcagaaattgcaaaaattaaaggagtaattaggatgagggaactggttcatttagtcagtcagttagactctagcacttaaacatagaaattgaatcccctaaaatagggaaaatggaatgacagtgcaagttactattttcctgtgttgtttttgttttattttacaatgttgttttgatgattagaaggaaaaacattcatgtcagatgcttaacacagtgcctagcacaaaattaagttttctatcaatgttggctacagtgatggtgacatttatgtgaggaatcatgaaaataaaacattctggtttgggagatagatgacattaataccttcaagtacactgtgcatgatatttgatattttgataatcaagaaaaccagaattttctaccatctttccctagtgtttaatattctgctattcatgaaagcaatttcattgtcaattgtctttttcttgtttgctgtgtggcttattgctagggttggcagcctatggtactggtgacaacagtggtatttgaaagaattatgaagtctgtttttcttagcactcctatcactctctctctctctttttttttcttctctagtttgaccctctacccactgcctattgacttgcaagaagtttatgaataatgacttggtacgccacttaccaatctttggttcaaaacagtgctttccaaatttgacttaattatatggattcaatagggaacttttttaaaagtcaaattataggttttctgtctgcatctcaaggggaggggcctgggaacatttatttttgtcacaggcgctgagagatttgtgatatactgaactaaaaatgtattttccatttataagaatcacctggagtacatgttaatactgtgaatagtatagatgaccggatcacatctcatatatactgagtgagaaactataactttgggattgagaacaattggtatgaaggccctgagattggaaagaatttgatattttggaaaaacctatttctttttgagatggagtcttgctttgccacccaggctggtgtgcagtggctatcttggctcactgcaacctcttcctcccaggttcaagcgattctcctgcctcagcctcccaagtagctgggattacagacgtgagccaccaggctcagctaatttttgtatttttagtagagacagagttttatcatgttggccaggctggtctcgaactcctgacctcgggcgatcctcctgcctcggcctcccaaagtgttgggattacaggtgtgagccactgcgcccggccagaaaaacctgttttttcttaatctattaaaagtaaaaaattgatcattttgtttcatttgttgaaaaataaaattgtaaaacatttattgcataggtgaaaaaattttgctttggttgattgtggtagttaaaaatcttagattatgcttgcttttactttggaaggctttatgttagaggaatttgctgggcaaacttctgctttcttgcaaaaaatattggacatcttatttttgcttaaaaagagaagccctattattgttgtttttgttttgttttggtttctgatgtaacacttttgcttatgacaacttctgatccagtgtttttaaaagcgttaaaaaactatggagatttaaatatagtatgtgatatggtttggctgtgttcccacccaaatcacatttcgaattatagctcctataaaccccatgtgttgtgggagggacgtggtgggaggtaattgaatcatgggggtggttttttctgtgctgttctcgtgatagtgagtaagtctcatgtgaactgatggttttataaaagggaagttctcctgcacatgctctcttgcttgctgccatgtaagacatgcctttgcttctcctttgccttctgccatgattctgaggcctctccagccatgtagagctgtcagtccattaaacctctttttctttataaattacccagtcttgagtatttcatcatagcagtatgaaaatggactaacatagtaaattggtaccagtggagtgggtactgctattaagataccagaaaacttagtttaaaagggaagtgactttggaactggataacaggcagaggttggaacagtttggagggctcagaagaagacaggaaaatgtgggaaaatgtggagcttcctaaagacttgttgaatggttttgaccaaaatgctgatagtcatatggacaatgaagttcaggctgaagtggtctcagaaggagatgaggaacttattgggaactggtgaaaaggtgattcttgatatgctttagcaaacagactggtggcattttgtccctgccctagagatttgtggaacttttaacttgagagagatgatttagggtatctggcggaagaaatttctaagcagtaaactgttcaagaggtgatttgagtactcttaaaagcattcagttttattcattcacaaaaatacggtttggaattggaacttatgtttaagggaagcagagcataaaagttcagaaaacttgcagcctgatgatgcaatagaaaagaaaaacccattttctgaggagacattcaagccagctgtagaaatttgcttaagtaacgaggagccaaatgttaattgccaagaaaatagggaaaatgtctccagggcatgtcagaggtcttcatggcagcccctcctatcacacgcccagaggcctaggaggaaaaaatggcttgctgggctgggcccagggccttgctgctttgtgaagtcttgggacttggtgtcctgggtcctagctgtggctaaaagggaccaaggtacagtttgggtcctggcttcagagggtgcaaaccccaagcattgacagcttccacgtggtgttgagctgcaaggtgcacagaagtccagaactgaggtttgggaatcttcatttagaattcagagaatgtatggaaatgcctggatgtccagacagaagtttgctgcgggggtgaagccctcagggagaacctttgctagggcagtgtggaagggaaatacagtgttggagcccccacacagagtccctactggggactgcctagtggagctgtgagaagcaggccactgttctccagactccagaatggtagatccaccaatggcttgcaccacatgcctggaaaagctttacactctcaatgccagcccatgaaagcaaccaggaagggagctgtaccctgcaaagctacaggagcagaactgcccaagtctgcgggagcccacctcttcctcagcatgagctggatatgagacatggagtcaaaggagatcattttggagcattaagatttgattgctctgctgtaaaatttcagtctgcatggactctgtaccccccttgtttctgccagtttctcccgtttggaatgggtgtatttgaccaatgcctgtcccctcattgtatctaggaaataattaacttgcttttgattttacaggctcataggcggaacggacttaccttgtttcagatgagactttggatgtggacttttgagttaatgctgaaatgaattaagactttgggggactgttgggaaggcatgattggttttgaaatatgaggacatgagatttgggagggtccaggggcaggtatttcttcatagcagtatgaaaatggactaatacagtatgtgttagaaattctagttgccagaattcctggaaatcttgatgctttttaaggaacactaggaagttattgatatatttaggtggtgtgtgagctgagaacactattttggaggaaattttatagtgccatatatatgttataaacatatgtgaccataatcacatttgtaggaaaaataacctattaaatgatgtgtgactggctattataaattttccactaaaatagttaattaattgttcgctgatttttttctgttagtgcttggtacagtatatattcttctgatgcttattgtagtataaggtacatttcttgaaaaaaacaaattgaaattactctgcctattctgttcgcaaattaggaaaagataacaattcttttagtagtggaatattttggtccagttcttgagatgccagtgaaggtcaagaatgtagcttcagaaccagtggaatctgagcttacttggtggatttcttatggagatggctggctgtttcatgagtgttatttggcagtgaagcagttggtatcacactgttgactcatcttcagaattaaaatttatttggaagtgaatttcctgaaagtaatactggtcttaaaaattcattgtcacagatttaaatgtgaagttaggatttactgtgatgcttgggaaattttcaaatttttcagtgaccagcattagacaagtaactgtcatttatcctccaaaaccatacagataatcatgtgtaccagccagtttgctcattttctcaaaaatgaggccaagagaaaactcagccaaaccaacaattggtttttaaaaaaaatctatgaaattaacaaatctttcattatagtgactaaagaaaacaagagaggagactcaactaaaatcagaaatgaaagaggggacacaactaccaattttatagaaataaaaaggattgtaaaagtactataaacaattttatgccaagaaattggataacctagatgaaatggatgaatacctggaaagacacaacctcccaacactgaatcatgaaaaaatagaaagcttgcacagacctatgggagattgaagcaataatcaaaaacattccaagaaagaaaagcctgggatcagatggcttcattggtgaattctaccaaatatttaaggaagaatcaacatcaatttttctcaaactcttcccaaaaaactgataaagagggaacacctcctaacttattctaaggggccaaaattaccctggtaccaaagtcagacaaggatactaaaaaaagaaagaaaagaaaactacataacttatcgttctctctctctctctttttttttttttttttttgagatggagcctcactctgttgcctaggctggagtgcaatggtgtgatcttggctcactgcaacctctgcctcccaggtttaagagattctcctgcctcagcctcccgagtagctgggattacaggtgcctgtcaccacacccagctaatttttgtatttttagtagaggcagggtttcaccattttggccaggcaggccattatctcttatgactgctgatgtaaaaatcctcaacaaaatgctagcaaactgaattcagcagcacgttaaaagcattatacacatgaccaagttggacttattcttggaatgcaaggatggttctacatgtgaaaagtgttatagtcaatgtaatgtaccacattaagagaataaaaacacataatcacttcaatagatgcagaaaaagcatttcacagaatttaacactctttcatgataaaacacccaacaaactgaaaatagaaggagactacctcagaataaaggccatgtgtaaaaaaccgacaactaatataattggtcataaaagactgaaagcttttcctctaagatcaggaacaagacaaggattcctgcctttgccatttctatttatcttggcaccagaagtcctagccagagcaattaggcaagaaagagaaatgaaaggcatcaaaattagaaaggaataagtaagattaccattgtaagcagatgatatgaccttacatgtaggcaatctaagattccacaaaagaaaaaatatctgatagaactattaataataaatgaattcagcaaagttgcaggatacaaaatcacacacaaaaatcagttgcattcctataaagtaacagcgaactatccaaaaaggaaattaagaaaacaattccatttacaatatcaacaaaaataaaatagtaataaattaaaccaaggaggtggaagaattgtacactgaaaattgtaagactttgctgaaataaagaggacataaataaatgaatagacattccatgtttatggattgatagacttaatactgttaagatgtcagtactacccaaagaaatctatggattcaatgtaatattatcaaaatcgcaataaccttcttgcagaaataggaaaatctatcctaaaccatatatggaatctcaagggaccccaaatagccaaaacaaagttgtaggtcgtatacttcctgatttcaaaacttaactacaaaattccagtaattaaaatagtgtggtactggtgtaaagatagacatatagagcaatggaatagaataaagagctcaggaataaagcctcacatacatgctcaaataacttttgacagaagtcctcctatggtttggaaatggtttgtctggccccaccaagtctcatattgatatttgatccccagtattggaggtagggtctgatgggagctatttggattatgggggtagatccctcatgaatggcttgatgccgttctcatgggaatgactgaaatttcactcttagttcttttgagaactggtgattgaaaagaacttggcactttcttccctctctctcacttgctgctcttgctgtgtgatgggctcccttttgccttctgccatgaatggaagcagcttgaggtcctcaccagatatagatgttggtaccatccttcttgtacagcttacagaactgtgggccaaataaacctcttttctttataaattacccagcttcagatattcctttatagcgacacaaatggactaaggtgtcaagatcatttgatagagaaaggcattgtacacagtctcttctacaaatggtgtgttgggaaaactgaatatctgtatgtaaaagaatgaatttgacctttaccttataccatatgcaacagttaactcaaaattgatcagagatctaaacataagagctactatgtaaaactcttagaggaaaacataaagaaagcttcacaacattggaattgtcaataatttcttgggcaggacaccaaaagcacaggcaagaaaagaaaaaaatagatgtttgacttcatgaaaattaaaacttcttgtgcattgaaggacagtaccaacagggtgaaaaaaatgagagaaaatacttttcaatcatatattttataaggaattgctgtctagaatatatagagaatttaaaaaatttttttatttccataggtttttggggaacaggtggtatttggttacatgagtaagttctttagtggtgatttgtgagattttggtgcatccatcacctgagcagtatacaccttcaccccctcctaccctttcccctgagtccctaaagtccattgtatcattcttataccgttgcattctcgtagcttagctcccactaacgagtgagaacatacgatgtttggttttccattcctgagttacttcactaggaataatagtttccagttctatctaggttgctgcaaatgccattaattaattcatttttatggctgcgtagtattccattgtgtgtgtgtgtgtgtgtgtgtgtgtgtgtgtttgtgtgtgtgtgtgtgtatgtgtgtaccacaatttctttatccagtagttgattgatgggcatttgggctggttccatatttttgcaattgtgaattgtgttgttataaacgtgtgtgcaaatatcttttttttatgacttttctcctgggttgggattgctggatccccagtagtgggattgctggatccccagtactgggattgctggattcccagtactgggattgctggattcccagtactgggattgctggatcaaatggtagttctacttttggttctttaaggaatctccacattgttttccatagtggttgtactagtttacattcctgccagcagtgtagaagtgttccctttcaccacatccatgccaacctccattttttaaaatttttttgataatggccattcttgcaggagtaaggtggtattgcatagtggttttgatttgcatttctctgatcactagtgatgttgagcatttcttattttgtttgttggctatttgtgtatcttcttttgagaattgcctattcatgtccttagcccactttttgatgggattgttaactcagtggcaaaaaaccaagcaacccaattaaaaaatgaacataggagctgaatagacatttttccaaagaagacatacaaatggccaaaaagtacatgaaaagatgctcaacatcactaatcattggggaagtgcaagtcaagaccacaatgagataccactttacatgtattttagtatggctatatgtatatatatatattgtatatatatgtctatcataaaatagatttaaagtggtatctcattctggtcttgaaggaaaacaacataaaatagcaaatgttggcaaggatgtgaagaaatagtaactgtttgtgcattatttgtgggaaagtaaaatggtgcagccactttggaaaatggtatggcagttctttaaaaaaaaaaaatcaaacgtagaattaccatatgatccagcaatacttctgggtatatgccacaaataatttaaagcaggaactcagttatttttttcacaatagctaaaagatctaagcaacccaagtgtcaattgagagatgaatggatcagtaacatggggtatgtacatataatggaatattactcagcctgctaaggaaggaaattttcacatgtggtacaacacttcaagatatcatgctaagtgaaataagctagtcacaaaaggacaaatattgtatgattccacttatattaggtagttagagtagttgaatttatagaaacagaaaataaaattgtgcttgccaatggccaggggatggggcatgggtaattaatgtgtaccaggtttcagtttgggaagatgagaaaattctagggatggattgtggtaatatttgcacaacaatgtgaatatagttaatgttactgaactgtatactttaaaattttttatatggtaaattttatgtctgtatgccacattaagaaaagaggctgaaggccttctgaaaagatcactgaagagttaaaataatttttcatgcatttagtaaactttttattatataaattctcaaacatatagaaaagcagagaaatagtgtaatgaatctcaatgtaatcttcacctagatttatagtgtgtttttttctgaagtgctttaaatgacagatatcatgacatttctttcctaagtactttactataatagatagctccccaaataaggactttttcatacagctattgtattagtcctttttcacactgctgataaagacacctgagactgggcaattttcaaaagaaagaggtttaatggacttacagttccacatcactggagaggcctcacaatcatggcagagggtgaaaggcacgtctcacatggtggcagacaagagaagagagcttgtgcagggcaactctcctttataaatccatcagatctcatgagacttattcattatcacgagaataacatggggaagacctgcctccatgattgaattacctcctgccgggtccctcccacaacacatgggaattcaagatgagatttgggtgaggacacagccaaaccatgtcattctgccctggcccctcccaaatctcatgtcctcatatttcaaaaccaatcatgccttccaaaagtcccccaaagtcttaattcatttcagcattaactcaaaagtccacattccaatgtctcatctgagacaaggcaagttccttctgcctatgtgcctgtaaaatcaaaagccaatcagtcacttcctagatacaatgggggtacaggcattgtgtaaatacagctgttccaagtgggagaaattggccaaatcaaaagggctacaggccccatgcaagtccaaaatccagcggggcagtcaaatcttaaagctccaaaatgatctcctttgactccttgtctcacatccaggtcacgctgatgcaagaggtaggttcctatggtcttgggcagctcctccctggtggctttacagtgtacagccttcctcttggctgctttcatgggctggcgttgagtgtctacggcttttccaggtgcacggtgcaagttgttggtggatctactattctggcgtctggtggacagtggtcctcttctcacagctccaccaggtggtgcctcagtagggactctgtgtgggggctccaaccccatatttctcttccacactgccctagcaaaggttctccatgagggctctgcccctgcagcaaacttttgactggggatccaggcatttccatacagattctgtaatccaggcagaggttcccaagcctcaattcttgacttctgtgcacctgcaggctcaataccacgtggaaactgccaaggcttggggcttgcatcctctgaagccagggcccaaactgtaccttggctctgtttagccacggctgggatgcagggcaccaagtcccaagacttcacaaagcagcaaggccctgggcccagcccagcaagccattttttcctcctaggcctctgggcctgtgatgggagaggctgccatgacaacctctgacatgccctggagacattttccctattttcttggcaattaacatttggctcctcgttacttaagcaaatttctacagctggcttgaatgtctcctcagaaaatgggtttttcttttctattgcatcatcaggctgcaagttttctgaacttttatgctctgcttcccttaaacataagttccaattccaaaccgtatttttgtgaatgaataaaactgaatgcttttaagagtactcaaatcacctcttgaacagtttactgcttagaaatttcttccgccagataccctaaatcatctctctcaagttaaaagttccacaaatctctagggcagggacaaaatgccaccagtctgtttgctaaagcatatcaagaatcaccttttcaccagttcccaataagttcctcatctccttctgagaccacttcagcctgaacttcattgtccatatgactatcagcattttggtcaaaaccattcaacaagtctttaggaagctccacattttcccacattttcctgtcttcttctgagccctccaaactgttccaacctctgcctgttatccagttccaaagtcacttcccttttaaactaagttttctggtatcttaatagcagtacccactccactggtaccaatttactatgttagtccattttcatactgctatgatgaaatactcaagactgggtaatttataaagaaaaagaggtttaatggactgacagctctacatggctggagaggcctcagaatcatggcagaaggcaaaggagaagcaaaggcatgtcttacatggcagcaagcaagagagcatgtgcaggagaacttcccttttataaaaccatcagttcacatgagacttactcactctcatgagaatagcatgggaaagacctgcccccatgattcaattaacctcccacgaggtttctcccacaacacctgggaattcaagatgtggtttggttggggatgcagccaaacccataccagccataatactatcatcatagctaaggatttttttaaaggatatctaatatctgggccatatttccgttgtctccattattccgaaaatgtatttttattgttggtttaatggaactgtatgttgcatttgtctttactgtttctcatctcttttgatgtgtaacaatttcatgccatttcctcattctgtcctcttgtactgtctctgtttattgtgttgaattttgtagaaattggggcattaccctcaagcaagacacccatcttgtggtatcttatttattttttttcattccagaaaattcttgtaaacttgaagtgagagctaaaggcttgttagaactggtttaaaacagtttcgcaagaatacatcttaagtgttataatacagactgaacagaaagtaaaattagaatttgacagttggaaaaatctttagagtgacgaagctgatttcagttaaaatgtctgttaataactagtagaattatgtcaaatggtaggccaaattagatgtgatcaaagatcgtggtagtgtacacatctctagaagcctttttggtagttctcaagagtttcttgtatattctctactttgaactttcttcctttgaagaagtgtgactttttttattataggcatactcaaaatgaatacagagttatattctgtctttggtaatatgagtgggaggacgaggggcacaaggaggaggaaaaggataaagggtagatgtttgttatcagcaagattttactagatttttttctatgttttctctgtttcccagaatggttctaaaatatcctcaggatggatgtattctatttgctgggggataagagtctcgacaaacagtactttactgtggtccatgcagagactccaacagttgaataagttcaagcatgagaggccagtaagaattgtaatggggaagaaagataccacactcactgtccacctgcgtggtcaggggttctgattggtatccacactctcaataactgatgggctattatctggtaccaggttcactagcttggtaggaggtaggaggatagagactgggagcacaacatatcaacataaaatgcatcttcactgagaagccttacattcattcagataaacctttcatacctaccaaagagtatactggattgtaaccagtgagataaatatatggatgtgtatcacctcagcatacaaaagtgtcacatatgaaaggaaccacttcttttaatagtccgtgagtagctccagcttcgctcaagcatcatgctttctttcaagaaacagacactgtagggaatcagagactttttttgtttatgtttttgtaataagcttttttagttaacttacagtcttttcagtttaaatacttttcaccaatcaggagtcatttttaccataaataatattgcctagtaatacagctgacagcctgcatttattttaatccagttgattaagtgctagaagatgatatcagagaatttaagcttgctaacctttttcctcaggaggcttcctggaaaagggcagatttaagtgaaaacaacaaaacaaaacctagcagcaacaacaaaaaacctatgtgcttatttgagaacatgttaataagtgtggatctttttcacagaaactttgtgtagttgaacatacacaaaattttgcatacaatttaataagatttgtagttttcccccaaattctcttttgaagatagaagagagtgtattttagttcctgggtaacatgtgaatgaagatataatgccagcaaggtgattgctggaaacagtgagctgattgatcagagcaagggtgagtggtagagtatgagaaagtaaaattgtttaggttgagcagattcttttttttatttttattttttgagacagagtcctgctctgttgctcaggctggagtgcagtggcatgacctcggctcactgcaacctctgcctcccgggttcaagtgattctcgtgcctcagcctcctgagtagctgggattgcagctactcagctacagaaattaccgtgcctggctaatttttgtatttttagtagagacggggtttccccatgttggccaggctagtctggaactcctgacctcaggtgatccacctgcctcggcctcccaaagtgttaggattacaggtgtgagctgctacactcggcctgggcagattcttaaatgtgaaaattttagaccctcttgcgccttctccaacatttacttctgttgaccaatgccttacttccccccacattcattttaaagttcttttctctcttgacttttgtgaaatcagtctctctctcttttttctttttccacctgtctttgaaacttagatatccctcagagttttttagtcctcttttctttttgattttcacttttacattaagagcacttcaattattcctatctgctgatgattcctaagtctctttttgccttgtgtggagctcgagatctttatttattgttgcctgtgtacatgtccaccagactgttccacaaatactaagttcagaaattctcaaattgtacttactttctcactgtggtcttccttctatgtttcctgtttcatctgttggcatccctatccaaagtcctttctttctatattccattgctatgttaagcccttctgtgcataattgtatttattctacagagttgtcttataggtcctatggtccttcttttagagataaagcaatttttgtagtttaaatatttacctccaaattacactattagtatgggacagtgctgggatataaacccatatgtataaattccatattttttactgcaattattataatgccagccacttttatcactttaaaaaatattaagggtttacctataggtgtaattaaaggaatatttattgcagtgtttttctaaaaagaaaaattccaacagtaagaatttctgttcagcccattaaagaatattcataaggaatgccatatggccatttatacatcatatttttgaccagtagtttttattttgtataaacaaattacgtatggaaacccaatgtgtgaaatagattaagaaaaaataatgcttgaaagggagggacgctccacagtatttcatggacagctatctgcaatggtttttgaggagagttaggaaaatattcataataccttaagtgaaaaaaatacaattagtaaaacagtatgcacagtgtgcccccaattttgctaaaaacgtatttgaatgtgcagttcgccctccgtatccatgggttctacatccatggattcaatcaactgcagagtgaaaatatttggggaaaaaagtgactatactgaacatgtacagactatttttcttgtcattattcttgaaacaatacagcataaccactatttacatagcatttacattgtattagatataagcaatctagagatgttttaaagtatttgggtggacatgtgtagattatatacaaatactacatgattttacataaggaacttaagcatcttcagattctggtatccgcagggagtcctggaactgatcccccatggataccaagggacaactctatacattgctaaaagactaggaagttatacatcaaagtatgagcactagttgttccttaatttgaggattatttataattttcattttccccacattttccacaatgagcaagaattagtttcgtaaatagagactataaagcaaaactcctgaacattatttaaaaaaggcaataaatgcaaaaaaccctcaaaacatgctacatgtcattgaatacacacaatatacacacatacactgtcatatacgaagtaaaaggaaactggtgactgttgatccatgagcattggcttttgaagcccttgaatacatgtgtaggcaagaagctgtactttactcttcgaacatcaaccttggatggatattgatgctgttttcagtaggggtttagaatgtggactttggaaactgactgttaggtttgaatcctggctctgctattatttgttgttttatcttgggcaagttgcttaacagttcttaagtcttccccatttgtgaaatgatacctaccttacagggaggttaggattaagtgagttaactcaataacatgcttacagcaatgcctggcacttagtaagagatcagtattagttgttttggttattattccaatcttttattttccctccaaactctgtctccctttcccttccccaaagttagctggaaatttagatggaaagtcatagtttttattcagattcagtttcccaaagaggtcactggtcaattaggtacatacttcttcttcctactaaaatttaataacaactataccttattttgtaaatatttgtgtgcttttatggtatgatttctaaccagaaattgtccacattcagtgattcactaggagcatttacaagactcagcacatggttgtacttatggctgtgatttattacagcaaaaggatacaaaacaaaatcagtgagaagaaaaggcacatggggtaaagtccagagtaaatcagtgtaagcgtctaagggtcctttcccagtggagttacatgggatgcgtctaattcctcaagcaagttgtgacaacacatgtaaaatgtttaccagggaagctcattagagactcagtgcccagggtttatattaggggttgttaatatagacactctctgtctagcatgcaccaaaattctagatcctagaaggaaaacaggtattcagcacaaaccacattttttgtaaagtgtaggcacactgagctgttcttactaggaaatagtgggaactgtcctgaaatctaaatttccagatgccagcgaggggccaaccttgcaagcagacctttctagggatagcaatctcaggcctgctgtgttaactcttttctgtaccatggtatgttatgaaatgtattttacttaagaaacgaatgtcaacaaatctagacatttaaaaaaagctttattgagatacaattctcacattataaaattcaaccaattaaagtgtacaatgcagtgatttttagtatatttatagagttgtgcaaccatcaccagagtctaattttagaacattttcaccatctcccctccaaaacccttactcattagcagtcatttctcattcccacctttcccctccctcaagctttccccccacgccctgccaatccctaggcaaccactaatttactttttgtcgttaaggaacaaatctatactttagcatgttttcatttttatttcatctctgatattagtggctttgtaaatggtaccttaaaaattattcacaggtattttacttccagtgtgtgagtcagagattcagagtttgagtctatatggcagcttctatatctagagcacttatccacactaatcatcatcaaaacggatattacatgagtttgggatatttaatgaaataattcattataaaagcccttgtttttgtaatgttcgttctcacttgtttaagagtatataatacaattgattgaggcttaccaatgataatttttatatttatgggttgacatttagtcttttcacggtatctttttgctaaaagagagaaagggactcatagtgaacaggatgaagttgggagaggtagttatgctgttgccattcagacgtagagaggggaaaaaagcatagattgttaggaggtaatggacaaaaagtattcctttattataagtggctgttaattttttggcattctctgatgttggtacaatatacaatagcaaatgaaaagtaaatttacatgtgaatttatattgaaccagaagtaaaaattttttaagttgtagaaaattttcaattttaaagcaaagatgcttgtgtgtatgtttttaaccattattttggttgaaatctagtttctctgaaatttgggttagtaagacaagctgtactataaactgagcactgtgggaggatgtttgttttgtgattaaaacagaactttgtcatcatgagttacataggtattgactaaacatgggtgtttacctaaatgtccaaatctgtgtaagttcttatgcttttgaaataaaagctttacttttaatgttaatacatgtttataattaaaagggatatttttggacattgggaattaatatatcaaatgatctattccctgggacaaagcaccagctctcagttactcacatccttgtcttccaggtgattttacaacgagatgctgctctccatagggatgctcatgctgtcagccacacaagtctacaccatcttgactgtccagctctttgcattcttaaacctactgcctgtagaagcagacattttagcagtaagtacagtaaaatttattcatgtctagaaacatcccttaaagaaaagcttaaaaaaagcctggaatgatatttataagacattgttataagacatttttatctaaaaacataccccaacacatatacacagttacttgacattgaggtaccttattcatttgtttatttattttttgagacggaatttcattctcgttgcccaggctggagtacattgttgcggtcctggctcactgaaacctccacctcccgggttcaagcagttctcctgactcaccctcctgagtagctggaattacaggcgtgtgccaccatgcccgactaatttttttgtatttttaatagagacagggtttcaccatgttggccaggctggtcttgaactcctgaacctaaggtgatcttcccgccttggcctcccaaagtgttgggattacaggtgtgagccaccacgcccagccccttattcattttctattgcttcatatctaatgtaagatctcatgaacaatcagtacctgataaataatgttgctcatgagggtatgtgtgcacatgtgggtgctttgcacacatacctacctgctgtgtgcttacatagaattttactgtttttcttggtacctagtacatctcttaatgactgtaagatctcagtagtatctctattgataataatatttaagaaattctataagatgttcatagaaaatttcaacccaagattagcattaatgaatcagaagagaagcacagtggtcctatctttgatggtggatagaaaagtttttagagaagaagagtgctgctcaaaaccttagcatagcctctcttagctactgtcttactttcctccacactggggagtatacagatggtctccagcttaagataaggcttgactagtgagctttcgactttatgatggtatgaaagtgatatgcattcagtacgcacctcaacttatgatgagattatgttccaacaaccccatcataagttgaaaatatcataagtagaatttgacttatgaaacatttttgacttagatattttcagtttatgatgaatttatccagatgtagccccattgtaagttgaggatatatattttctatttctctttttctgtgaaggtagaaaaagaacatacatgcctatactctaggtctgtgctaaggatttggttttactttctgggtgcaactgatttgcttaatgatatcaggtgagaaataaaagggcaagaattgttgctgaccaaagcttgatgtggtccccagctgtgcttctgcacattgcagtaattctggaagattctgagatcattgtagcacttgagagagccaggctggtttccataccacagcttttgaaggcagaggatgctagtaatccatacgagatttctaaccccctgttgtcctctgtagtagggaactggttgattaggtttgttttggggaatagtcttggtctttttgaggtggaatggaaatagagcctttaaagactgagtccattgctatccaaatctcccttctaaattggtccctaaaatccttagaatattcttggcatgacttttgaaatgagttagaggatttatggactgatcagggaataaacttctccttgtctcctttctctcctttgatttcttccattttgtgtctctctttttccctctctgttgtttttaatactttttgccttctttctttcatttatacccaaggtggattgctattctgtggtggagctccctgatgggttaaatgattttcagtgttgtgctctgggaacttaagcagatatataaccttgatcaaattactcagctgctataagtgccacagtttctttatttcttcatgtaaactggagtgttgtggtggtgattaaataagataaactgcttagaatagtatctgacacatagtaaatattttatatatggttttaatcttcattataattatcattctgattatacttcattcagccccttgagaagatacaaaactacctgagctgtattttttaatttagagacaaaaaaaaaatgttaggtatggaagaatggtcaatcctttttgccagcagtgttccttgtgctttacacaggtacttgtggaatgtatgttgatgtcctgtagtgaaggaactgtaagatgggagctgcttaaatctggtctctatgctgtccataaggatagaaggctgacacgaatgcaaagatggctggaggggagtggcttgtgaaagcatataactggtaaaacagggaactaaaaattgagacagaggaactggatgtgtgacaatcattcaaaggaagtgagttaagaggtagaaaataagagcacctccttttaatgcaataagagcatccctgaaatctgagtttgcagtaatacagatataaataaattagacatctagttccagtcaactaggttgattctagttccatttgcacagggcttggggtgctgcttttgaaaaattaagttttagttatgctatttgtaatgccagatgcctttgattttttggttggttggttggttgttttgttttgtgttttttttgttttttgttttttgtttttggcagttgaattcaattcacagacaacagtgtttgtccaagtagttgttgagttctaagaggctatggagatgctactgtagcatctagtctatagctgactagactagctgactagtcagacagacctctaggccatgagtacttggaaggcaggactgtgtcttactaaactttattcctggtgcctggtgtcagttacacaggaattcaataaacgtttgaagtaattaaaagccttctcttagagattttgtaccatcacattttcttttaatagcatctgttccttagtacttttagattactgtttttatctcttatcatttttcttttacccaaaaagaaacgtaatactattaattatgtaggtttatactagaaacatggaattttagaattgcacttaagagagaactacatcagtgctgtatattctgagactcagagtccacaagtgacatgttagttttgagtagtgcccatgattttactgagaagtaacatccatcttatatgagagtcaaacaacccatgtagcttgatgcccagtctgccttttgattcttttgtctggatttgtcagagagaattggttgctgggtagtgattattgagggccagtgtgctgtgtagcaaagaaacacccaatgggtggtggtgtgaatggattggattatatagcatgggtagtccaggctccagaaatggatttataatcagagttgaaatccagctctaccactctatttgcatgaccttgggcagattacttaacatttcttaagtcgcagttaactttgtaaaagtgagagtttgtgaaggacagtgcagggtagtgggttaagggctggagctctgtggccagactgcctcggttagaatcctggttcttctaatttaccagagcttgttattttcaacattctgttgtcaatctgtaaaatgaggatgatagtaatagtggcctactttgtagagttgttgttaggattaaataaattattacctgtaaagtgcttagcatgatgtctgtacataatgagtgctcagtaattgttagatatttattactttctaaattcaattaaaccttttgttaaggaagctgtcaagaaaaataattggttaaggaaaagaccttttcaaaataagtggagtcaaacttatgtggtaatcactaagaatgggattctagtgaggagtaactattttctacttcagatttttttttttttttgagatggagtcttgctgtgttgcccaagctgttgtgcagtggcgcaatcttggctccctgcaacatctgtctcctggattcaagcgactctcctgcctcagccttgcaagtagctgggattacaggcatttgacatcaggcctggctaatttttgtatttttagtagagatggggtttcaacatgttggcctggctggtcttgaactcctgacctcaggtgatctgcccacctcggcctcccaaagtgctaggattacaggtgtgagccaccacatccggcctactacttcagatttttaaacagtgaacatgctttaattttatgagcatcgctcccctccctccttataccaaaaacgtaaagtacctttgttagtcttgttcactgtaggaacattttttgttttaaacaatatgattttaagagacaatatgaaacaatccttattttgctgttaaggaaagacaaagcagtttcaaaaagggtttcattcagtaacaaaacttattccacatctcagtgttacaagtactgtagttcaagctagacattttatttctataattttagctataatagtgaaactcttaagtaataggaagagataaaagaatactttagtatagtttgtagattccccatttcctaatttcaaaagtacattaaaaaatactgcttacacacatttgtattttgtcctcattctatttccattgatctagataagttactttattttacagtgacatctttggctgggatgaattaaatgtttttctcaagttcaacattaacctgatcataggtgaattaaatcaattaaatgtgttttaattaagagattaaacgatagattgtgataatgggtttaaaagcattttgtaactctgaagtactttgtaaactatggagtactctgcaaatatgaattattgttgcaatgggaaatcacgctgaagcaattaccacatatacttgatggcctccaagtacactgctaggatgattatcccagcaatgacagaatgaataggtttagtgactgcatttagatgcttgaatcacacagtttcctgagctaattacaagcatacagtgagaggcaaaggtataagatggacatgctaagacactcaagatagggttccagtgggatgcaagaaccacactacctgaatcctgggtcacttgttgtagtttgtccagtcttcctgtatgctgcatcaacttttcctgctgacagtgtggtatggttaccaggacctgagttgacggtgagccaaggagacttgacagatgaaaggtgtctagatccaacatttgcttgctgtactggagagatgcaaggcaactggtcacagctgtaattggctgttaaactgtggagttgcttatctgcatgcctctggcagatgacataagaggctaggatagcgttaaccaatgggtgtttgattcagggatgacgtagctatcagtctggatgcgtgacttaatccatgctttgtgaatacttaaggtttacttgatccttccatcttttcttatctatatataacactcttgctttcttcctttttgtctatcttcaaaccatcctttgtatctatatgcaaaacaaatgtgttctttttttttgtatttatgtcctacatgttgtgaacacttcccttaatttctagtacatcattttcacttgtgtttcaaaagttacttgtttactatctatacttgtttactatctatgaaactcaggtttcatccatttcccttgtttctcttgctctctgtatagcaaattgaacattattaaatgatacagcaaactcatctcacaattattatcattactgttatcttctaaaagcacaaagaacttttgttttgttttggtaaaggactaataaatattgtagctttggaatctatatctgtgtggaagggggaaaattgttaaagagtttgaatacctccagctttttccgtgtatgtatttcattgaatttggtcttttcagtgttcaaccctggataaaaatgttcagcttatacaaaattgacatgccttaaaaatatgatatgatgctgcttctttccaaaaagaaagtcatttttcatagctagagccagaaatgctgtaaatttcttccagtaaatcagacctttataatacagagaaattaaaatggaacactcctcctggaagatgatctgtctggaaaattccttgctaggaaattgtctatgggaaaaactcagaaaacagtaggctgaattagtgttgctgctcgataatatttgaaataataatccaatttaagcagttgtatatgttgtaaattatatatattccttctattttagtggatgtacatttacaaattcagttttattttgataagctgtgatagtaatcagaattgtcaaaataataattatacataattaaataagtctttgtttttaatgttatatataaattggtcttaacttgaatatttaaaattttatttttagtataactttgaaaatgcatctcagacatttgatgacctccctgcaagatttggttatagacttccagctgaaggtttaaaggtaagacagttggtaatacattgtaaagacacaaggtatttaataaggtgatttttattgtttattatttaaagaatgaaatcatttcttactatttattattataaagcctatatatagtcatttgtaaagggtcagattattcaaaagatatcagaaagaaagtgaaaatcacctaggattgtattattctgaactagctgtgtttaacattttggtatatcacatttcagacctgtttttttaggatatgtgctatgcgtgtgtttgtagatgtatgtatgtgtgtgtacatatatatatgtacacacacatttacatatatatgtaaatgctttcatatacagtaaatctgtatttaacactaatagaaacatgctatttggttacctgcctttttcttttaattgtatgttttgatcatgttttttcatgctgataggtaaggatttacattattaattgtaacagctgcatggttttgcaatatcatgaaatagtatggattttgaacattgctttagtttttcatagtggatatttaggttgtctagtttttactattacagtgctacaatgaatgtttttgtctttgtgtattcatccatttatctccataggatacatttccaaatgtagaattgctttgtggcatgaatgtttaaagttttgttctgtattttcagttcttcctccaaaaagtttggaacgatttagaattctatcaataacatctgagactgtccttttccctataccctcttaaatactagatattatcaaacttttgctaatttgattttaaaaaatctaatgaacttaaacatattttttgctgtgtgtgtgagagagagagagggagagagagagagagagagagagagagagagagagagagagagagaatggactattaatgctctttgcccaatttgaaatgaaagtgtccttgtgctttgtaagagttctttatatattggaagtatcaatttattgtttgccatatatgcttcagattatcccttcttcagtttttcgtttatcttttaattttttttaagatttcaaaagttttgtttaagtagttaaaaattcttctttttcctctacctctgggggttagaaagtcctttctcattccaagataatattagttttttgttatatgaattcatgaagttgtgtggatatgtaccatagaatgttttcagtttattctaattttcttaaaatttctcttttttttttttttttttttaaggtagggtttcactctgttgcccagactggagcacagtggcacaatcttggctcactgcaacgtccgccttctgggctcaagtgatcctcccacctcaacctcccgagtggctgagactaagtgggcaccaccatgcccggctagtttttgtatttttatgtagagatggggtttcgccatgttgcccaggctggtcttgaactcctgggctcaagtgatccgcccaccttagcctcccaaagtactggtatttcaggcatgagccaccgtgcctagccagaatttcttagtaagataccacaaacctattattcttaattaggatggcagacacctctgggaggggcattgaatttttaattattaaaaaaaaattcatagcattgtatgactatttctcataaaaatatttcaaccgaaaagtaatatacataagaaaaaggaaacaccttcttttattcttttcttacctatatgtagcagtcacacttccctcttcagagttaaatattatcagtgattttacaggccttcagatccttttctgaacatgtaatgctttttcattcttttttgttcataaacttatgaacatgtataattcataaatggttatcatttgtatatatgaaaagtttcttaattcttacaatggaatccgctctagctagttttacccagaaagggatttataaagggataaagatgttcagagtatcatagcctggacaggcagtttctaaactgttacaggaataaaacccagaaccaccttgcaggactggctttatagatgagtggtgcagccaatggaccctcacaccacattattttttctctcatcaggaagcctttgtggttttacctcacaacatttggcctcttctgccatccaagctaatcgaagagataccctttttcagactgtttccttacatgtctacttccaaatccaacacttggatttttctgagtgatagacttttggccacatagttacttgctacatattttggtgaaatacctagctatgaggaaggctgggaaatacaatgtagggtttttgttgttgttatttttgttgttttagcctactttgggaaggtggaatgcgtagtgggttcagaaaatttggagcaccgtgagtgacagatgtctactgcaataattaccctgcaaggctgggctgggtgcagtggctcacatctgcagtcccagcactttgggaggccaaggtgggtagatcacttcaggtcaagagaccagcctgagcaacatggtgaaaccctgtctctaccaaaaaatataaaaagtagctgggcatggtggcgcaagcctgtggtctcagctacttgggaagctgaggtgggagaatcgcttgaacccaggaaggtgaggttgcagtgagccgcgatcaagccattgcactccagcctgggcgacagagtgagaccttgtctcaaaaataaaaataaataaataactactctgcagtttgattcccctacttcttctgttttagaactctttccacagcagcatctataaatctagtatgttcctgttaagcactgcatggtattctgtaatatgaatgatcatagtttattagtaatttcctctttaaaaatacatatatatgtatttttacatttatgcattaaaaaatatatatgtatctttacatttatatattaaaaatacatatatacgtatatatgtgtatatatatacgtgtatatatgtgtgcatatatatgtgtgtgtatatatatatgtattttttttcccccaaagttgttatttctctaggatagaggtctggaagtagaattgatgaaaccaatgggtatgtacatctaaaagtttcatagatactgccaaattacctttgcaaaggctgtgctaatttattcccattaacactgtaggagaatacttatctccctatactcttgccaacactggatattatcggtctttctaactcttgccaatctgatgggcaaaagtattatcttgttttaatttgcatttctctgattactaatgatgatctggcaacctttctttcattctatcataaggagtcagactattccttctcactgaagagcttttctactgaataagcttattttaaagagctccattaattctcgataagcataatcttattggtgctcctcaattactgtgctactataaatttggtttacatttaaaagatatgttgatgagtttgtttattcactgcctgaccaaaaaaaaaaaaacggtgttagatatctgtctgctttttgcacttgacaatatagggcaagaagagaagtgaaatattctaacaaaattattggattattatgggtagcttttatagttgcgtgactggttttgccattgcccagaatcagaatttaaaatgccagccatgcaaagatttacatttgtttacaaggacttgataataatgaagtgaggtagctcactatagtattatgtctgtaaaaccaattaaataaatacgttaaaaatataactaatttaaagatataatatggttattatgagacttagctgaaaaatactttttttttttttttttgagacagagtctcgccctattgcccagcctggagtgcagtggcatgatcatagctcactgaaaccaccaactgctgggttcaagccatcctcccacctcaggctcctgtgtagctagtactatgggagtgtgctactgtgcccggctaatttttaaatttttttaggaatggaatcttgctatgtttcccaggctggttgcgaacccctggcttcaagcaatcctcctgcttcggcctcctaaagtgatgggattgtaggcatgagctactgcacctggccaaaatatcttactttttttattgagacggagtctcactctgtcgcccaggctggagtgcagtggtgtgatcccggctcactgcaagctccggccttctgggttcacgccattctcctgcctcagcctcctgagtagctgggactacaggcgcccgccactacgcacggctaatttttttgtatttttagtagagatggggtttcaccgtgttagctagaatggtctcaatcttctgacttcatgatccacccaccttggcctcccaaagtgctgggatacaggcgtgagccaccatgcccggcccaaaatatcttacttttaaactctgcccagaaagtttaggtgagatagtttttgtaggtctaatttatgttctatattttgtagcttttataacatccctggattccatcagaatcatttataagacttcagatatttatagtataatatatcagttgaaattctgtttacattctatttatatatgccccaatattaggttaattgtatttaaagcctttttctgtcctctcctgtatcttaaaaaatactattattcaagtataagaaaatgagaaagccaaggaattttgacctatttgaactttaatgcaaaaatgtaaatcttttcatggattaaaatatggcacatcagtgttacagaagttttaaaagaaagattttatttttgtatctaggtaagtcctgtgtttgtagttttatattttaattggctgtttaggaagttaccttttccagacaacctttttagaccttgtaacctttgagtaccattagtaattagtttacagttcttttgaacagtatatttatatgttttggcaaaattcagaactatacaactgttctttttggaaaacatgttttgtctttgaaaagataaataatgttacttagcagtataaatatactttcctacgtcctcaaaaaattggtaaagattacctttccccatccccttcccccactctatgcttaggaggccaagaattattattgtataatgtaacgtatgactctatttttacctttttcaaatggataaccaagtattaaagaatcattattgagtagttactatggtttggatatggtttttttgtccccaccaaatcacatgttgaaatttgatccccattgtgggggtgttggaaggtggggcccagtgggaggtgtttgggtcatgggggcagatccctcatgaattgcttgatgccattctctctctggctagatggaattagttccaacggaataggttagttccctcaagagtgggttgttataaagccaggacaccgcttaggtttggtccctcttcacatatgcccacttctcctttggccttctccatcatgttttgatgcagccctcaccagaagctgagcaggtgccagtgccatgcttcttaaacagcctgcacaaccatgagctaaataaaactccttcctttataaataacctgcctcaggtgtgctgttatagaaacacaaaatagaccaagacagtagtcaagactttacatgtggatttgtaatggtagcaagcaaggtctcttgctatactttttattatcagtataattggaataatttagttacacattgagggccagtctcaggagaacaagcttctccagatttcttgtttctatatttttaggaagtgccttgataggtggaggagataatgattgttaaaaaattgaaaacaagatttatctctgataaggaagctttgatcagtaagccaagtgtcagattacctgagtataattatcaatggcaaatctcattttcagcaacacagcttttgggctagatttgccatgatccatatatactgtgttttgtaacctggtagtcagggtatattctttatgttgaagaggaagaagatagaagagatgaagatcatgggatgcggatttgtcctagactatgctgttcctactatccagaacaaagttgcaaataagcagtttttcttatatgatgtataatttatttcccctcatcattattcattaaattagtgccttatatcatcaccagttaattttccacaaactaggcttgttctttgaaagttaatttaccagttaatttcaaaattcttattacaggaaatgattttgtttaatataaagtcttgagattagaagagagtttttttccctggtgaaggaaaatgcaaacattgcaaagaaatgtggttgtttggatgttttatttgtgttacgtcctttgcctgctttctttgcaggaaagaagctcagtgccacttagtgtatttttcctctcagaacacttacacagttttgtgatgtgaagaaagccctggttaaggctcaatgtgctggacttcctcacccttatgttacagtatcaccctcagtttataaacgaaaacaaaggtcagagttcctttttcaaaggataaataaagaaatagcattgtcaaaataaagagtcaaaccatctggttatacatgaaataagaattctaagatctaaggacattttcacatgcacatagttagatggtataaaaagaatacttttgaagtgaattttgagcttctaaaataaaccctttcctcttaatttcaaaaagtaatggttgcttattcatttattaaatgaagcaggaatatagcatttcatttgatttagaaaataattgtttcatcatggcaaattatcacttagagaagaggggagataaagacacacacacacagaggaagtcaaaggaggctcaggtttttgatttcataaatcaacacactcccttcattttctcattgcattactgggcatcttttttgttcacttagtagtttttactagattttcttagtggctttctcagttcaatatagctaattttttattcttctgctcatgaaaaaatatttttctcattagaagagtgatacatgctcaccattaaaattaagatgatatagatatgaaaaagaatatggctcatggagtagaactggtataattaaaatgaccatactgcctaaagcagtctacagattcaatgaaatttctttcaaaatgtcaatgtcatttttcacagaaatagaaaaaactatcttaaaatttatatggaaccagaaaagacctcaaataaccaaagaaatcctgaacaaaaagaacaaagctggagacatcacactacctgacatcaaaatatattacaaggcaaccaggtgtggtggctcacacctgtaatcccagcacttggggagcccgaggcaggtggagcatttgaggtcaggagttcaagaccagcctgaccaacatggtgaaaccccatctctactaaaaatacaaaattagccgggcatggtggtgggcacctgtagtcccagctactcaggaggctgaggagaatcattgaacggagatgcaggttgcagtgagctgagatcatgccactgcaccccagcctgggcaacagagagagactccatctaaaaaaaaaaaaaaatatatatatatatatatatatatatatataacgtgtatatataatgtatttatacataatgtatacacacatatatacatattatgcacacacatacatataacaaggctgtaagaaccaaaacagtatggtactgatataaaaacaggcacatagaccaatgctacagagtagaggatccagaagtaaattcacatatttatggccaaatgattattgacaaaggtgccaagaacatacactggggaaagggcagtctcttcaataaagaatgctgggaaaattggatatccatatgcagaagaatgaaactgaaccctcatctctgaccatatacaaaaatcaactcaagatggattaaagaattaaagcccccaaactataaaactattggaagaaaacatatggaaaacacttcagggcattgaactaggcaaagattttacagctaaaatcacaaaagcacagacaacaaaaagaaaaatagacaaatgatgctatattgaactaaaaagcttttgcacagcaaaggagtcaacagagtgaagagacaacctgttgaatgggagaagatatttgcaaactctccatgtgacaggggactaatatccagaatatataaggaatttgaacatctcagcagcaaaaagacagtctgatttaaaaaagggcaaatgatctaaacagatatttttcaaaagaagacatacaaatggccaacgggcatatgaaaaaaatgtttaacatcactaatcatcagggaaatgtaaatcaaaaccacagcgagatagcatcttaatccagttaggctgactatcattaaaatgacaaaaaaaaagacagattttggcaaggattcagagaagagggaactcatacactgttggtgggaatgtaaattagtacaactactgtggaaaacggtatggagatttaaaaaaaaaaacttaaaagggggtgggggagaactaaatatagcactaccataggacccagcagtcccaccactgggtatttatccaaaggaaaagaagtgtatcaaagggatacctgcacttgcatgtttattatgtcactattcacaatagccaagatgtggaatcaacctactgtccatgaatagatgaatggattaaaaaaagtatatatatggaatgtaatactatttggctgtaaaaaagaatgaaaccatgtcatttgtcacaacatgaatggaattagagattattatgtcaagtggaattatacaggcagagaaagaacaaatatcccatgttctcactcatttgtaggagctaaaaaagttgatcttatggaggttgagagtagattgatagataccagagggtgagaaaaagatgtggttgagagggggagatgaagaaaggttggtcagtgggtacaaacatgcagttagatagaaggtataagttctaatgtttgataacagagtagggtgactatagttagcaataatgtattaagtatattttgaagttgctggaagacagaacttgaaatgttctcaacacatagaaatgataaatactcaaggtaataggttcctcaagtatcctgacttgatcattacacattttatgcatgtaacaaattatcacacgcaccccataaatatacaaaatattaaatgccaataaagttttaaaagaatatgaaaatcatacataattctacaattaaagattataatggtagatgtttgggtacaactgtgtgaacttatgtagacacattcatgccttcattttatgcacttatatgtgttattttgcaacttaaaaaaattggcaatatgttggatggcatatccaatatcatggatatcttcccatataaaaatctatacattcatatcatcattcaaaattatacaatttattatagtacttaaattacaccataatgtaaccaatcccttgtgtcattggacatttagattgctttcactttttaaaaatggaaatatttcaagcatagactagagtatgagaataacagagcatcctgtatatctgctacctagaggttaatattttactatttttttgaaagaagaaataaaatattacagatactactgaaacatcctttttatcctaccatattctgttcccttacctcgctccttatagatgatcattatcctgaaacttatgtgtatctttcctatttatgttataaaacatacatatatatattttttctaccatatatgcatctataaacattgtgcttccatttaaattttctttgctgtggttttaaaacttgcttttccatctaacactatatttgaaatttttgttattacatattcctaattcattttaactgttgcatactgcattttatgaatatgccacaatttattttttcattcatttgctggtagatgccagttttttactttcttttttagtgaacatcttttaaatatgtctccttgtatatattataactagatgccaattcacactcatcaaattagtaaaagtaggagtctaacaatatccacaactggcaaggatgtgaaaccaggtacttttatatactgctggtataaaagaatgtccagccactttgatgagtttagtaatatctcccttcttctgtaagtgataagtaataaaataattcattatattttacatttgatatattccctgtttcatgaaataaatgaatgagtaatcgtcacctttgaaattaacagaataactaatggcaatgacagtacccttattaaggtattgtaattgttctccctacttttgtttgcctgcactatcccttcttgccagttgccattctctttgaattctgaatactgaaataattcctctagttaggatctgaccatttccatcattatgatccctttaatcagattgataagcaaattgtatcaactttaattaaccaggttgtgttcaactataaactgagttataatgacaaattgcaaatggcaagtgctgtggtaagtaatgaatgagtgagggtcttttttgttgtggttgtgtttgttatgttttggaaaacagtatgttttatgtttcattaccaaagaattcctcttagtcttgattcttttttttattttttaagatggagactcgctctgtcatgcaggctggagtgcaatggtgcaatctcagctcactgcaagctatgcctcctgggttcaagcaattgtcatgcctcagcttcctgtgtagctgggattacaggcgtgtaccaccacgcctggctaatttttgtatttttagtagagacagggtttcaccatattggctaggctggtcttgaactcctgacctcaggtgatctgcctgccttggcctcccaaagtactgggattacaggtgtgagccaccacacccgggctacatttgttcataatactaaaggagaatttttctgatgcctgttaagttttcatggatttactttttgtatttgtttctgaactcttgctgtcaaagattttgttaagaattctgtagttattacatttaacctctttatgtttttacaggatttgtcaaatactatagaatatgaattatgcataaatattctttactgggttgtactgattatatggcaattgtagaggacatggattgctagtgtaagcacaatccacttagaattcttgtttttagagaaattattttgttgcatgtagctggaatggcaatgtttgattggaattttttttttttttttttttttttttttttttagaatgatgatgtggttgtagtattagtatgaatgtaactaccatagtttggatatttgatccttatgttgaaatctgatccctagtgttggaggtaaggcacaatgggaggatgtttgggtcagggaagtggatccctcatgaatggcttggtgacttctgctgtaatgaatgaattctcactcttagttcctgtacgagctagttgttcaagagtctggcccctctcttctcctctttcatcatgtgatctcttctcacacaggctccccttcaccttccactatgcatgagtggaagcaggccatcagaaacagatgctggtgccatgccttttgtgtgtgtgtgtatgtgtgctttcttgtatagcctgcagaactatgagccaaataaacctctttacaaattacccagcctcaggtattcctttatagcagtataaacgcaccaagacagtaacgtatcaattaaaaggcattgtcctccagagcgcacattcattttgttttctaaaatgtcaaggtatcatatccattgagtgaacacacattatctgtgtgtaccaaatgagaggcacacaccagatgaccttttcttcacagagctggaatatcataaaatcaaaatcctgacaaatcagtactgtgttaagtaaaacaaaactgaaggttatagtcattaaatgtttgccaattatgctattgttattgagaactaaatttgataaagacaaaaagaatgtcaactggatcttttatgatttccctttgcttaaatctctccatatcagctcaaataaaaaagaaattattgatcatatttcctagctttattctggacactatgatttgttgccatccctccctccttttttcttttaatgtcgaggtcactagcaaactatttatgtctgcagattaatttgaagtagtaaactttgggagaagatatttattaatttatatgtaaatgaaattttatttgcaatcaggttattctgatgatataaagaaaggtatagtggatgtttaataagatatattgtatttagatgggacaaccaaaattccaaaaccaagagaagaaaaattaggcatttggagtatatttctccttaaccagtgtgatctaagaaataaaaaaaaataaaaacaagcatctccataaaagtgtcttttctggctgtctgcagaagtggtacttatcaatggttacagtagactggagcctgtgcaaaggggctaaccctttcaacacattcatgaaacttctttctagatgttttggtgatatatatatatatatatatatgtataaaacagacattatatttgttgtaataatcatcaccattaatagtaaaagcaggaatatttaagatataacctcaaaagctgtcttgttcattgaccagccctataccctcctgtttcgtttttttgagagagagagtctcactctgtttcccaagatgaagtgcagtggtgtgatcatggctcactgcagccttccactcctggcctcaagcaatcctcctactttagcctcccaagtagttgggactacaggcatgcaccaccacagccagctaatttttgtattttttgtatttttgtaattttgtatttttctgtaaacaaaaaaattggaatagatgagctttctctctgtctactaattttgggttgcatttggtgttgtttttctagttccttgaggttcattgttaggtggtttatttgaaatctttatgcttttttgatataagcgtttgttacaggaaaggggtcccgatctagaccccaagagagagttcttggatctcgtgcaagaaagaattcagggtgagtctatagagtaaagtgaaagcaagtttattaggaaaataagggaataaaaaaatggctaccccgtagacagagcagcccagagggctcctggttggccatttttatgattatttcttgatgatatgctaaacaaggggtgggattatttctgccttccctttttagaccatatagggtaatttcctgatgtcatgacatctataaactgtcatggcactggtagtgttataggaaagggatcctgatccagaccccaagagagggtcgttggatctcacacaagaaagaattcaggacaagtctgcagtgcaaagtgaaagcaagtttattaagaaagtaaaggaataaaagaatgactactccatagacagaacagcctggagggctgctggttgcccatttttatgattatttcttgatgatatgctaaacaaggggtagattatttatgcctcccctttttagaccatatgggtaacttcctgaagttgccgtggcatttgtaaagtgtcatggcgctggtgggagtgtagcagtgaggaagaccagaggtcactcacgtcaccatcttggttttggtggattttagctgacttctttattgtaacctattttatcagcaaggtctttatgacctgtgtctagtgctgacctcttatctcattctgtgacttagaatgctttaaccatctgggagtgcagcctagtaggtctcagtctcattttacccagctcctattcaagatggagttgatctggttcagacacctctgacatgtttattactataaacttccctcttaatactgcttttgctgtatcccatatattttagtatgtagtagtttcattttcatttgtttcaggaaattttaaatttcttttcttaatttctttattcacccattggttattcaggaacattttgtttacttgccatgtatttgtgaagtttccaaggttcttcttgttattgtagtctattgtggccagaaaagatagtggtatgattgctactttttgaatttttcagacttgttttgtggcctaagatatggtatattctgaaaatgttccatgtgctgataaaaataatgtcttttctataactgttgggtgagatgttctgtaaatgtcaggacttttcggttattgattctttgttgattttctgtctggatgatctgtacatttctgaaagtggtatgctaaagttccctactattattgtattgtagtctctctctccctttggatctgtttatgtttgctgcatatgcttggctgccccatattgggtgcataaatagttataattgttatatcgtcttgcagaattgacccctttatcatatatagtgaccttccttgtctcttttttttttctttttttgagacagagtcttgctctgtcacccaggctggagtgcagtggccctatctcggctcactgcaagctccgcctcccgggttcacaccattctcctgcctcagcctccctagtagctgggactacaggcgcccaccaccacgcccggctaatttttttgtatttttagtagagatggggtttcacgtgttagccaggatggtgttgatctcttgaccttgtgatccacctgcctcggcctcccaaagtgctgggattataggcatgagcgaccgcacccggcctcttgtctctttttacactgtttgatgatttgtagtctgttttatctgatgtaagtatagctactactggaatttcatttttcactcttcacttttggactatgtgtatctttataggtgaagtggtttttttgtaagcagcattgtattgggtcttgtttctttatccatccagccattctgtgccttttaattggagaatggattccatttacatttagtgttattgatgagttaggacttttactgccattttgttgattgttttttgtattgtaatttttctcttcctttcttactgtcttcctttgtggttattttctctgatagtactttttaattcgttgctttttatttttagtgaatctgttacaggtttttgcattgtcattactatgaggcttacaaagccatcttataacaagtaatttaaagggtgacattttaagtgacatagaaaagaatagaaacaaaggaaaatgaaaaaaaatcttctacactttaactgtgtccctcatattttggcttttagttgtctcagttcacatatttttatattacctatctcttactatgttgctgtagctataattttttttgtttttctttttttaaacaattgttttaaatagatttgtcttctggacatagctagagttatgggtggattgcacaccacaattatggtgtgagtattctgggtttgtctatgtacttaattgtaccagtgcgttttagaccttcaactatttttttttaattttagcacattagtctttattctttcagattaaataatttttcttagcatttcttgtaagacaggcctggtggtggtaaactctctcaacttttgtttatctgggaaaaactttgtttcttattatttgaaggataactttactggatttggtattcttggatgataggtttcctttcttcctccctgcctccctcccttccctttttcctttctgctcctctttattccgatcctctccactcctctcctcccctcccctttcctcccaacccttctccttccctctcctttccctttctgttctttcctttctttctctctctctctttctcttgttattccactccctcctggcttgtattgtttttcaatgaaaagtctgttgccagatgaattggaactcctttgtatatcattttcttcttttttcttgctgcatttaggatcctctctttgtccttgacctttgagagtttgattagtgtatgtcttggggtagtcttatttgggtcaaatctgtttgttctctgaccttcctgtagctggttatttacatctttctcaagttttggaaagttttttattatttttttgaataagctttctataccttacttttgctcagctccctcttgaacacaataattcttagagttagtcttttgaggtaattttctttatcttgtaggagatctttattgcttttcactcttttcttttttctcttctgtgtacttaaaaaataggctgtctttgacttggctgattctttcttctccttgatccattctgatgttgagagcctttaatgaatttttcaggtcagcagatgtatttctcagttccaaaatttgtttgatttaaacaaaattatttcaattttctggttaaaattttctgataaatttctgaatttcttttctgtgttatcttggagatcactgagtttccttaaaactactattttgaattcttggttaaaaagttcacatattaggccgggcgcggtggctcacgcctgtaatcccagcactttgggaggctgaggcgggcggatcacaaggtcaggagatcgagaccatcccggctaaaacggtgaaaccccgtctctactaaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgcctcagaaaaaaaaaaaagttcacatattgccatcttgttagggttgcttgttggtttcttgcttcgtccatttggggatcatggttccctgcttgctcttgtttcttgtggatgtatgtcagtgtctttgcattgaaagattagttatttattctgttcttctctgtctggcttgttttggtttctattggatgtatttggttagaggttatttactgctaggttactgcctcctttttggctataggtgatgccttaagcttaggttcaccttggctctagtaaattatcaaaatgctgcccttcccaaaggggcagttcccaacagggatatcttggcactgtgggaaggctgactgtggaggttcatgcccagtggacctgtgggacaaacctactgtatggtgctactgaatagctactgtgatttggcatctcctttggtagaattacaaaggagggctctcctttccagggctagggattgtagtcctgcttcccctcttagtctctatctacctcatggatatttctcccttcaggtacttgtgatgctttctgtgggttaaggaagggacaaatctcctcctagggaacccaagatagtgggcaatctggttccactttggtcttacttttccagtgtagaaacagtgagttggagggaaattttccttgcagttggtgctcggcaaaatggggggaggggcatagtagatgtggaagtctgattctctgtctgctgggagttttttttacttctctgtggccctgggaatgatctctccttatatttgagttctagcttatttctggccgtaatctcattgctgtacatttgtttttctttttctatggggggagtcaaaccagcttgcttctgcatcatcattttggagctggaagccaacctatatggcttgagtttaattgctgtaataatcatgttgaaaaatatttcctacactatatgatttagcattggagcaaaaacttagtgtttgcagaaaggcactcagagcaggatgcaaatttaacaagaataaagcaaatattcatcattggaaggatgaccacagttgtacttcgttgcaaaacaaaaaccgagtgctttatgggattaagaagaggagctattatatgagcaaatgaaagagtgatacattttatacccaagatatgtacaaacactttccatatcacaagctgagcaatataatttcagggaggagaaattgccaaatcctgtggaatagatgattggtgtgaccagttcaggaccatacagaactgttgttaaggcattgtctcatagctttaattgcctccttcctttataaatgaaatcagtgaatttgatcatctttttatgtgtttattcactttttacaaaagatagacatttgatttttctgttttagtctgttaccagattttttttttttttttttttttccgagacggagtttcgctctatcgcccaggctggagtgcagtggcagaatcttgactcactgcaacttccacctcctgggttcaagccattctcctgcctcagcctcccaagtagctgggactacaggtgtgtgccaccatgctcggctaatttttgtatttttagtagagatggggttttgccatgttggccaggctggtcttgaactcctgacttcaggtgatccatctgcctcggcctcccaaagtgctgggattgcaaatgtgagtcactgtgaccagcctgttactacattttcttatgtcaaaccatcctgcattcctgggaaagcaacttgctgtttactttttaaattcatggttatctcgtggacgtcttttcagtttagtgtatacaggtcttccttatttttttaaatggctgcattattttcctattgtataaatatactataattgtttaaatagttaccttgtggatatgcatgatttccagtttttgctattaaaaataatgtaccaatgactgtctttccacatacaccttacatactcaggctagcatttctgcagaataaatttctagaaatttatttattatgtgcatttcattgtctgctaacatgaaagaaagttaatttttaagacatatttgcttggtttgaaaatgtcaaatattgttcgaaaatataccagtggttgtctttggggtgattggcttatgcctgagtttgcttattattattatttttttaacttcaatacaaaagatagaacttattttagaaaactaaatgcttgtgaaagcaaatgctgctttagaagttccgtgattgtgagcaattttacatgcccaatgatacatctagcataatgcaaaacacatgacaaatcgaaaagatatttgtagaagtaagttgattgatttactgagtgaaacagagagataatttttaccaattctttttcagggttttttgattaactcaaaaccagagaatgcctgtgaacccatagtgcctccaccagtaaaagacaattcatctggcactttcatcgtgttaattagaagacttgattgtaattttgatataaaggtatgattatcttttttcattttttgtttcctatttgttcagttagctaatttaaatcatttacatcctcccttgtttcagaaaacatttaaaatttaaaatccagtaagattgaaaataaactggattcatagaatagaaataatgtttactggttctaagaattttcaggcatttgttggacatcttgaactgtggtttaacagtggaatgttacttgatctcatctaggaatgaaaacttaacttcagcctttagttttatgcttttacccttccagtatcaatctcaaacctacatctatacctgtgtctacattgtcattgaggtttctcttttgtaataagttaaatctgcccctgtgtaaagttttttctctctgacatgggttaagctagcatttcagatagtaaaacaaggtttacccacctccgtcaccatatatcaccagtgctgctctaggtgtatggttttttaaagtctgttttgggattggcattggcaaaggagccacattgaggcctatgtaaaataaaccttgatgtaactgttactggactacctcagagctgagtgtcatatagtgtcttgcatgtatctcccagaataggacatgggctattatttcatgtcacttggtcttagataatttgtccgttcagcaagaaaaaccgccctgtcatgctgtgcatgaattttctctgcaattttgattgcatggaagaaatgatacctccatagtaaacttatgagaggaataaaataatataaagggatttgaaaatgtatagtactgtataaatgatagttattgttactactttatgttagttccaaatatagactctcaattgcctttaaatgggaataaattagagcttgaagtcaaagtagtagacttcctgctcctcagagttgtttatgatagtttaaatttaactgttttatccagaactaaactataataattacaggttgcttcagttaaaattaaatgttattgtaatgtttcattaatttcttgctgctaagaaattaaaagtaaactaattctattgatcccaaggtttactacactattatgctatgtaatttctggactcggtacagtctgataattagaaactagaatacttttttgctgttgttataactttcctttataggcagggatggcagatggtacactttgaaaattagggaaatactgttattgaatatctgtttttgaagatgaaaccacagctcaggaatgaatacagtaggcttgttagccttcttgtccctttagtggatcctcatcatgagtctgagtacttctaaaggagtttaatgatttagtcattactccagctcatctcttttcactgcttgccttgaattttatgttgcagccatactgcctacctgaactctctcaactggctgtgccatgctgatcatacatttgtgcctttacatgtactattttctctgtccaagatctctgtctccagtgatctttaccacccatttatctgtctcatcggttacatgctagctgaggatgttacctcctcagggagccttacttttctttctacttcctctgttgcagtgcagaccattccagctcaatgtgccacccttccactttgtaaatacttccttcattgctttttatcacattgttgttactttttattgaatatatatatctcacttatttgtgaattgatggtgtttagaattcatgttttagtcatatttatgtatccaatttgtattatagtgtgtggtaatcaataaagacttattaaatgaagctgtgtaatagtcttttgcttatgtgtctaatatattcttgaaaaacatgtacatatgaaaaacatggaagaagttttcagttgagccattctaatgttagacagggaaatgttaaaaaaattctcattgtactttaccatgtaggcacagtttttatgaataagggtctagtctgttgtacatgttctttaacttggttattttttcctccataaatacacagtggagtgtattctggccatttaaggctaaagattccttacttatgtcattcctaatgatttctgtctttgtcagagttgtataaatttctggaacatcagtttataggggagacacaatgattataatcaaggtctggaaacagactgtatacatttcaatctcatctttattatttactagcagtatgatcttggacaagttattttacctctgtgtgcctcaatttccttatctgtaaaataagaattataatgttccctatatgataggattgttgggaggatcaaatgaactaatcaatgttaaatgcctaccaaacagcaccttgcacacaggaaggaggcaagtgggtcttagctgttgatgttttatgctttttaccattagaattaaatagaataagggtaaagatggcaaaattcctgacttttcagaaattaaattgtctggtaagtcacatgtgatatagcaactcagtgtcagctgatgtaaaatttctgacttggcttataaagacagtttagtcatgccattgtggaaagtatgtttcataaatttgtaatagtaagaattatggatcacctatcaaggtagtgtgactgggtaaggataaagtcattatgggtactgggaaaacaactggaatcgcaccctaaagaagatttcctttctagagtggttactgatggataagctgttagccttattagctgtaattttcatatcagaaatctctgactgcatttaatgagcttccaaaatggttatatacagttttatattaagtgtgttgtggaattcagtcatcagtgttaatatatatctcttatagataatcagtagtggttcattcatgtatatccacaattttgtatgatgcattgacttaagatagttagaaaaatgatatatttccttatttattacatagcttactaggactgagtactgaggaaaacttaattcaactccatacataatactacaattgatggtagtgcagggttatattttggcatgcctcttatccaaagtgacatacaaattatctcagacaaaggagaattggctctatcttttaaaattttccttggagaaaggaactctttgttgtagaccacaaagagaaaagaaacaaggaataaaaatttatcgagttattccagatgattaatgttggtgagtatttcaggatttttacaactcttttagttttgttttaaacagattaaagaaacctacacttttcttacttctttaaaaggaaatgaataagtggaatgtatgttataatttttaaaatggcatattttcttcatacaaaccatcccaagtgatttgtgactcaaagatagccacgaaggcagcagaaatgcaattaacaattcctggaggaaagggaattgctttccaaataaagagagccattgtttaattttttatcttctgttgagagaagcacatatgaaccttttaatctgtcttaccttgaggagatgcagcaaaacccatgctcagaatgaatgtttgaatatgtagaatatccaaaaagccagtaagaagaactattgattacatgtcaggtacttattctaaaagtaatcacttacactgttttacaaaaactgtatcctctgaaaaatacagctctttagaggaaaagcgaaacagtgctattttgtctttgtatgatgctgttctttactgtgacaaaaattgactttgaagcattttgagggagatatttctcaaaaggcttgaattggcatcccagtgagaaatacgactttaaaaaaaatctgtaaaaatacctagtaattgaaaggccattaaaataatcacttaacattgaactttcagagctatacaattttctgtgtatataactgaataaagacaagttataaaaaaatctgtccattgtcatttcagtaccagatgctttcattacttgggtataatggtaagtcaccaatttctttgagtagccaatttactgtattttagctggactttagcaaaggctggtaaacagaaatggtgcaacatatgcactttattcagcagtgtgtgctgaatcttattctatcttatgtgtgaatgagtatttttgaaaaatgcagctgcaaagccatctaggccagttaccaagactgaaaggacttagatattattctcccttcccacacccccttttttgtgggcatgaatggaggtacatttggattgtagatgataaggaatatgttgggtctcttcagagctattttctgctgtaatgtggcttttataaaacttaactgggatacagatacaaaacttaactgggatactttacctgacttctgcctctctctcaagtctcatctctactttgccactcctcccacctcgtaagaatttacaagtccccatatgtgctgagcagtctctcccactctgtcttagtttctgtcatgtcctccatctggcatgtcctccttctacttgtctgtctggccaatctgactttattttaaatctgagataaactgtgtcctgtctgaaaccttccctgattttcttcaaggtagaagtcatcatatcttttttttttttttttttttttttgagatggagttttgctcttgttgcccaggctggagtgcagtagcacggtcttggctcactgcaacctctgcctcccgggttcaagcaattctcttgcctcagcctcctgagtagctgggattacaggtgcgtgccaccacgccccactaattttttgtgtttttagtagagatggtatttcatcatgttggccaggctagtcttgaactcctggcctcaggtgatccacccgcctcggcctctcaaagtgcagggattacaggcgtgagccaccacacccggcccgtatcttttatatactatttaatcccacatcagtctctgtttctctctgtgagagaaaaatatcatgttttagattctgtagtgctagtgcctaatgcattatatggcattggtagatgaataataaatatttgcaaagtgatttactttaaaaaccttaagggcttataataaaatgtgaatagattagagcctaaacagtatcactggaactttccatttgcttcatgttcatttcacttaatgcttttggcattatttctaagcctagatatttatttatcccacagatatttttctctagttctcaatgtttatagaatttttttaaattaccataaacatttttgggattatttgatcatatcataataactctttttctttctgtcttttttttttttttttttttggtgatttttttgttatctcagaaagtagccctctagttttcctttctagacttacctttcattacattatcccctttcaggccttcagtcaaacacattacttgtccccagaacatactctgcactactatttcagtagtagtaagcaagtagatacgaccttaagtagaaattaaactctgcaaattacctgaaagtcatttaatatcatttaatttttcataatgtatatatttctataaagtgatgtataacatttgttattaatctacttcagaatcatgtttaaaagattccactaaaggagcatattcaaggatattcgatggatggaaacagttctatccatatatagttcaatcaaacagctttgtgctgctaattcattcattcatttgttcattcatttcttccaccctttaattggtaaatatacttgcattttcatgattaggtttctttatacacaaatttattcaatattaaaataacaaagcaaaattcccttcttttaccaggaaggtaatctttcatgaaagaaaaaagctgaaaaatattaatttacatgtgctttattctaatctaatgaagcagtgtaatgccagtaactttatttatgtatctattccccaaacattcttttgcttcagaatttttacataggtatcctttaatcacagacatcagaatgctagaccatatacttttcaagagacttactgctttattttggactcaagcaataaaatgtattaaaatcaagatattcagattactcagatatactataaatgaacgatgtctaggtaaggaggaaagatgggatcgaaagaaagagagaaagatagtttttatcactgaactataatattaatgagagttaaaatgtcataagagcctgatactctcttctgaggagtagctcttctcaacatggcctgcagtagtcctaaaataatgtgcaggaaagaacaatgttgaaatggaatgtaatattggcaggattgcttgctataattctggatcttatttcaataattgattattcgatactgcaaagttcccaggaatttttatccaatagataaaattaatgatttacattcacaatctgaatcctcagatctattgctccattctcatctgcattgttttgatcacttgagaaagagattctacttcttaatttcttcttatttctttggactcaaaaagatgatcatagctaggttttgagaattatctctattctctatgtctctcattaatttatttcattttcttcccttatagaataagtactttttctcctctattagacatctgggtggggagaaagggtattttgtgtccaggctgatggttaatttactgttcctttgtggctatgctgaaggaagagaaaatcagttctccagagaacttttccattttgcacttggaaaggtttagaagcagagttagagtgtgttttctttagggaatctttagaaggtagacattaaagtgaaggtctagttgtgtcacatttctagaactgcaaaaacccaatttataactagaagtttgaagaggccaggctccagaaccatccagtatctgtattatgctattttctttttcgttttgacttttcacctttttgtgttttgaaagatggaagacacagtaaaagtatctataatgtgtatatgtgcaatttaaataatagtaaaatgaatttctgtgtactcaatacttagtttaagagagacctgttactttctaatgtatcactttaatcagacttcattaaagaccttgttatcaggtaattttttttttttttttttgagacagggtcttatactgttgcctgggctggagtgcagtggcatgaacatggctcactgcagccttgacctcctggggctcaggcgatccttccacctcagcctcccaagtagctaggactatatgcacactccaccatgcctggctaatttgttttgttttgttgagagggggtcttgttatgttgctcagactggtctcaaactcctgggctcaagtgatccttttaccttggccttccaaagtgctgagattacagatgtgaaccattgcatctggcctggtaattctttatcttcaagattttattccatctacagattatattaaatgagctgatcttcataatgagaaagctctatatttgcactaattttacattgatttcaaatgttttaaataaagtgatgttaagtataccataaagtgactgctcattaaagttactcattttttatcttgtgtttataatagcttgcaaagggaaagtctctttgtaaggccagaacaaattctagcaatactgtgtattttctaattctttctttttgctacattatactgttttcattacctctagcctgatcctaacctaaaaaacccatggatatgtcttttctaatttcagattcttgggagtagagcttatgttttatgcagttctgtgtactgagcttttagtacagtgcctacaataccagaaacaattaacaggcagtaatggaggagtatactcagagatctgtcgctgggtggcgctgaacatcaaaattcttactgtaattgctccatcacagttacttttcaagtgcaatggaagttcctgtgttacttgtgaaattcctagtaagctgattttaagtacagaaagttatcctcttgttgcacagaaagttattctaaagcctttattttcagtggtgggtgggctgaaatggggcctctgctatgttaggatgagaaatcattaagatttgattggaatatgaatcctatcagtgtctaaaaaatatgaacttagatcagatcctttattttaaatatctactttaatatacataggtaactagagaatatttatgaatagcttttttagatttaaattgcaattctgacaaatatttaggcagcttttaactagtatagtttattttaactggtgtggttcattacaaagtaaagatttttttaaagcagttttaacttaagcataacttacaagttttaacttatagcaagcataactacacataaaggttattcagattttcttaatgtcactgggaaaaaaagacgaatgtaatttaacttttaaattaattttaattttatgttattcattttattatctttagtactaatcatgttccagctacagtattaagcttcataatactggaaatagccacattcaaagacctataagctaatgactttgattttttgatgggatgttgcagaacatgattgttgcaacatggaacaatcatgttgaaaggcatcaatcttttttctgattgccaacaacctatggaatattaaaaactatctatatgagtgagtttcaaacttttttgactgcaacccacccacagtaagaagtttatttttacttgttccctagtttgtatacagcacacagtctgacaataaaatttcatggaatagtacttacctacactacctatacgataataacttggtatatgaaatttctttttattaaaaaataaaattcacttgggttcactaaatgactttactgcctggtaatggatcatgacctatagtttgaaaaatgcagatttaggccaatcttttctgtgtagcagtgaaaactggcagggacactaagaagtatgctttttgcctaagcacttctaagttcaaaaattgctttttatttgtaattttagtagtaaattgtgtctcccagtatttaaaattgcttgtccatatgccatagattgactttaaaatgatgccattggaaaaaataacaaaagatctttgtttttttttgagatagagtcttgctctgttgcccaggctggaatacagtggcttgctcgcagctcactgcaacctccaccttccaggttcaaatgattctcctgccctagcctcctgagtagctgatattacaggcacccaccaccaggcctggctaattttcatatttttagtagagatggggtttcaccacgttgtccaggctggcctcgaacccctgacctcaagtgatccacccacctcggccttccaaagtgttgggattacaggtgtgagctactgcacccggccaacataagatctttaataatttaagttccaagcgttttggcttctgttttttggtatactgtacttgaaacaaataagtatggctttttgtataacacaagattttactagccctaccaaaaatgttttctaatgaaataaataaattcagcttacctctaagcttaacatgtacagtggtaatatgccacttagcaaaaggtcaactttcccagaacatagcctcagagaagagaaggaaacatgcctttgtaccaccattatgaatgttgctaagcttcagcgttaaaaccatgtacttttcctggcagtttttctcagaattcttatgcacttaattttttttaaagaatagaattcttatcgggtttagttctttttttttctctgccacagagaaggatatacagatggaggaagtccagaataactattagtagagtaccagtggtaagcacagagagaggaagtaacatatgacacttaacattaaggagaaaaactatagtctgttgaagcatgttcatgatgatctcgagtaactggaaaaggtcaagtcacatttggtgaaaaggtggggaaaatgcaacatatcacaaaaatttttatccaaaatgactaaagtaaaatttcctgtgtgctttcgtggagggtgggtgggggagggggtaggaaggaactaaccaacagatacgaggaaattttatttttttgacttatatattgctggatagggctggataatcagttaccttagttgcagtttactttaaacaactatttatatgagagatatttttctaggcttgagatatacataaacaaaaaagattgttcttaaggaacattaaagcctggtacttaaaatgctctaaatgttattttgtcagatctctgtttttcaaggtgaaaacaggcttagttttctagtaattaatgtttataccaagaagcatgaaaacagatcttttgttaatttttaaagtaatactctgaaacatgaattttcacaaattttgcttactagtattgtgctatgcacttacctttactaagtgcaggatgattttgtttttattttcaatttgagaccatgatgaaattagtccatatttatatcatgtttttaatgagccatggtagttgaaaattaatctatttaaagttaagtatgtgaagctggcctgattaaaatgtatcaggttgtcacagtactcagctggatatttaaaaaataatgccctcaagacaaaagcttgtggttcatgttacaacaaagatgaaaatacaggtatacttctgaagttaatccattgttagtaactaccaagtgttttttcttaaacagttttaaaataagccccatattttatgtcttatacattctctctctgtacaacagcagcattctcctacatgtagttaccacacttaagaaatttaatattgataaatattatctaataatataaactacatgtttaaatttcctaattgtgtccaaaatatctcttatagttgttttctttttaaccatttcaggatccaatcatgaatcccagactaaacatattcagcttagttgtcatgtctcctttaatctacaacagctcttgattctttttttcctactttgtgcatttctgtgtttcagtttaataatttctattcctttgtcttcacatttactgatcctttattctacaatgtctataatcttttaagcccacctagtgaacttttcatattgtatctcttttatctaggagtttcacttggatctttaaaatgtgtgtgtatgtgtgtgtgtatgtatcatccatttctctgagccttatgtttatattctccttcaaatccttgaacgtaatttataattttatgtctttatattacatgtaaatgtattcttataataataaattataatttatagctgttttaaaatccttgtctgctattcataattccgtatccatgtaatttctgggtctgtttctgttgaatggtttttctcatggttatgggtcacattttcttgcttcttggcgtgtctacctttttttttttcaactttcattttttaagttctggggtacatgtacaggatgtgcaggtttggtacataggtaaacgtgtgccatggtggtttgctgcacggatcaacccatcacccaagaattaagcccagcatccattagctattcttctgatgctctctctcccccgaccctccctgagaagtaccagtgtatgttctccaccctgtgtccatgtgttctcattgtttagctcccacttataagtgagaacacgtggtgtttggttttctgtttctgcgttagtttgccaaggataacggcatccagctccattcatgtccctgagaaggacatgatctcgttcctttttatggctgcatagtattccatggtgtatatgtaccacatttgctttatctagtctatgattgatgggcatttgggtcaattccgtatctttgttgtgaatagtgcatgtctagtaacttttgattagatgttggacatagtgttgtattgtcatatgtcttggtctttaaagaccttttaattttgttgtggctggcagtaagttacttgcagatgagcttggttattttcaggcttgtttttaaagtttgttaagttgatgaagagttgcctttactgtagcactactattttagctgtactaataaggtataacccttctagggtgtcctctgaatgatctagtattcaaggaagtctcccctctctggctggtcagagcttgaactcttcctgatcctgtctgaattctggaaattgttaatcttttttccagtaattgtttttttttccctagtgagcttgtttgtccaggcttataaggtctcactgtatgcatgcatatgccattcttatatttagccaaagacctaaagggaacccatctacatttttttttagttttttatttaaaatttttgtgggtacatagtaggtgtatgtatttataggatacatgacattttttgatacaaacatgtaatgtataataatcacatcatagaaaatggagtatctatgacctcgagcatttatcctttgtgttacatacaattcagttttactttttagttcctttagaatgtacaattaaattattaactatagtaaccctgttgtgctatcaagtactaggtcttatttattctgtgtgtgtgtgtgtggttttttttttgtacccattaaccatccccatctccccccactacactactctcttatctccatgagttcaattgttttgatttttagatcccacaaataagtgaaaacatgtgatgtttgtctttctgtgcctggctcatttcacttaacatagtggctttcagtttcattcatgttgcaaatgacaggatctcattttttctaatggctgaatagtactccattgtgtctaagtaccacattttctttattcattcacctgtggatggacacttaggttgtttccaagtcttggctattgtgaacagtgctgcaacaaacatgggagcttgggtatctctttcatatagtgattttctttctttggggaatatacccagcactgaggttgctggatcatatggcagctctatttttagtttttttgaggaatctccaagccgttctccctagtgattgtgctaatttacattcctaccaacagtgtacagggttcccttttctccacatactctccagcatttcttgttgcctgttttttttggataaaagcatttcaactggggtgagatgatatctcattgtagttttgacttgcatttatctgatgatcagtgatgttgagcacatttttatttgcctatttcccatttgtatgtcttcttttgagaaatgtctattcaaatcttttgcccatttattaattggattatcagacttttttcctatagcattgtttgaactccttatatattctggttattgattccttttcagatgggtagtttgcagatattttctcctaatctgtaggttgtctctttactttgttgattgtttcctttgctgcgtggaaggcttttatcttgataggagtccatttgtcccttttgctttggttgcctgtgcttatggggtattactcaagaaatttttgcccagacaaatgtcctggagattttccccaatgttttcttgtagtaatttcataatttgagatgttaaatttaagtatttcatccattttggtttgatatttttatatggcaagaaataggggtctagtttcattcttctggatatgtacctccagttttctcagcgccattcattgaagagactgtcttttccccagtgtatgttcttgacattattgtcaaaaatgagttcactgtaggtgtgtggatttgtttctgtgttttctattctgttccattgttctgtgtatctttttatgccagcatcatgctgttttggttactatagctgtgtagtataatttgaagtcaggtaatgtgattccttcagttttgttctttttgctgaggatacctttgtctcttcttggtcttttgtggtttcatataaattttacaattgtttttctctatttctgtgaagaatgtcattggttttgatagacattgcattgaatctgtagattgctttgggtagtgtgggcattttaacaatattgattcttccaatctatgaacatggatttttttctcttaattttattttggattgttcattgctagtgtatagagaaacagtggatttatgtatattgatcttgtatcctgtcacattgctaaactggtttattagttttagtagtttatttgtggattctttcatatgattgattgattgattgatcgagatatcatttgcacatacatatagttttacttcttcttttccaatctggaagcattttatttcaatttcttgcctaattttcctggctagaactgcctgtacaatactaaatagaagggccaagagtggaattcttgtctttctgatcctagagagaaggcattaagtcttttaacctgaagtatgatgttagctgtgatttctcatagatgctctttatcaggttgagttcacttctatttctgttcgttgagtacttttatcatgaaaggatatgattttttcaaatgtatagtgttagtagtatccaaataagttttgatatgttttgtttttgctttcattcatctcaaagtattgtaaaatttcctttgtgattttttgacccattgattaggagtgtgttatttaattttgaaatatttgtgaatttcccaaatttccttctgatgttaatctttaatttcattccactatgatcggagaatatactttgtgtgatttcagtacttttaaagttatccagggacgttgaagaggacaggagaaacagacttgaatcgctgacaccacccttcttcattccccgcccgcttcccggcagcaaccacgcaatgcagagtctgtgcactaggagtagcgagagcacagtgactagaggactttacatggaactcagtgctgccctgtcacacagttcaacaatgatagttggagactgcaatgccccaatttcaataatgaatagaacagcttgtcagaaaatcagtaaggaaacacaagacttgagcaacagtataaatcatctagaccaaaccgatacctatagaatgttccatccaacaacagatgttgatctccagggctcaggtgatcctcccacctcagcctcctgagtagctgggactacaggcatgtgccatcacacccagcttatttttaaattttttgtagagatggggtctctttacattgccaggctggtcttcagttcctggaatcaaacaatcctactgtctcagcctcccaaagtgctgggattacaggcatgagccaccatgccctgtcttctagaagtctttttgcagattcatttaagtagatgattatgtgaactgcagataaagactgttttagtttttcatttcttcatccatatgcacttttacacactctctcttctctcctctccctttgccctactcccaccaccttattgcattggctaagagcttcagtacaatgttgaatagaagcagtaagagtgaatatcttcattttgttgctgttactaaggagaaagcattcagtcttttaccagcaaatagaatgttaattgtaagagttttgtaagtaacactattaacagaagatattttaaaataatatgaagccaagttcatacttgaacatgaaagttgattgggagcaaaaagaaaagaaagacgctttaaagctactgaagacatcatgagtaaattggaattcaagaaaatgtagtcattctcttcctagtgagtaagcacttaaaatacaccttgagagaggtgtatttttatatttattcctaaaccatggtagatgaattttcccagtatttattacttttttctacttctattcttattagtttacttgttttagtaataaaattatgacttgtcactgaaattttcctctacctcacatatatttttattctgcacgcattactgtttgacatatttcagtatatcctcttttaacttcccaattaaaataaatgatctatttgtacttataaaaatgttgaaatagtgaactaaaatttatgttattaaaattagaagagagtatatttgtaaaagctactatttatcatcagatatcttttgcccattatctgaagacagatgttctcagaaacactgggcatttgcaggaaatgaatgtatgctgttgctggaatatcctctgtctgtctgaagtagtcctgcttttgggcttgccttttctctgttcttcaaacattacaaattactcttcgtgcaaaacagcactataattcagataaaagttttagaacttgaaatgcagatttgtatttcaagtaaataatgttctagttctaagtatgtatcattttacatgaatatccagactcctgtctaatataataactggattcttttcaaggttattgttcaccagggaaagtcacctctcttacatttttaccattcttgcaggtgtgtagcctggacatatacacatgtctgcttatttgcaacatctcttcccagagaaacaatgaagtacacttaacttcgttcatatatagaagttaaagaggattgaagattataggaaatgtaacaatgtgaatagattgcattttattagaagtttgttttaaacaacaaggtagccagatttgtctttttttgagatggagtcttgctctgtcacccaggccgaagtccagtggcgcgatctcagctcactgcaacctccgcctcctgggttcaagcgattctcctgcctcagcctcccgagtagctgggactacaggtgtgtgccaccacgcccagccaatttttgtacttttagtagagacggggtttcaccatgttggccaggatggtctttatctcttgacctcatgatccccccgactcagcctcccaaagtgctgggattacaggcgtgagccactgcacctggccccagatatttattgaatgaatagattaatgtgctgaaaatctgaatttgagtgtgcgtgtgtgtgtgtgtgtgtgtgtgtgtgtgtgtgtcggagtcttgctctgttgcccaggctggagtgcagtggcgtgatctcagctcactgcaacctccacctcctggattcaaacgattctcctgcctcaacctcccaagtaactaggactacaggcgtgtgccaccatgcccagctaatttttgtatttttagtagagacggggtttcaccttgttggccaggatggtctttatctcttgacctcgtgatctgcccgactcagcctcccaaagtgctgggattaaaggcgtgagccactgcacttggccccaaatatttattgaatgaataaatagattaacttgctgaaaatctgacaatttttttttttttttttttgagatggagtctcgctctgtcgcccaggctggagtgtagtggtgcgatctcggctcactgcaacctctgacttccgggttcaagcaattctcctgcctcaacctcctgagtagctaggactacaggcgtgcaccactgtgcccagctgatttttgtatttttagtagagatgggatttcaccatgttggccagactagtcccgaatttcttggccagactggtcgaactcctgacctcgtgatctgcccgcctcagcctcccagagtcctgggattacaggcatgagctatcgcgcccggcctgaacatttttgtcttaagttctaacctgttgtgttctacctacctaggaaaacttgctacctctcaaatttagtatgtttaaagccagtctctgctactttcctatcaaaacaaagtttctcagctttcctattttggccaaaggcattctccaagttccctaagttcaaaaattggctatgaagtataagagatagtattctttcacgtcattgctgtcatcctgcattgtcataaaagcttctaaatcttcagtctctcctttccaagtcaatgtaatcattaccagattgttccaaagcagtgttttagccatgtcaaccccttattcaagtgcctactgtgaactcttgactgaggagaccacaagtctacttttctaaagagccttcagggtactgcacagtctgtccttttttttctctctcttctcacttctgactgtccaacaataaacactagtagcaatggcaataaacataactcttagtatgtgccaggtaatgtttaagcactgttttaagtgtttttcatatattaaattatttaatcctcagattaaacaataataaatgtgtatattgtaatactagtaatgtagacattaaatcacttgcatgtctaataaaagtaggatttgagcccaggtcgtctagttcccagagtctgtacttttaactaatctgccattctgcctttcagtaacactcttctttaagtcaagtcactatgttttttgttttgttttgttttaaatgtgtcttttaagataccatttgccctgttgtagctctcttcttcccatatgaaaaaatatccccaccttttcccactgttaaccagaatttcctgtttttattgaggtgtaattcaagtcttataaaatctgtcataggtatttcatcccacagcctttttccctctaagtttctatcagctcttcacacaatattttaacacatttcttcttggcttgtgttgttttgtttataggttttattttgcccacaagattttaagattaatgttatctgcatcttgatgctttctcagttcaattcctctttctagacatttgtaaaatgttacataaggttaatgatcctgagcctcatcctgatccattgggcaaccccatgcttctctatctaacctgacaaagcagtgtttaaatctcagctctgcctaagtgtgaccttagggtagttacacttacctatctttcctcatttctaaactatagaaaagaatatctacattgtggagttgtattgaatattagagataacatgtataaagcactagcacacagagatttctttttaaaaggtctctattcatgatcatctcaaaagcataatcatctctattataaggcatgttttattagtgtcagtattataaatttgttcaggctagaaataagatgaattattgtgttgttcccagggttccttttagaacctgtcttattgaagacttttctattagcagtctgctatcttctgacagactggctatttataataacaagccaacagttccattatttctttaaacctcttggttaggtgccacctggtctatgtaatttagttgcatgtaatttgtttattggatgtaaaatactcagtgcatttaccacaatttgggctaatagctctgatcagtctccttaaaaaggcagattgccaatacaatttagaaggctttataatgtagttttcagttttggtggctgttttggatttagatttgttcactgtgcatgctttgtttcatgaatctttaagttctttgcttccatctgacaccatgtgtttgaggttgcattttatgaatgggaaactttgcaaatgcttactaaatgatttaacatttatttctgcctcatgtgttcttaaaaataccagctgctgcttagttgaaaatgtaatttaatttgactgacacatgagttttatagttcataaacatggatgtattttccttgtttgtattcataagcctgttagtccatatgttaatgtgttctttgatttaatttcatttctttattttaaaaatcgataaaaacaacaacaaaaaccttgggaaagccttcatacttgctacatttttgaaaacatgcatctattttttggagatcacacttatgcctacagaatttcttcccattttagtggtttcctaaggtttctattttaggagttttattattatgttaacagagaacagcttttgatattgatataattttgtagtgtatttatagaaacaagtgcattttggatgtgtgaaagacatatttctcctaagttgcttggtacagttttaaaagcctaatggttagatttagttaaacatggtggactgttataaatccattcatgtatatagatgattcttaataatttgagagtgagaaagcctcttgaaagattattactttgtctcctctccagaaaagtttatatgtagacaaccgcagatttaaggaccccctggagacctgttggggaattgggatagtacaggggtccccaagcccccagccgtggtcccgtacctgttaggaaatgggccgcatggcaggaggtgagcggtgggccggcaagcattactgcctgagctctgcctcctgtcagatcagtggtgcattagattctcgtaggagcgtgaaccctattgtgaactgtgcatgcaagggacctaggttgcacacttcttacgagaatctaactaatgcctgatgatctgaggtggaacagtttcattctgaaactattcccccggtggaaaagttgtcttccacaaaagtagtgcctggtaccaaaaaggttggggacccctggggtatgacatgtatatgtgtaagtataagacactatataagatcttgaagaaaaatataaatagattaacgtaaatactctaagcagggagcaattaatataggtacatgtggcataggggtacaggacagggcaagcttcatggagataatggaatttgaagtactgacaggcattcagaagacaaagccagttctacacagggtcaagaaagcaactgacctgtttggctacccatgagtactgaaatttccttaaggataatgactttctgattgatcctcaagttccacattgtgcctagtatggatacagttatcttactcattatgtaagctcagcaaactacttgctgaattcagccacagtttttactcgttgtgctttctgagaccacttttctctgtgttctaacatgttgcatgtttgccttcacacatatttttattcagggaaaaaagttaaattatgtaatttcaatgactatgtgctttggttggctttaaaaagaaatttaaaacttaagttttgtattagcaggaaacagcttttgatattggtctaattttatatttcttaaattgtgtctttggcaacagttactttttgggtgtggaaagaaacatttctcctcagctccttggttagcttttagggaaaagttaaaatggtcatgaaagcatcagataaactaatagtaaccccaactgagtatacttttgtttaaataaaagccaagtgaagtctgtactgccatggtaatataatgcagaaataataagttaatgtatgtaacaaataatcaaagtttatagactacattcttaagagattatttttttcctccctttggaaagtagtgatatctaaggggaagagggtgtgggggactggcattttctcaacattcatagttggataacaaaatccacctaaaaataaaacatgtactcatatgcaaaaatgctaaacttacttttttgattattgacctttctttgcacaactctaaaacatacttgtcacagttttgttgactggtgatttcttgccattcctacagtagagcagtaagtcctgtgccaacaaacaatttatattattttaattagttttttaaaaaatcactttctgcctgattttatctcctgtgtttataatgttataatatgagctattaatttaaacacatttaaaaagtacgtttaattgattcaagtaatatttaatactggcctaccctgtgtcaggctatttcataggtgctatggaggctataagataaacaaagtattaatttcttggggcagtcatatctcctacagatttagttttttttagtaataggataatattattctgatttatccacactgttgtctctttcagaaatctaacttgaattggtgggatagttttagagaagtcaagaataatgtagaagataatttttctctgtgccaagtcaactgacctgactgggattgaatatgtagacctcatttctcttacctagctttcagatccagtctgaataattgcacatcctttttacatttgggaacttgactctttgggctttccctggccctttggaacatgactcaggttttatttttattgaattatagcagagtgttgaatcattataatgctgataactaaaacagaactaatattagacttggaaattcttctaaaaaattaatatgcctgtttcttaaaaacacttaacactcaaacactctgagacataccattgtggaatgctcataaggtaatgtatttcaagagtttcttactatcattagtatccagaactatatatactcaaaagtatttcaagtattcaaaactatgtatatatatgtttgccctcctaatttttattttattcaaccaatatgcaaataatgatctatctgatccttcatttttgctaatagtctaaaggtcatacaataagtagtttaggtctgggtttatttttacttataacagaatattatttttaaagtgagacgtaataacatgttttgacactttccagatctttcatgtaaaaaaattctgccacacatccaactatattcttatggtacaaaggttactattttggaggctagctttaggaaagatcaaatagctagatagaaccagagtaagcaacttcagcctgcaggtatttttaagtttttaaaaagctttgtaaaggaattttacagaatattttggatgatcaagctagtgatatgaattggttttatctgactcatttctgtgtgttaggcatggtattaagcatttttaaaatattattttacatatgacaagaatattgtcattctcatttcagaggttaggaaactgagggttacaaaagaagtaatttgctcaagttcatcccactaattcatggcagaggtgggaattgaatgctcaaggtctggtaactcctaagcctgattacagcaagtttctacctctttagagcaaaacagattaatgctttgagtccttttaatgttttagcttgtatcctcatcttttatttacttcagtaagtttttataatcaattgtaaaagacaaaccactgtcttccttataacataattttttttttttttttttgctttgcaggttttaaatgcacagagagcaggatacaaggcagccatagttcacaatgttgattctgatgacctcattagcatgggatccaacgacagtaagtacaggtatcacttttcttctctcctgtttgacagatcatttgtaactaaaaattaacaggattttccttctctcattttctttttaaaaagcaaaatttcttctctatcagataatccctcattcttaactctggatgattttattcatagtagagatgaaaatgactttcttttctgaacagtttttttttaaacatatatgttttatttattgatattttgttaaaaaccaaaatgggggaaacagctttaatagggataaacatgctgagttaagaatgccatagagggtgttttgtaatttatttagagattcacagcattattttagggtatgcacatacactaagtagctgctataatctgctggagttccaaagccacatacttgtgcttccttataccagttggttattagcccttcgtcatacattggtatgttcatagtttttcatttcagatgggaatgtctttctttactctctactaattattagcttgtagggaaaaacgagccaattttagtggcataactggctgtaataagacactgactttgaagctgtatgcctcacttaatgtagtttctattactcagggcactatggggttttatcaaaacctttctaattgatactaagatgatttactgtcaacactcatgattagaatttattttattcttttgagtgcataaccataatatattttgttattaagtcctattgattcatattttcagggtagagcaaagtatagacataaagctatagactgatagaaaacactggaatgtatttaggagtttaaataactgcatcctgaaaaggaaatattttatattccttaaccaaaaagtcttcttttagcctatgacagtgttttctgttgtttttgtttttgcccttcttctttatttttttttttttgagatggagtttcactcttgttgcccaggctggagtgcaatggtgcgatgttggctcaccgcaacctctgcctcctgggttcaagcgattctcctgcctcagcctcctgagtagctgggatgacaggcacctgccaccacgcctggctaattttgtattttaagtagagatggagtttctccatgttggtcaggttggtcttgaactcccgacctcaggtgatccgcccacctcagcctcccaaagtgctgggattacattcgtgggccaccgtgcctgggcatttttgtccttcttaaccctaatagagtgaggcaaaattataatatgtaaaaagtaaaatttattaatacatttcttaatttctttatattttaaattattattttaacctcctagctaattaaatcttcatgactgtagaatccattaagtacccataagaagttttagcatttcaggaatagtttgacagctactacatgggaattacaggacttacttaagtgagtttacttatcaaataaactggtaatgttagtactgccaatttgacacattttacttctcctttaactatttccctcttaaaaaaaattatcccagttgatacatcccatggtcagtaacttttgtgatctgtatacatttactggcaaaatggaaagcatgcgtagtctggaaatggataggcctgaattcgaaatcaaatcctacttgtatcagttgtataactttgagcaagttacttactctttgtgtgttttgctaaaggcccaagcccaggatttagcaaaccttcaggaccttctcaagggctgaatatgttttggattgaacaaattgattattatttgtaaactatttactcttttgacatgttttcagtaaaaattttgcaggctgaaattgtcagttccctttatcacttattttttctttgtaatactgtaaaacctttttgtgataatcatgtcagctcctaaagaaaatatgttcaatattaaaagtagcacacaaccatataagcctgctgttgccatggaaatgtttcaactgagttgttgttcaaagactgctcagaattttggttcttgactttgttgcttagattattttctatgatattttgctccatctttgcgcatgtgtttaaacgttttatatgtacagagacaaatgttgtaaagatctttaccattttcatgtttgctattacttggtagaggtaagaaaagcatagatttatcagaagaggcttgtatctgtccctcttttcaaggcctttcctaggaatactggtatcttataccaagcagagatactaacgcctggaaacaaaaggaagttgtaaaagccccttcctgttgacacttcacgtaaggaatataccaatttttatttcagccaggaacagaatggattaattcagtgagccaataacattctttatctttaggagacagcagaaagtggtaggaaggacaccaacttcagaaccaggaaatatgtgtttattctaagccaggctagttgttatgtgaaccagatacctgcgccctcaggaaagttacttaatctttataagcacattattttcatctataatagtgtgaataattttgataattatttgacctgacaaatttgtgaaaaccttatgagagaaggtatatgagaaaacccatgcaatggcagagtgagaggagcctagatgaggagtcagaagcctccagtttgagtccagactgtgcaaatatctaactgtataaccaggtcaagttgttaatatctctgggtcattttttttttcctttttttctttgatttctttcttcaacaaatgcattttgacagcctaccctgcactgttttaggcactgtgactataggaagtaatgatgcagtcagaggctctgccttcatatctttcattgaggtagtagagtgcagtacttaagagagtactttccgggtactgcttgttagggtttgaatcccagctttaccacctagtagctgtatgaccttgggtatattacctaatatctatatgcttcagtttttctgatctgtgaaattaggataataatagtacctaagttatttagttgcgatgaagattgaatgaattaaggcctgttaagtgtctagaggacttcctggttcttagcaatcatttaatgattgttcagatattattattgtgattattatcattttattgcattctagagtaggagagaagaaatgaacacataatcaaatagatgtgctataatgtcaagtagtgataaatgctatgaagaaaaatatcagcataaggggatatagaatgacagagatgaaaggaaggcagctattttagatagggtggtcagagaaagcttctgtgaggcattgcaatttgagcaccgatctaaagttagaggctgagtcatgcagatttctgaaggagggtattccaaggagacggaacaacaagtacaacaattcaaagataaagcatgcttggtgtttccaaagtgtggcataaagccacaatggctagagtagtgaacaagggagggagtggggggataaggttagagaaggagccaggggtcaaatatgatgggccttgtcagccatgataaggactttggaatttattctaaataagttttaggctgggcacagtggctcaggcctgtaatcctagcactttgggaggccaaggcgggaggattgcctgagcttaggagttcaagaccaaccttggcaacattgtgaaaccccatctctactaaatatataaaaaattagccaggtgtggtggcgtgcatgcctgtagtcccagctactcaagaggctgaaccacaagaatcacttgaacctgggaggcggagggtgcagtgagccgagatcgtgccactgcactccagcctgggcaacagagcaagactccgtctccaaatgattgaatgaatgaatgaatgaataaataaaaaaaaataagttttaaacagctgtgtaaggcaatatgacatatttcataaacggagcactttgctgttctttggagagaacactgaaggtgaaaggtgagcaaaagtgccaacagagagaacatttagaaagctgctgcagcagccaggcaagagtaatggtggtttggagtattagtagttaaagtcatgagaagtggtaggaatatggctatattttgaagctgacaggatttggtatagggagtaagggaaagggaggagtcaaggatgattccaagatgtttagtctgagaaactaagtgaatggctatgctgtttacagagatgagaaacagagttgatcgactgagagaaaagagacattcagagttcagttgagaaactttgtttgaaacatgtattaggcaatcaaatggagatattgaatggacaattggatatacgaatctggagagtttggggctggatcattcaaattgtaatctatctttgtcgatatgtacttcacagagttgttttacagatcaaaatagagtgttttaaaagtattttgtgaagtaaaacatatttagttttgttttcagtagataatgttgccattttcaagatggctactcatatttgcttacaatattttctccctttttcttaatcattttattaaagtaaggagctttctacatctctttagatgtcataattcaaagaagctaggttacttccaatattattagccagtagttacaaaccaaaagttattccttgagtttgtcatagtatcttcatgaaagaagaaagcatcatacaattccaagttttaagtatcaaataaaataagctttaaactcatatgtggtagagaaaatatcttagcaaaatagaaaatatctcccaaatataaaaaaaaatatagtcctataacaatacctctgcatctattaaaaaaaaaaatgcaataatgcctgtagccccagctacttgggaggctgagacaggaggggcacttgagcccaggagttacaggctgtagtacacaatggtgccatctgtgaatagccactgcactgcatcctgagcaacatagtgagactctgtctctaaaaaaataaaaataaaaataaatgatgaggtagatctgtatttattgacataacaggatatctgagctgtatcattgtgtagaaaaaaagcttacactttaaaaattatatgatcccattgatataaaaaataaaattttattgatcatgttgatataaaaatagtgattaaatatttcttgactaatattttttgtttctgccctctttggggcttacatgtttttttctggtgtgtatgtgcgcgcatgtgtgcgtgtgtgtgtgtgtgagagagagagagaatgtatgagagttgaacgtttatatttgcataaaacaatctagaagtgaaaaaaacttactctaccaaggatatcaagattttaaaccttgtctttataaggatgaaaacaataacagcaaaatagatcagtaatttataagtttagggggtaggggttgactgtatgagggaattttggtgggtgatggaacattctatatccaactgtagttgtggttataattgtatgtatttgtcacaacttacagaactgcttattactttaaataaaacatttgtccttggatgggaaagattatgattttgttttgttttctttttctttacttgcctcccccccttttaaatgcataatgaatatgcattgtttttaaaatgcagaacaaagttattttgaaaactataaaaagaaaacaaatgggccttctctaaagccaaatgtgttaaactaactcacagctaataatgaggctgctttttctattagcaacattaagaggattgtttttctttctattcctgagtaatgggtaattttgacgaaattctttttgggtggcatttgattttggttttgaatatgggtagaagagtcaaatatcttaagataccaatcaaacacaaaactttgccatgagcgccaggcttacaaggaaatagaaaccagctttcctgccctattccctttctcaacccctgtcagcctttcagtctggaaagccagagatgtgtggtattactttttagattgttgtgaagttgtcttttcttatattctctggcttatacgtctcctggaaatgggtatgtaaaagaagctttttctctttttcatttaggaattaagttatgtgtgggaagaaaacctaaaatttcttcatctttcttctctaataagttatgtctagagaggaagaaatcaaatggaaatattaaaaataaaaattacatctcaatcttatagactattgagagaattcaggtaatgtgtatatgcaaaatgttagctttgttactgtaaatgttatgtttctcaaccattttgatgatgaataaaatctgcaatctggaaaatcaagcaatagacaattaaagttgattgtaattgtttccagttgcatttgctgctattatgaagaaaagttgattatacactaaatatgggcttttaagaataatttcattattcttttatacagttgaggtactaaagaaaattgacattccatctgtctttattggtgaatcatcagctaattctctgaaagatgaattcacatatgaaaaagggtaagtaatggatataaaaaatcatgttgcttaaaattcttctttatattaaggtagaattatataatattgtaatcaagattatgtttcagaatgaactctgtagtgctaaattatccctttttaaatcattatgcttttaagacgtagtattttaaagtattttactactttttctttgtatgattatgttgaaaatatattcatgctagtgagagtaagtcacccttgttgctaaaaagataacttttcattttgaagtttaatcaaactactggtattttaaaacaatgcaatttatgtttatatgacattttctattaagaaatgtttgtatattactaaaaagatattttatatattataaacacagaatccaaaacattgtgttaagggactaacatttacaaaggcaaaaagtcagttttcaagttttagaagcttgatttgaatgagaacttttatatgaaactcttctcccctacccccacaaaataatctcattacaaagataacatacagactgaaattaacttaaggcacagctgtctcagctaatatagaaaacagagaaaacggtacaataaacacttcagaacttcttccatgacacacagatccccaaaacgtagttgaccagaacagactttggtctaagaggaacaacaacaaaaataataataaaagcagctaatatttattgagcatttagcaaagctgggcactcatgaaagcaagacttctacattttgttatccatttaatcctcacaacaaccctctagtggttgttattattatcacttattatctacatttgccagaagaggtaactggcacaatgaaatccaattctaattatttagggggaaaagaaatccacgaatatttctgtttgaaaatgcataaaaagaagagggcaaggttttctgtttactgttattgttagttccccactacagtgttgatatttaaaatactgttcacatattatatgctcagaacattttttttaagttaaggaatgtaattttggaagttgtatcaaaaaacagttatgcaaagtggtgttttgtcagccgtgtttgcttggttaaaagagaggagaattagtacttgcttttacctcaatattgctccctcgtttagaatacttctatatattttaatatgtattttaaagagtattttttgtttttaattataaaaccatactttttaaaattaagaagtaatatatagatactagcaaaatatggaaaaattgaaatataaaatatttaaagtgaaagtctctatgtgacactattgcttaccaactactgttttttaaaaagccctttgtttttccccatatttgcttattcaccttaattagtgatcacatgctcataaaatggaaccatacggtgcctaataatttgtaacttgctttatttacttaatgttttgaccctttccaggtgaatacaagtttacaaactctcttatcccacctcttggctacagatatattgtggcattgaaaaatgtttgaattttaaaaagttaaataacattccaaatagaatttgaggcaacaccccataatcaaacaaattaatgtatctgcaataaatatatggctattttttcatgtcagttcacttcaagttgactgtcaaatgaattgcaaacattattttttaaagctttttaggttttagaattggtcataaggaattgtagacccgtacataaagatctactctatctatctatctatatatctgtctatctgtctgtctgtctgtctgtctgtctgtctgtctatctatctacctacctacctacctatacctatcatctatctatttatctgtctgtctgtttagtatctatctaccacctactttaccctcaagccccctctctttcagtgggcagaactaggaaatatatatggcttttaaagatacaataaatcatgagtgtatactgttgcttccaatttaaatacaaaggtctagaatttttactttattgaccttaaatgggtattttatttttctatgctgaaagacaccaacataataatatattgtcttttctaaatgtaaagtatgtacacaacagactcagaagaagaatatcaatgctattaccaacatttcttaaaaaacagttctttctctgcttagaatatgtcataatagataagataaagctaaattattatcattattattattatttttgagacaggctgttactctgttgcccaggctggagtgcagtggcatggtctcaactcactgcaacctctgcctcctgatctcaagcaatcctcctaccttagcctccccagcagctgggggctacaggcgaattctttttttaaaagaaagtgaaatagtctgtgtgctgatgttataaattgaaaacacaggtttatttgattcatttgctttcagagtttggcgattgctccccttacccccaactgtgattttaaaaattatatataaactctgagtcaaaatcagtgaaacaatgtatattcagagaagttcagattctaagtatcatccatcttgtccatcttgttcctctccttaccttataagtaataattaaaaaaagactttaatttattctttagttcattaaatttaaaaatatgtaggaaaatatatatctcctctcccctatcttctacccttagtgcataaacaatattccccatcctgcttttgacttgattgtttatccttgagtagatagagatattcttcattcttttgtacagctgcatagaactcttattttgtggatgttccagtttaatcagccagtcccctgttgatcagcatttgaatcggttacgttattttgtaattataaatactgctgtaatgcataaccttatgcctaagtgttttcatgtttttgccagtatacttttggaatagatttctagaagtgggattgctagttcagagttttaatgtatatgtatttttgctagatattgtcaattcccatccgtaagggtcatgccaacagtttatgagggtgtctcttttattgtaccctcaccaacaaagttgttgtcagatttgcttatttttactaatcagataggtgagaaatggtattctattatagttttcatgtgtatttctcttattacaagcacatttaagcatttttttcttatgcttaagcgctacttatattttatcttttatgagctgtttacctctaggccagttttttgtattagattattggtcattttcttccctatttttagaagttctgtattttattagttatgttggtcctttattttttaatattacttttttttgtattttgaaatttttatttcactatgatgttgggttttttttaatgtaaacaaaaatcaaatatctcttcccttgggctgttggtcttgagtcttaataaagttttccctactcctgtgttatagaggaattcacccacatttatacttgtatggttttgtttttaatattaaatcttttgttcatttgtaatttatcctatatatagcttgaagaatggatccaatcatatctttttccaaatagccatcagttattccaatggggtttttttttgtccttcccaatgaaatttttaaaacaattttattaagatatatctcacataccataaggtttacccatttaaggtgtaaaattcagtgatttgagtatatttatagaattctgcaatcatcatcacattctaattttagaactttttcaatattccaagtagaaaccccgtacacatttgcagtcacttcctattccccagtccttcttcgtccactccagccccaggcaatcactaatctactttctgtctttatggatttgtctattctggttatttcacatgaatggaatcatataatattttatgattttttttcatttaatgtaatgttttcaaggttcatcatattgtaacatgtattggtactttattctttttattgctgaatagctttccattgtatggatataccatgttttgtttatctattcatcagttgatggatggacatttagcttgtttccacaacttggctattgtgaataatgctttttttttcactatttgtgtacaaatttttacatgtgcatatgtttttatttctctttggtatatacctagaatggaattgttgcattatgtggtaactctatgtttaacactttgaggaactgccagactttttcccaaagtgccttcaccaatttatattcacaccagcaatgtatgagggttccagtttttccttccaaaggaatttaataatcaactggtctagcttcagaaaaacctgataagatttttattgagattacattatattcataaattaatttaggaagaattgacatttttaggataagtctccttattcaagagtgtggtatgtcctttcatttgttcaattctgcttttttttttttttttttttttttaatttagaaagggtctcactccagttgcgcaggctggagtgcagtggtgccagctcactgcagccttgatctccgaggctcaggtgatcctcccactgcagcctcctgagtagctaggaccccaggcatgcaccaccttgcccagctaattttttgtatttttagtagagctggggttttgccatgttgccaaggctggtcttgaactcctggactcaagcaatctgtccgcctcagctccacaaagtgttgggattacaggtgtgagtgagcagcgaattctgtttttatgtattcagctttgtttagtttttttagtccaaaatctatgtgagataaacatttcttgttaaatttatgccaaggtattttattgtttgctatcataagtggagtctcctctttcattacatctactaactggtttttatttgtacagctgaaagctcatttttgagtgtggatataataacctgcaatttgactaaattctcttactgttgatggcagttttttcatataaatagaaatagttttatcttttcctttccaattcttatgcttctaattgctttcccttatctaattgcattggtaataactttaacaccatgttaaatagtagtagagataggcatctttcccttgttactccctttagtaagaaagcttctcgtttctttaagtaagattctggttttttatcatattaatgaagtattcatcaattattgttttattgtactttattctttttagctactgttcactcttttaactacttttaaaaaggatggtatattctggatttaacaatagtccattgtttagatatatcctaatttacttagccagtaagccaccgactataagcatgacctctggagtaagagctgtgtggattcaaatcctggcttccatcacttgttagctgtgtgatcttcaacaaaaaatttattatctctgggccgtagcctctctcctcattaaaatgtgaacaataatagaacctacagcatatagcattgctggaaggattaaacacattaataaaattcttagaagaatacctgggacatagtaaatgcttcataaatgttaatgcttaccttccaattcttgtctattacagaaagtgctataatgatatccttgaccatatactatgtgcaattgcacaaatgtttctttagcaaaagcacctaaaagtggaatttttttgattaaggagaaacagttttaaatttcagtaaacaattgtcatattgccctttaaaaagcagttatgtttccaccaacattttaggaaagccaatgttttcccctactcttgccagtaatacatattatcagtctttttatgacctcccaatctgacaagaagaaaatgagttggtccgattagcatttctttattcacagtgaatagttttataaactgtttggtgtcctttgtcaattttggtcttttaaaaacttaaattctagaagcattttgtaacttttattagggaaggcaaattattggataacatacaacttttacaagttgtgggcagagacaaagcttgtttttgatcagagtgagtagtgcagttcactggagggattgctggggtgtggcctttgggagggtatttaatcttcatggacatattttctcttgaaaatgaagagttagaacaaagaatattgaggttcctttaagatttctatattctctctgatggttagggattctattttttcacatttaatccctagcaccaggcccattgactgtatcacagtagacatttagtaaattctaatgaaattaaactgcttttatgttacctcagaattcctcaagaagacagagcagtgcactggcagtaaatggggacacagagcctgtttattaagtgatgtaagatgtttaatgaggcagctgtgagctttgtctgaaaggagcaagttcaaggaagtagtcagatgaaatagtggggatatccagcagttgggctgaatacaggttattgcctggaaagctgatctataggacagaaggctctgctgtgtggctgtaaatccactgaggcttagtagtttgattggtgggggttggatgtcagaaaagaacagacaagacttcatgtgtcaacagaaggatggggaaattagacaggttattattatcaagcttaagcctaggcagctggtttgaaattagcctgggaagtcacacaaaggaaaataagaccctattttctgggttgcttaggactctgcttcagtgatcaaatcttagctgcagagctcataagatgtgctgtatttaggcatggacatagaggcagtgtggtaggataattacctgtttaaataccttcttcctcaaatacagattaatctgggactagggcaaggatgaatctgcaagttcagctgtgggagacctgggctgacagaagaaatagaaatggagccagaggactgaaattccattgtagttctgttgtagttccctgtatcatcactatcaccacatccactgttagcaatttggttaagaaaaaaacagtatcttgagtgtacattgagcttttgattcaagatgctcaaaacctttttttttttttttgagacaaagcctcactatgtcacccaggctggagtgcagtggtgcgatctcagctcactgcaacctccgcctcccgggttcaagctaagtttccagccttagcccctggggaagctgggactacaggtgctggccaccatgcctggttaattttttttttttttttttttgtatttttagtagagatggggttttgccatgttggccaggctagtctcaaactcctgtggcctcaagtgatccacccaccgtggcctcccaaagtgctgggattacaggcaagatgctcaaaatcttttatcaattgttgaccctttaaaatccccacaatatatcttgacggtaaactaaaatggtatttagtttataatggaaagcattaataggatatgtagaatattagatttagaacccgggcgtatgaatcttagcataatgcttcctgggaaattctgaaattgattccatttctgccgttacaaacacacacgaagttcctagttcactgggacttcctgatttgttcttttagcttgctccttctcacctagaagctctgtttatttctgagcaaccctggggcttgtctcataggacaggatttatttatctcatcaaggctgagtgtgccttaggaagtcataaacataaaaagagaagaaaaaaaaaaacagaatatgagagttgtaagccttcctactgctgagatactaagttacaatgggttgaatttaggatatgcaatagtctggcttctaaaccctgatagtgtttatttatagcaggttagtggctgtggggtagggaggttatagaggattagcgtctcatggaaaggctcttatacttaaaagtggtaccactggctcagggcagtttcagagggtatgtgccgggaacagggatattaattgcggagctggctggcctcgtgctggaagagatggtatcaaatagagcagcttaggccctgctgctgctgattttcttttttacactgatgatatattagttactttagtattttgtgcaaagctatacaaatgtgtgtgaaatcctttgtcatcccccattctgctggaaagtgaagtaaaaagctacttgtattctagcaatcgtagcaatttttggaaagtttaaattattggggtaaattcctggtattttttgtttgttgaagcttgatagagccccttgtgtgtgtgtataagaaataatagcataaagatttaaaaatagtctcggaaaaaaataagttgcatacatgttatttgtcttaagtgctatggtgtcctaagcacctctgtatgaggaaaggagtaaatctgttattttcctttatactgagaacgattgttttgcattgaacctttcggttatgaaatacctggcttcactacttaaaaaattaactagcagtggataacagagtagctttgctggcaccgtactagtctagtagcacagtggacccaatggattcatctgtcatatctgtcatattactgaacattatacaaactcttccctaaactaagggtatttttaatgcagagctttgatgccatgtaaaatttcctcatgtaacacaaatgatgtgcttattctgattacagttttatttcatgggtccctgtcaatttttataatgataatgtcacagtaataacatggttaatgataaatgagaattaaggcatgtagcatttcctattacccaccttacaacatacacatttctgtagtttttttcagtccagtggtggagaaggtgggggatatacaggaagccataactcttatgaattatttgaccagtttttcattccatatctcatagataattgtagagtataggacctgtatccattgtacctgatacaacagatacatgtaaagcagatagggaggaaacagtataatttttatcaatactgacgctagagtttttccataggaagaacttatgaacagtaatttgattgaggtggaggttctttttggtacccaaggtactaccatgattttacgtataaaatataacttttgccccagctactaaattcaataaacaacatctctagacctgccgtggtggctcacgcctgtaatcccagcactttgggaggccaaggcaggcgaatcacctgaggtcaagaattcaagaccaccctggccaacatggcaaaaccctctctactaataaaaatacaaaaattagcagggtatggtggcaggcacctgtaatcccagctactcaggaggctgaggtaggagaatcacttgaaccccggaggtggaggttgcagtgagctgagattgcaccactgtactccagcctgggcaacagaacaaggctccatctcaaaaaaaaaaagtaaaataaaataaataaataaataacatatctccaggatagacacagtaagaattgattggctagttttctttacccagtttaatcatataggcatgctattaggaaaaatatgtaaaatagacttaaagatgtagaaagcattccttaaattattgaaagtcatattttagaaaatgaaatgtatgtagtggatttaattgtaatgtctatatgtctgtttttaaaaatattttttcctgtttttaattaacatcagaatttaacaactcttcatttctcaattattgatttttgttttcttctaggggccaccttatcttagttccagaatttagtcttcctttggaatactacctaattcccttccttatcatagtgggcatctgtctcatcttgatagtcattttcatggtaggtacattaacttttaataatttttaaaaaatagtatggatgaatctaaaaacattgtattgagtgagagaatttaaacaatgtgtacataaaagagtacatattatataaattcatttatgtgaagttctagaaaaaacaaagataatgtgaataggaaaaagtaagaatggtgatttcctctgccgcggggggttagagagaagtgatcgatttactgaaaagagtataagggaacttttgggggatgacagtcgtgttctgtatcttgttagagatgtgggttgcaaaaatgcatggcatttgtctggattcacaaaattaattgtgttgtacatttcattatatgtaaattttacctcaaaacgaattgcaaaaaaaatttactaaacctagtaatgacatgcatgccaaagtattttagggaaagtacactgatatctgcaacttactttaaaatacactgtaaaaaaataagaggaaaaagtaagatgtattgatgggtaaatagggttgtgacaaaaagcacagtaaaatgttaattatagaatccaggtggatatatgggtatttattataaaattcaactcttctgtatgtttgaaattttttatattaaagtatgaaaaaaataatgtgagagcttaaggttaagggggaatgacatattatttctccataacggtggttatcaaaatacggttacaagactattagtaggtctgcaagctcaaaattattatgtaataatattaaggtagtatttcctttggtcactctcattctcttagaggtgtacagtaaaaatttctataggctacatgatgtgcaatatcaaaatatttgaaaacagaagcagtttgaaaatccctctgtattctatttggacagatattaaaatagatttgcaaagatataaaacagtcccactcttcttgccaacttctttgtcataaagaatacatattttcatattcagtacatttattattgtattgaattcatagattagtttaaagattaaatgctatctttaaaatgttcagtcttcctatgatgctatggtatttttaaatttacttatttaggcctttccatcagttaaataatttttttcctataaatgttttgcatgtctttttttagacttattacacatatagtaagtttttcttgctaccaaaaaaaggatttttgaaattatattttttaattggctattcttataattgagtattagagcattgctttttattaaacatttaattttggaataatgttaagatttacagaaagtttgcaaagaagagaattcctgttcatccgtcatctactttcccgcattgttaacattttacattgccaggagacttttgtcaaaactaagaaactgacattggtacattactgttaactaaactccacattttggattttaccaggtttttcattaatgtactctttctgttccaggatcaaatccaggataccacattgtatttcattatcctgtcttccctctggtctatgacaattttgctgttcttgtttttcatggccttgataattttgagtactagccaggtatcctgtagaatgtctctcaacctgatttttttctcatgattagacaaggctacaggtttttcaaaagagtatcacagacgtgaagtgcccttctcatcacatcatatttgagggtatatggtatctgtagaacatcactgatgatgctaaccttcatcccttggttaaggtagtgtttgctgaatttctccacttataaagttaatattttttcctttttctactcttttctttctttagaagtgaggcactaactatagcccacccttaagctgggaaggggagggcatatctgcattatttgaaattcttctacaaggaagatttttctcttctcagcatttatttattcaaccactttcattagtatacactcatgtatatttattttacacttaggttataatccagtaatattcatacattatttttgttttttgattgtttttaaattgtttaactttggctcttgtcatgctggatcttgtgttcctttgattcaacgctatcccttttttttattattaagcacttcttgactactatcttgtactataagatgcttcaggttcatcttatattttttatatttttcttgtcccagccctagcatcagaccttttcccagggagtcatgttttttttaattagagagctatatttagaaagcaaggtttggtcaggggacattatagatttttatatattaatcatgtaatcatgtcattaatcatgtaatcatgtaacaaattccattatggtaatttgtttgttgattcccttggggtttcagcatagaagcaagaaagtagagagtaagttagaaaaccaaaaaacaaacaaacaaaaatacccttggaaaaccaggagtacaagtaaataaccttatacagataaagaatatagactaaaaacttaaaataaacattattaaatggtgaaatgctagaagccttcccttgaaactcaagaacagcggggccgggtgcggtggctcacacctgtaatcccagcactttgggaggccaaggcgggcggatcacctgaggtcagcctgagttcaagatcagcctggccaacatggtgaaaccgcgtctctactaaaaatacaaaatttagctgggtgtggtggcaggcgtctataatcccagctactcgggaggctgaggcaggagaatcatttgcacccaggaggcagaggttgcagtgagccaagatcacaccattgcactccagcctgggcaacaagatcgaaactccatctcaaaaaaaaaaaaagtcaagaacaggaaatggatgtctattgttgtacctcctttaacattgtgctatattttttgggaaaataaaggggaaaaagcagtataagtcgtggacataaatcagatttttatttgcttgacttttttaaatgggtactggattatatgttttttatctgttgtaataataattggtttttctctcttttatcatgtttgtgttgggttacattaatatgctttgtaaattttgaaattccttatattctggggataaatcctgtttatgatgtataaattttgtccttacatctctggattattcagatttctaatatagattaattttttatacttggatatcgatgtaaaaattctagaatattagcaatctggatattcaggtaaaagaaaactttggttttatggggccaccttgacatcaaaactagacaatcccttgagcactgttggtaggaaggtagaatggaacaaccactaaagaatacagtatggcaactcctcaaaaaataaaacatggatctggtaattccacttctgggtatataccaaaaagaattcaaagcaaagactcgaatagatatttgtacaccatgtttatagcaatattatttacaatagccaatgatgaaagcaacccaagtgtacattgatggatgaagggataaacaagatgtggaatatgcatacaatggaatattattcagtgttattaaggaaggaaattctgacacatgctaccacatagatgaaacttgactttatgctacgtgaaataagccagtcacaaaaggacaaatactgattctacttacacgaggtacctggagtagccaaattcatagagacagaaactagaatggtggttgccagggactgaggggactgaggaagggggagttattgtttaatggatacagagtttcagcttaataagatgaaggctgtgaatggatggtagtgatggtagcacaacagtatgaatgtacttaagccatcgaactgtacacttaaacgtggttgagatagtaaggtttatgttgtgtatattttactgtaattttaaaattaactaggcaatcaaaattatagcctcataaaactaagctttctcttactttctaaaatagttttttttttttaaagaaaattggggttatctgttacttgacatttttgtagaggatgcctataaaatcatctaggtctagtgaccttctcatagttatatagacattcagatggttttccagttcctactaaagtgtatttctaagaaatttcctgttttcaagtgtagtggaataaagtgatttataatattcatatactcaaataacaatttaaagagaatttctactatttgtggaataagttatctttattcatatccatctgtgcctttcacaatgttgtcagaaattattgccttattagtctttcaaagaagtaggctttcattcaataaatatttattctgtacctatggtgaactaggcaccgttcaagggtctgcagattcatcagtaaacaaaatcggtaaaaatccctgatgttaagtagcttacattttagtagaacttaatgctaaattctttactttctttatttttatcatgaatttttgttcttatcattttctttcttctaccttgtctggttgtatgtctggttgttgattcccttggggtttcagcatagaagcaagaaagtagagagtaagttagaaaaccaaaaaacaaacaaacaaaaatacccttggaaaaccaggagtacaagtaaataaccttatacagataaaaaatatagactaaaaacttaaaataaacattattaaatggtgaaatgctagaagccttcccttgaaactcaagaacagcgggttgtatggcttttctttttctagtttattcagctaaatgcttatttttttctttctagtatatgcatttaggttataaatttttctacaacaataactttagctgaaacccacaacttttgataaggaaaattcttactttcatttgacttaaatttaaaagtttttcattttaatataggatgtttctttatcactcttaatgtttcaatccatatgaagggggaactctagttactatgactcttagctgttctctgcccatttactctttccaccttagaggagataaagtgtcttatctgacactttaggaagggcaaattgggcacacttggttcagctccaccatctttgttttgttattaacctgactttgggacatagatgttcattcagctcctccagggttagggctggttctgcaattctgcggcagagtgaagggaaggcctacttcattccaaagttgtctttgtctatatctaagtggctaaggcaacctaattctattgctcaataaaaaattctgtttcttgcactgcacgggggtcatgctaatcttctctgtatcattccaattttagtatatgtgttgctgaaacgagtacagaaagttctgtttctgtctccagtgagaaacacttcctccttctggccagttcatggtcttatttctcaagttatttagaatccaggtggcaaaggggcgcatgctgattataacaccccctcagaaacgtagatattcattatgatttgttctgtgacttatgaattacttcagtacagttttacatttccaaaatatgtatttttttctattgatttctaattcagttgtgttgaggtaagaaaacattgtatgttatggattctttggttattttcaaaaacctcctttgtggcatggttttctgattaaattttgtaaacattccatgtgtgtgaaaagatgtgaagtgcagttctatgtccattagttcgaacttgtgaatttgttttgtctagtcttttaacagctttattgagacataattaatgtaacttaaaattaactcatttaaagtacacaattcaataattttaagtatcttcacagaattatgcaaccatcaccacaatcgttaataattttctgcgttctttttctattttctgaagcagtgctaagaatagaacaatattatgagccacattttattgtaattttaaattttctggtagccaaatttaaaaggttaaaaaaaggaaacagatgagattaattttaatactatatttatttaactcaataaatctaaaatatataacaacattcagttaatacaaatatatgatatttttatattctttttgtatagtgtctttgtaatctggtgtctattttatacttacagcacatcccagttcagactatctatgtttcaagtgctcagtagtcacatgtacttggtggctaccatattggacagcacaggtctatagtcttctaaattttttgtgtgcttaagctataagttgccgagcttgtgaatgtatgtatttcactattttgtttctagatgaggtgttgtttttattgttgtcatgactctcctaatgatgctttttgccttaaattctattgcttgatattctagcttttcttttgcttaatattttcatggtagatctttatccctttattttattttgtatgttaatttggttattttatgcagggtcttgctctatcacccaggctggagtacagtggcacaatcatagctcactataacctcaagtgatcctcccacctcagcctcccaagtagctgggactagaggcgcacatcaccatgcccagctaattgttttttttttttttttgtagagatggggcctctctgtgttgcttaggctagtctcaaactcctgggctcaagcagtccttcagccttggcctcccaaagcactggaattacaggtgtgagccactgcacctggtcctatccctttattttttacttttatttttgtcctaatgtatcattcagttttaatcttgtgtcttgtaaatagcatatgatcggaatttttttcttatacaatgtgatacactccttttgaaaacggtggatttaatccatttaacatatattgtgatcacacatgtatttggattaatttctattgtttactttttattctgtattttcttctgtgtaaatttgcaataataacttttactttctttttcctattgatatgaacatttgcattatattgctgttcttttagtggttaccattaaactttaaaaaaatttatggaggtatgatttgatataataaattacacatatttaaattgtacactttggtaagttttgatgtaggtttataagcatatatatcacttatgcatatgtatatcacatatatcatccatatgtaacagatatgtatgtgtatacctgcgaaaccaccaccaccacaatcaagataatgaaatattaaccaccctaaaaagtttggcaatgccttccttctaccccttccaacttttccttcatcctcccctcactacccttctccatgcccagacaactacaaatctgattttagtcactatagattactttgcattttctacagctttatataaatggaatcataaagtctgtactcttttgtgtctgtcttctttctgtcaccgtaattattttgagatttgtatatgttattgagtgcatggattgttcattcctttttattgctgagatatattccattgtgtgaatataccatgatttgtttacccatttacctattgatcaacatttgggttgtttctagtttttggctattacaaataaagctgacatggacatttgttgtatggaaatatgctttcatttctattgggtaagtatatctaggagcaggacagttgggtcacaggataaatgtgtgtttagattcataagaaattgccaagctcttttccaaagtggttgtaccattttacaatcccaccagaaagtgtatgagagtgccagtccctccacttccgtgccaacgcttggtatagtcagtgttttacattttagtcaccctaataggtatattgtattatagtatttatgatttgaatttttgttttcctattgactactagtagacattgcacatctcttcaagagcttatttgctgtttgtcttgtatagtgaagtatcttcaaatattttgtccattttctgttgggtaacttgttttcttattattgagttttgagaggtttttatatatattctggatacaaatcccttatcttgtatacaatttgcaaatattttatttcagtctgtggctcatctgtatttttcatttttaaattttatttatgtattcatttacttatttatgttttggagacaggccctcactctgttgtgcaggctggagtacagtggcacaaacatgagtcactgcagccttgacatcctgggctcaaatgattctcacacttcagccgcccaagtagctggaactacaggcacacggcaatgcgccaggctaatttttttctttttagagatggggtctcactatgttgcccaggctggtcttgatttcctggcctcaaacagtcctcccacttcagttgtcttttatttttttaacagtgccttttaagcagagaagttcttaactttgacatagtcaaatttttcctttacagagggtgtttttggtatttggtttttggccctgtgtactttctttttattcttgcaagcatagcaatttatagtttaaaatattttgtacattttatccggcatttctgaatatttgtagtgaaggtgttctgcattatttctgcctgttattctgtagtaactaataagtgtatgtttgaaatttttatcagtttgtaatatataggaatatcaaccttcccattctttttttttttttttttttacccattggagtctttataaaatctatagtttaccatttgtatttttgcaagcaaacagttatatgatttttataatgtctccgtaggtaattcaaagataatcaagatcaattaataaaaaattcaaggggtaattcatgggttaactaatcactaatgtaatttaatgctttaattaacaatactattgcaattagaatttaaatgaattgaattgatttgcagtagctatccagaaacttaaaagatatttgttattttaatggtcactttctctttgcacatttaatatctgactcctttttttactcttttatttttagatcacaaaatttgtccaggatagacatagagctagaagaaacagacttcgtaaagatcaacttaagaaacttcctgtacataaattcaagaaaggtaagtatttgttttctaaataattatccttagtttatttaagactgcagggtgactatactctttaaaaaaatttttattattattattatactttaagttctagggtacatgtgcacaacgtgcaggtttgttacataggtatacatgtgccatgttggtttgctgcacccatcaactcgtcatttacattaggtatttctcctaatgctatccctcccccagccctccaccccccaacaggccctgttgtgtgatgttcccctccctgtgtccatgtgttctcattgttcaccttccacttatgagtgagaacacgcagtgtttggttttctgtccttgtgatattttgctgagaatgatggtttctagcttcatccatgtccctgcaaaggacacgacctcatctgtttttctggctgcatagtattccatggtgtatatgtgccacattttctttatccagtctattattgatggacatttgggttggttccaagtctttgctattgtgaatagtgccacaatacacatgtgtgcatgtgtctttatagtagcatgatttataatcatttgggtatataccctgtaatgggattgctggatcaaatggtatttctagttctagatccctgaggaatcgccacactgtcttccacaatggttgaactaatttacatacccaccaacagtgtaaaagtgttcctatttctccacatcctctccagcatctgttgtttcctgacttgttttttttttcttttgagacggagtctcactctgtcacccaggctggagtgcagtggtgcgatcttggctcactgcagcctccgccccccaggttcaagagattctcctgcctcagccttccgagtagctgggattacagatgcctgccactgcacccagctaatttttgtattcttagtagagacggggtttcaccatcttggccaggctggtcttggactcctgaccttgtgatccatccacctcggcctcccagagtgctgggactacaggtgtgagccactgtgcctggcctgtttcctgactttttaagactatactcttatactaccttctgtgtccctaccataaactatgcctaacgctaagtagactttcagttaagaatgaatgaataaataaatgaatgaatgaatgtgagagatgatgttttgctgtgatctggtgaaagcaggagaaggatgcacagtctgcagagaatttaaaaacaataattaaactaaccaaaatgcttgtaaatattatcaccatgtgccattagttctaaacaatgtcagtagataaaatatttttctgtaccaggtgaactactctcacttaccttcctcctattctgtctcccacaatataacactgtatagtgttgtattaactaaacacataggtaggtagctgttatatatcatcacttatatatatcatcttaattttcatacttctatgaactgtatactcttattattttccctttatagatgaggaaaaatcgggtcagggacattaggaattttaatatcacatagccagtattgacagaactagaggagaggtgtgactataataccatagccaatgtaagtttcccctatagtatagtttctctgtgatttagtgaccttttagtgcagatacctacttgataaatccttttggctggcacttcccagacttcattttcatataccagtaaaaatattctgttttttaattcagcagtgaaaaagtgtagggagtggagggagaaaatagagaaaaaggcaataaaacatagttctgccacatttttatttttcaaataataaaatgttttataaacctgccatttaccattaacattaaaaaatagaacacttaacaaaaaaaagtaggaaaaagaacatcatgttaaaataaagaaatgaatagacatttctaaaaatgcactgcattttacatttacattattattatacagtgatttacattatcattatacagtgtggattagttaatagtttttttttgttttgtttttaagagatggggtctcactgtgttgctcaggctgaacttgaactcctgagctcaagtgatcatcccacctcagcttctcatgtagctaagactataggcatgtgccactgggcccagcctggattaaagatttccacatagaccagaactagtttgaagattaggaattacttttttaggcttcattttgtgtgtttaaaaatatgtttaaaatggccaggcacggtggctcacacctgtaatcccagcacttagggaggccaaggcagacagatcactaggtcaggagatcgagaccatcctggccaacatggtgaaaccccgtctctactaaaatacaaaaaaattagccgggtgtggtggtgcgtgcctgtagtaccagctactcaggaggctgaggcaggggaatcacttgaacccgggaggcagaggttgcagtgagccgagatcacacgactgcaatccagcctggtggcagagcaagactccatctcaaaaaaaaaaaaaaaaaaagaaaagtttaaaaaatggtgatactgtcctgggtttaaagggaaaacatgtcattggcttttcctctgagtaagatgggtagctgtagtaggatttggaacagaggagagagagaatgtctcagttaactgttaaaaggatccttctgctgacattaagaataggttattagatggcaaagggtataaacagagagaacagacaggaaagttattgtagtaattcaggtgtgatataaatgtggcttggggtgatatcagtggaggagaagaaatctttaaatactggctgtatctggagatggaatacacagaatttactgatggactagatattggaagaggagacaaggatgactccagattttttggtctgaacaacaaaatggatggtctatttaaggacagtccttaaatagcaataaggatggttaatgtatgagagagcaggttttaggagggaaattggaagattggtattgaacatatggaatttcagatgtctattagatgttagaagtttaagagagaggtctgaactggaaataccagcatgaaaatgtatttatatcattagactggatgagattaccaagagagtgcgtacagagagagagaataccaaagacaccgtggggcattccatcattcagtagaagaggaatcagaagtggcagcagtggagactgagaaggtgtgaccaattacataggaagaaaatcaggagagtgtgatttaccagaaacccagtgatgcaaatctatcagggagcaaggaatgataacctgtgtcagtgctgctgaacataagtaagatgagagctcagtattgaccactagagactattgatgatcttgatgagcagttgacagagtggtcaggccaaaaatctgattgtagttgatttaagagagaatggtggaaagagaggaattagagatagtttttgtaagaagtttaactaaaaaagggagcaaagaaatggggtcatagctgctgggggaagttgagtcaagaaataacagcatgtttgtttgctaaaggaaattgatgtaggtgacagatgggagagtccctgtaatgttcttgagaaggcaagaggagattggatatcttgcacaaaaaggtgaactggccttaggtagtatcatagagacttgagctaagggaaagtagaatatgtgggtgaaaaatcacagtaggtgggtatttgtagtggtgagtctgtggaaatgttctttgctttaatttctctcaggtaggaaatcaccaactgagggtgaggacagaggaggaggtattggagcttttaagaacagaggtataaaatactattattccaggagagtaggaggaggaatggactagggaaatataatatggttgcttggcagcctgaacccattttgaacccatcagcataactgtttttctctatggagtggtgtttatcatcacttttttcaaaatgtgaagtataacatttatacagaagagtatgtagaatacatatttctagaatcatccagttcaagagatagaacattactgccaccccaggagctgttatgttcccttctagataaataatcctttcttgtcctctggaggtaatcactatcctggtttatgataatttcactgcctttctcaagttgtaccacatacgaatgcatacctaaacagttggcttaattttgcctatttttgaattgtatttttcttacctctgattaattttttaatgaaatttatacacttagttgcatttaggtatagttcatttactttcattctgtcttttaaagattttacttacccactttactgttaattgacattctttttttttcagtttagggctattataaatcatacttttgagaatatacttgtacatatatcctggtgcatatgtccatgaatttctttagcatatatacctagaagtagattaatttgatcatagtatatagctattttcaattttattgggtaatgcaaaatcatttccaaagtgattgatggtaccaatttctactctcaccaacagtctataggagttcctgttgttctatgtatttatccaatactttgtactgatggacttttaaattttagcattctggtgggtttataactcgttgttttactttttatttcccttcttgcaatgaggttaaatatctgttcacattatttgccagttggattttcactttcacgaagtacctttcatgatatatgcccgtgtgtctgtttcatatatgggaggaattctttatatgttcctacaagcctccagagggaggcgtagagtatggcaatttagttcttcaataattcttgtgttttaactgtctttttctagtttatggaccagaattcttgcctttcatggtagtattcttctatttttgttttgttttgtcttgatttgtttttttgaggcggagtctcgctctgtcccctaggctggagtggagtggtgtgatctcagctcactgcaagctccgcctcccgagttcacactattctcttgcctcatcctgccgagtagctgggactacaggcgcccgccaccatgcctggctcctttttgtatttttagtagagatggggtttcaccatgttagccaggatgatctcgatctcctgacctcatgatctgcccaccttggcctcccaaagtgctgggattacaggcgtgagccaccatgcccagcctcttctgtgtttttagagtacgttttctatcccaagatcatacagatgttattttatattaccttctgaaagctttatatttttgtcttttgtgtttaatccacatgaattgattgtgtaaaactggagtccaatttaagttttttttccagtttgatattttatataagggtatccagttgttccagagctaattattgaaaatacactgttctgcagtgtcacctctgatgtaaattaaggtccagatatgtgtgggtttgtttctggatttctcttggttttattgtttaaccgtttatcagtatcacactgtttcaattacagtaggttcatggtaagacctgatagagctagtcttcccactttgttttttttcaatagtgtttacctatgtttaacactttgcctttccacttaaaggtaaaaatcgaattgtcaaggccaccccacctccaaatatatgcacaagtgattgtattttttattgtagcagaatacacacagcataaaatttaccattttaatcattttaaagtatcttcatattgttatgcaaccatcaccaccatccatctccagacttctttatcttcccaaactgaaactctgtacctgttaaacagtaactccccatttccacttccccccagccactggcatccaccattctacttactgtctctgaatttgactactgtaggtacctcacgtaagtggaattacctgatatttgtcctgtttctgacttatttcacttcccataatgttttcaaggattatcgatgttgtagcatatatcagaatgtctttactttctctggcggaataatagtctgttgtgtatttttaccacattttgtttattcattcatctattagcggatacgagttggttacaccttttggctattgtaaataatactgcaatgaacattgataaaaaagtatctgtttaagtccatggattcaattattttgggtatataccaaggagtgatattgtttaactttatgaggaacctggatactgtcttccacagttactgtaccattttacattcccagcagcaatgctcaagggttcatatttctccacatccttgtcaacacttgtattctgttgttttgttttaatatagctatcctaatgggtaggaagtggtaccttaatgtggttttatttgcatttccctactgactaatgatgttgagcatcttttcttgtgcttattgtccacttggatatttcctttggcaaattatctgttcaagtacttttcttattttcaattgggtggtttatcattttgttcttgagttataggagttctttgtatattctagataacatgatttgcaaatattttttcccattctgtcagttgtcactttcttgataatgtccttttatgtacagaagtttcaaattttgatgtagtccaatttaccttttttctttttttgcttatgatatgaagcataagcaaaaacctttttttttttttttttttgcttgtgaaggaaattaaagaagacctcaataaatggaaaagcatcccacattcatggattgaaagacttaatattgttaagatatcaagactacccaaagcagtctacaaattcagcacaattcctatcaaaattccaagaactttttttgcagaaatgaaaaatttaaaaattttgattaagtccagtttttaccttatgtcatatctaagaatacactgtcaaatctaaggtcataaagatttaccctatgttttcttcaaagttttatggttttagcttatatttaggtcttttatcaatttagagttgattttcatatatagtaaatatgaggtagggctcccggcttatttttttgtatgtggaaatccagttatctcagcaccatttgttgaagagactgttttctcattgaatatcttggcactctcatcaaaaataagttggccatagatgtatggttttatttatggactctcaggtacattcctttggtctatatgattatccttatgccagtcccacactattttgattactctagttttgtagtaaattttgaaactgagaattgtgagtcttccacatttgttgttgttcttcagtattttagctattcagggtcctttgcaattccataataacttgagaataatttgaggatagaactttatatttttgcaaaaaaagttatagaattttgatagggattgtgctaaatttgtaggttgctttgggtagtcttgacatcttaacaatattaagtcttccaatccatgaatatgggatgcttttccatttattgaggtcttctttaatttccttcagcaatgccatgtaattttcagtctataagtctttcatctccttagatttatttctaggcattttattgttttagatactattataaatagaattcctttctaaatttcttttatggattgttcattgctggtgtggagaaacacaactgatttttatgcattgatcttataacctacaactttgatggatttgtatatagctctggtagctttcttgtggattcttggggatttcctatatagcagattgtattagcctgttctcacactactataagaaatacccaagactgggtaatttataaaggaaaggttttaattgactcacagttccacattgctggagaagcctcaggaaacttctaatcatggtggaaggcaaaggagaagcagacatcttcatagggcatcaggacagagtgagtgcaagcaggggagatgccagatgcttataaaaccatcagatctcgtgagactcactatcatgacaatagcgtgggggaaactgcccccatgatccaattacctccacctggtcctgcccctgacacgtggggattatgtgtattataattcaagatgagattttgggtggagacacagccaaaccatatcacagatcatgtcatctgtgaataggtgtagttttacttctttctttccaacatggatttatttcattttcttgtgtaattgcttatagaacttacagtacaatattgaataatagtggtgaaagtggccattctactttctttctgattttaaggcaaaaatttgcagtacttcaccagtgagtattttagttgtgagttgttgttgttgtttttaataaatgccctttatcaagttgatgaagtcccctactatataggttcatttttttggcatgttgaaatctacttgttccagcattatttgttgaaaagactgtcctttctcccttgaatcacctttgctccactgttagagagcagttgactatatttgtgtgagtctttttctggaatctctattctgtcccatttatctattctttcaccagtaccacaccgccttgattactgtacttttgttttgttttgtcttgaaatggagtcttgctctgttgcccaggctggagtgcagtggtgcaatctcggctcactgcaacctccgcctcccaggttcaagcaattcttctgcctcagcctcccatgtagctgggagcacaggcatgtgccaccatgcctgtctaattttttttgtatttttagtagagacagggtttcactatgttggctaggctggtcttgaactcctgacctcaagtgatctgcctgcctcggcctcccaaagtgctgggattacaggcgtgagccactgcaccagctgattactttatagtaagtcttaacattgggtagtgtcagttcattgactttgttacttcagtatggtgttggctgttttggtgttttgccattccgtatatacttgtgaactagtttgttggtatccaaaaaaagaaattgctgagattttgattgggattgcattgaatttataaatcaagttgggcatcccacttggtcatggtgtataattttttatatacggatattcaattttctaatattttgtttaggatttatcatctatgttcatggtagttactagtcagtagttttcctttcttgtgatgtctttgcctagttgtgagatttggataataactggcttcacagaatgagttatgatataccctctgctgttttctggaagaaattgtaaagaatttgggtaatttctttcctgagtgtttggtagaattcaccagtgaacctatctggatatggtgcctgctgttttggaaggttattatttatcggttcaggttctttaatagacctaggcctattcagattgtacgtttctttttgtgtggctttcggcagattgtgcctttctgagtaattggtacatttcatctgttaccagatttgtaggcatagaattgtttagtattcctttattattgtttttatattcataggattaatagtgatgaccacttttctaaaatttttgatattaataatttgtgtcttttgtctctttttcttggttcacctagctagatatcgatttcatttatcttttcaaagaacaatattttggttttgttgattttctggtgtttttttggttgtgtgtgtgtttttgtttttttggttttttttctggggggacaaggtctcactctgtcatccaggctggagtgcagtggcacaaccatggctgactgcagcctcgacttcccaggctcaaccaacccttccacctcagccttccaagtaactggaactacaggtgtgcaccactgtggccggctaatttttttatttttatttttttagagacagggtctcactatgttgccaggtctgaactgctggcctcaagtgatcctcccactttggcctcccaaagtgctgggattacaggcatgagccaccacacccagcctgattttctgcttttacttgcattgatttgttcaatttttatttctttttttctgctactttgaatttaatttgctctgtttctagtttcctaaaggtaaagcttagattattgattttagctcttttttcttttctaacatatatatattcagtgctataaatttccctgtactgctttcattgcattttacaattttttattgatatataatagttgtacatatttatggggtacatgttatattttgatacatgcatacaatatgtaaggatcaaatcaggataattgggatatttatcaccccaagcaatgatcatttttgtgtgtgtgttgggaataattcaaagcttctcatctagctatttgaaatacataactttattgttaactatagttgccttaccatactatcaaaaactagaacttattccttctaactgtttttgtagccagtagccagcctcccttcactgctcccttccacccttcccagcatctggtaaccaccagtttgctctctacctccatgagatcagttttcttagttcccacatacgagtgagaacatgggatatttgtctttctgggtttggcttatgtcacttagtatcatgtcctctagttccatccatgttgctgcaaataacagggtttttttttatggctgaatagtattccattgtgtatatatgccacattttctttatccagtcatccattgatagacacttaggttgattccatatcttggctattgtgaatagtgctgcagtaaacatgggagtgcagatatctcttcaatatactgattttcctttcttttggacacatatccagcaatgggattgctggatcatatggtggtttcatttttacttttttgaggaacctcaatactgttttccttagtagccatactaatttatattcccaccagcagtgtacgagtggtcccctttctcccgccacatcacatgttcctcttgcgtagtacaatacaatcatctcttcccagtagtatccaaagtcttaactcattccaccatcaactcaaaaatccaaagtctaaagtcttatctgagactcaagacacatttctttccacctattagcccgtaaaatcaaaaacaaattcttaacttccaagatacaacagtggtgcaggtattaggtaaacattcccaatccaaaagggaggaattggccaaaagaaagggaaataggccccacacaagtctgaaacctagcagggcagacattaaagtttaaagctccaacataatctttgactctgtgtcccgcatccaaggcacactggtgcaaggggtgggctcccaatgccttgggaagctccatccctgtggctctcacaggttggagtctggtgtctgtgccttttcaatgctgagggtgcaagctgctggtggctctacccttcttgggtctggaggatagcagtcctgttcccatagcttcactagactgccctggtagggagtctgtgttggggatccaaccttacatttcccctcaatactgcactagcagagtttctgtgtgggggctatgtcctgggacagacttctgcctgggacccaggctttctaatacatcctctgaaatctaggttggaacctggcaagccttctttccttttgaatgctgcacacctacagccttaataccacatggaaaccagcaaggattacagcttgtgctctcagagcagtgccccaaactgtaccaggggcccttttgagctgaggctggagcagccaggatgcagggagcagcctcttaagatggtgcagggcagaggctccgcaggcctgacccactaaaccattctttcctcctaggcctctgggcttgtgatgggaggagctgccttttgaggcttttttttttttttaaattgtcttggatattagcacttggctcttttttagtaatgctaatctatctagcaagtggttggttcacagcccacttgtattcttttgaatgctgcacacttacagccttaataccacatggaagccaccaaggattacagcttgcgctctccagagtagctattgtaaatgagattactttcttatttttcagattgtttgctgttggcatatacaaatgatactgatttttgtatgttgattttatatcctgcaactgtactgaatttgctatattagttctaacagtttcttttctttcttcttttttttttttttttgagatggagtctagctttgtcacccaggctagagtgcagtggtgtgatctcggctcactgtaacctctgcctgccaggttcaagcaattctcctgcctcagcctcccaagtagctgggactataggtacccacgaccacgcctggctaatttttgtattcttagtagagacggggtttcaccatgttggacaggctggtctcgaactcctgacctcaagtgatccacccgcctcagcctcccaaagtgttaggattacaggtgtgagccaccatgctcagcctctaacagtttcttgatggagttttctttggtttttaaaatatacaatcatgtcatctgtgaacaaggttaatttgacttcttcctttccagtttggtagttttcagcagtgaagccatccagtcctgggcttttctttgatgggagacttttaattactgtttcagtttcattacttgctattggtctgttcaggctttttctttctttatggttcagtcttgacaggtgtacatgtctatgaatttgcccattttttctaggttatctaatttgttggcatataattattcataaaatctctgatgatcattatattctagggtattgattgtaatttttttcatttatactttgagtgttttctctttttttgttagtctagcaaaaggtatgtggactttatcttttcaaaaaacaatttttttctttcagttatcttttgtatttttcagtctgaattttatttctgctctgatctgtattatttctttctactaattttagattttgtttattcttgtttttctagttccttgaggtggattgttcagttgtttatatgaagtttttctcctttttgatggaggattattgctatgaacttcctacttagtattgcttttgcttgtcccatagattttgatatgctgtgtttccattttcatttgctcaaaaaaatttttagatttcctttttaatttctttattgacccattttttatttaggagcatgttgtttaattttcacatatttatagttttcaaagttccttttttttttttcctgaggcagtgtctcactctttggctcaaggctggagtgcagttgcacaatctcagctcagtgcagtatccacctcccaagtagctgagagtacaggcatgcactactacacccagctaatttttttgtagagatgaggttttaccatgttgcccaaggctggtctcaaactcctagactcaagtgatctgcctgcctcagcctcccagattgctgggattacaggcatgagccaccacacctggcccaaagttcccctttaaaaaagaataaaaatctagttttattctgctgtggtcagaaaagatacttgatacaattttgacttttttgagtttgctgagacttgttttttctcctaacgtgatctgtcctggggaatgttccatgtgctgatgagaagaatgtatattccacagagctggatgaagtgttctgtaaatgtcagttatcattatatagtgattttttgggtctctttttaagtgtttgttgtttattttatctgatataaatatagctattcttgctcttttttgttttccaattgcatggaatatctttttccacccctttactttcagtctatgtgtctttataggtaaagtgagtttcttatcggcagcagatcattgggttctgtttttctattcatttaatcactctatgtcttttaattagaacatttagttcatttacattgttattattgataggtaagaacttcctcctgtcattttgttgtttgttttctggttgttttgtaactccttttttactttcttttctttctttctctttcacctttctttatgattgtgcaaatttctctggtagtatgttttaattccttgctgtttatttttagtgttacctattataggtgttttgctttgtggttactatgaggcttacaaaaaacatcttataagttattctgaatatatgagaactcaatgttgatcacaaagaaaacgacaaaaaactttacatcgtaatttcatcccccacacacattttgacctcttgttgacacaatttacatctttttatattgcctgacttttaacagattgttgtagtttttactttggtagatttagtcttcatactagagataccacagttacagtattagagtattctaaatttgtctgtatatttttaccaataacttttataacttcagatattttcttgttgcatgttagtgtccttttgttccagattgaagaactacctttgacattttttataagatgaattccttcagctttcgtttgtcttcagaagtcattatctctcatttatggttgaaggatagctttgctggggacactgttctcagttggcagtttttttttttcctttagctttttaatatgtcatcccactccattcaggcatgtatggtttctactagatgtccattaacagatgaattagagctctttatatgttatgcttcttttttttctgcttttatgctcctctttttgtttttgacctttgagaatttgattattgtatgccttgggatagtcttactggagtttaatctgtttggtaatctttgaccttcctatgcctggatatttatctttctatagatctggaaagttttctgttattatttctttgaataagctctgtaccccttgctctttcttaactatgtcttgaaggccaatgactcttaaatttgctctttttaggctattttctagatcttatatgtgttcttcctttttactctcctatgtctcctctctttatatattttcaaattgtctttgagctcactgattctttcttctgcttgattagttctgtcaaaaccctctcatgcattttcagttcagccaatgtatttcacagttccaagatttctatttttttaattttttaatctgtttgttaaatttttctggtaagtttctaaagtgttttactctgctatcttggagttccccaggtttctccaaaattgctattttgaattcttgatcagagaacttacacatcttcatctcaggttggtagggtgtcactggctccttgctttgtaaatttgggaaggtcgtggttccctgtttgatgttgtttcttacagatgtacatttatgtcttcatattgatttgttatttattctagtttttgctatctgcctttgcttggtctttcaggtgtcgtttgttgcattctcttagacttagatcactgccttcttttcagcactagatggcaccctaagcccaggtttgcctggctttcacaaacgttcggcgcactgaccatcttgggttaggggatgttccaaaggggattccctggctggggttggtggggaagggaattagctaggagtttgtgcgcagaggacccgtggaatgtgcctcctactgctgctgatccactgtccctctgatttggcatctcctttggctgagatgaagagcagccccaagtttcctttgctggagttgctagccctacttccacgtttgtccatagctgtcttcagattttctcccaacaggcactagcaatgcttcctgtgggttgaggcaggaacagctttcctgcatagtaaccctagacggtagggaaactggctgtctaccttagtctcagtttctccaggataggaaccgtaagtcttgggagacttttttatccagtgcctaataacttaagggaggggcatcatggatagagaagtcgaggggcatcatggatagaaaagtccattctctcttaatttttcacttttttgtgacaccaaggattgtcacagcctcagttttgagttctggaatattgatggtgataatgttgtcactgtatagttgtttttcattttctgtacgggaaaatcaactcagattgcttctactctgccattttggtaacatcactgcattttacaaattttgatatgttgtatttttattttcacttagctcaaaatattttaaaatttctcttgagatttcttctttgacctgcttgttactcagaagtgtgttttttaatcttcacatgtttgggaatttgccagctatctgtatttatatattattatatatttctagtttaactccattgtgctctgcatggtaatattgtaagacttatttttaaaaaataaagtatactttatgtcccagaatgtggtctctccgtggatgaatgttccatgtgagctggaaaggaatgtatattctatttcttgttggatgatgaagtagtgtgtatatcaattaaatccagttgactggtgctgctgttgagttcaactgtgtccttactgattttctgcctgctggatctgtacatttcagatagaggggtgttgatgtctccaactataatagcagattcatctgtttctccttgcagttctatcaatttttgccttatatattttggcactctgttattaggtacatacacattaaatattgttatatatatagttatgtatatatataattttttaaaattttttatttatttattttgagacagagtctcgctctgttgcccaggctggagtgcagtggtgcgatctcagctcactgcagcctctgcctcccaggttcaagcaattctcctccttcagcctcccaagtagctgggactataggtgcagaccaccatgcccggctaatttttgtattttttagtagagatggggtttcactatgttgggccaggctggtctcgaactcctgacctcaagtgatccaccagctccaaaagtcctggaattacaggtatgagccaccgtgcctggccatattgttattattattttttttttttttggagaattgatccctttattattatgtaatgcctctctatctgtgatgatttttcttgcactgatgtctgctctgtctgaaaatatgcttactctcacattttttggattagggttagcatgatatttttgtcaatctctttacttttaatctatgtgtcttaatttttttttactttattaaaatactgagttttatttcacatgtatatttttgcctccccaccatttccatgtctgaccaccactactactatgtcctatcataacattccatacatacttaaaaccaagcaaagggtggagttccatctttaaaaactaaacaggcattttgggcaacacattcttggcaatagagcctggacaacatttatcaaacacagtagggaaagttctcactgcattataaaaaggacagccagatatcaactgttacagaaatgaaataaaatggaaaatttttaacaaattgtttaaactattttcctaaagagacttcctccactgccagagattttgaataacctcctggtcagtcatccggaagcactcctcacataattgatgaactgcttgcattttaatgtcttctacagaactaggtccttttcgtgttttaggagttttttcctgttttttgaaagattcttgtccttttgatcttggtgttgatggttttcagtcttttccattctgatttgacttctgtgcatttttggctggagtatctcgtatggatttcctcactggtgctttttatccagtttcctcatcatcaaaatcatcatcatcgtcattttcatcatcatcttctgcatcagcagcaagttttacttttttctgtggaacttttctgccacctccgggggcagatcgctttccagataaacttgagtttcacatactcctcttcttcatcttctgactctgcatcttcctccacagctactaagtgctgtccactaatatgcactggctctgaagcacacttcaaccgtaagatcaccagtggtgttatttcaaggcccccagaaaccattggctgtacagacattttcaaagttgccagtgttactttaatcggactgccttcataattcattgcctctgtttcaacaatatgcaatttatcctttgctccagtccctgaaatcaccgttcttaaagataactggtgctcattttcatcattattcaccttaaagtgataatctttgtcggccttttgttgacaactgaaaagatagttctggggcctcagagggctcatgtccatgtccatcaaatcttccatggggtggtgacacgcacttaggtgggagagaaggtggacagagataaacgactgctgctccagagaacagccgcgcaggatggaatcacaccagggtatgtgtcttcatatttaaagtgggtttcttttcaacaaaatatagctggtcttattttttttatctgatccactctgacaatcttttgattagcatatttaggacatagatatttaaagtgattatgaatgtagttgggttaatatctattatatttatcattgttctgtatttgttgcccctgtttctgtttttctctttcaatcttttttcatcatttgtggttttaattaagtatttcataatgattccactttcctttcttagcatattaatgttatttatatgtgtgtatgtattttcttttttagtggttgccctagagtttgcattgtacatttacaactaatccaatttgactttcaaataacactatacttctttgtgggtagtgcaagttcccaataataacaaaatattcctaatttctaccctccatcccttatatcattgctgttattcatttcacttatatatgttatacattcatagcatacataattgaatatattattgctgttactattttgaacaaactgctatttgtttgttcacaagtaaaatcaagtaagaataagaaaagtagaagtttttattttacttttacttatttctcctccaggatgtttactttctttatgtagatctaagattctgacctatatcatttttcttctctttaaagaacttattttaacatttctcacaagtcagttctgtgggcaaaaattacctcaaattgtgtttatgaaagtttttattttttcttcacctttttttgcttgcattttttattgtagaaaaacacataacaataaatttacaatcttaaccatttttaagtgtacagttcaatagtgttaagtatatttacattattgtgcaaccaatctctagaatttttttcatcttataacactaagactctgtacccactaaatactaataattccctctttctcttctctccagcccttgctaaccacatttctgctgtttcttttctacaatttgactactttagatacttcatatgagtggactgatacagtatttgtccttttgcaactggcatattttgcttagcataatgccctcacggttcacctatgttgtggcatgtgacagaatattcttttatttttaaagatttcataatactacattttatgtatataccattttccttttccattcgttgtcaatagacatttggattgtttccactctaccccttgtctattataaataatgcttccatgaacatgggtgaaaatttatctttaagatcctgctttgaattctttctggatatatatccagaagtgggattgctgaatcatattctaattgtctttttaattttaggagtatctccttactgcttgctctctgtactacctgcaccattttacattcccatcaccagtgcacaagggctctccacatgctcaacttacattctgctcttttgttagtggccattctagtgagtatgagtcgatatctcattgttttgatttgcatttccctgatgattagtgatgatgagcatcttttcaagtatttattggctattcgtatatcttctttggagaattttctatccaagtcattttctcatttttaaattaggtttttttttttttttttttttactgttgagttgtagaagttccttatatagtctggatattaaccccaaatcagatacatgtgttgcagttatttttgcccagtccataagctgccccttcactctgtcgatcatgtctgtttatgcacaaaagtttctcgtagtcccatttgtctatttttttcttttgttgcctgtgcttatggtgtcacttccaagacataattctcaaatccaatatcctgaagtttttcccctatatttttttctaggagtttaatagttttaggccttacatttaggtctttaatcccttttgagttaattttatgtaaggtgtaagttaaggtccagcttaatatttatttatttatttatttatttatttaggcatgtggatatcccagttttcccagtaccatttgttaaggagactgtcctttattcactgtgtcatcttggcatccttgtcaaaagtcatttggccatatatacaagggtttattcctaggctctaaattctgttccattggtgtatatatatctgtctttattctagtaccataccatcttaattactgttgctgtgtagaatgttttgaaatcagggagtatgagtcttccaattttgttcttttcaagattgttttggctattcatagtcccttgagaattttacgatgcttttttctgtttctgcaaaaaatgtcattggtattttgataagaattacattgaatctgtagatcactgtgggtagcatggacagtttgacaatgttaagtctttcaatctatgagcctggaatatctttccatttatttctatcttctttgatttcttgtggcagtgtttagtttgtagtgtagaaaccttttaataagctcaagcttattccaaagtatttatcctttttgttgctatagtaaatggaattgttttcttaatttcctgttttgttttgttttttttacaggttctttggttgaaggataatttcctttgtgaattgattgttagtgtatagaaatgcaatttttgaattttgattttgcatcctgtaactttgctgaatttgctaattttaacagtttgtatggaatatgtcttctgtgaagggaattaattttactgattttccaatctgtatgttttctatttcattttcttgtctaattgctctggatagacctcctagtactgtgttgaatagtagtggtgagtgtgggcatccttgccttattcctgctcttagagggaaagtttcagtcttcttttgttgactatgatgttaaatgtagccatctcatatatgacttttattatgctgggatagtttttttctattcctagtttattgagtatttgtgtcatgagattgttgaattttgtctgcatcaattgaaatgatcacctggttttgtccttcatcttgttaatgtggtgtattaaatagatttattttcatatgttaaaccatcctttcattccatgaataagtcccactggtcatggtatataatccttttaatgtactgttgaattcagtttactagtattttgttgaggattttcacatcagtatacttaagggatatttgcctgcagttttctttttttgtatctgtctctcattttggtgttaaggtaattctgacctcatagaatgagtttggaagtgttgcagttctttttttttttttttaagactttattttttagagcagttttaggttcacagcaaaattgagtagaatgtactgagatatcccaatatcccctgccctcacacaggcaaagccttaccaattatcaacatcctgcactagagtggtccatctgttgcaactgatgaatgtacatgaacatatcattatcctccaaagcctatagtttacattagggtttactcttggtgttgtatgcctcccctattatcaacatcctgcaccagagtggtacatctgttgcaactgatgaacctacatggacacattgttatcctccaaagcccatagtttaccttagcgtttattcttgttgttgtacattctatgggtttagacaaatttagtgacatgtgtccatcattatagtatcacatggagtaggttcactgccctagcaatcctctgtgttctgcctgtttatctctcccttcccccatcccctagcaaccactgaccttactgtttccacagtcactttttcaaggatgtcatgtagttggaatcatatagtatattgcctcttcaggctagcatactgtgttcttttgtctttttttttttatatatatactttaagttctagggtacatgcacacaacgtgcaggtttgttacatatgtatacatgtgccatgttggtgtgctgcacccattaactcgttatttagcattaggtatatctcctaatgctatccctccccctcccccaaccccacgacatgccctggtgtgtgatgttccccttcctacgtcccagtgttctcatcattcagttcccacctatgagtgagaagatgtggtgtttggttttttgtccttgcgatagtttgctgagaatgatggtttccagcttcatcctacaaaggatccctacaaaggacatgaacttatccttttttatggctgcatagtattccatggtgtatatgtgccacattttcttaatccagtctatcattgatggacatttgggttggctccaagtctttgctattgtgaatagtgcctcaataaacatacatgtacatgtgtctttatagcagcattatttataatcctttagctatatacccagtaatgggattgctgggtcaaatggtatttctagttctagatccttgaggaatcaccacactgtcttccacaatggttgaactagtttacagtcccaccaacagagtaaaagtgttcctatttctccacatcctctccagcacctgttgtttcctgactttttaatgatcgccattctaactggtgtgagatggtatctcattgtggcatttctctgatggccagtgatgatgagcattttttcatgtgtctgttggctgcatcaatgtcttcttttgaaaagtgtctgttcatatccttcgcccactttttgatggggttgtttgttttttttcttgtaaatttgttggagttctttgtggattctggatattagccctttgtcagatgggtagattgcaataattttctcccattctctaggttgcctgttcactctgatggtagtttcttttgctgtgcagaagctcttttgtttagttagatcccatttgtcaattttggcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtataaggaagggatccagtttcagctttccacatatggctagccagttttcccagcaccatttattaaatagggaatcctttcctcatttcttgtttttgtcaggtttgtcaaagatcagatggttgtagatgtgtgatattatttctgagggctctgttctgttccattggtctatatctctgtcttggtagcagtaccatgctgttttggttactgtagccttgtagtatagtttgaagtcaggtagtgtaatgcctccagctttgttcttttggcttaggattgtctggcagtgtgggctcttttttgagccttggtcattgctagcacagcagtctgagatcgaactgcaaggcggcagcaaggctggggggtggggggtgcccgccattgctgaggcttgtgtaggtaaacaaagtggttaggaagctcgaactgggtggagcccaccacagctcaaggaggcctgcctgcctctgtagtctccacctctgggggcagggtatagccaaacaaaaggcagcagaaatctctgcagacttaaatgtccctgtctgacagctttgaagagagtagtggttctcccagcacgcagcttgagatctgagaacagacagactgcctccttaagtgggtccctgacccccaagtaacctaactgggaggcaccccccagtaggggcagactgacaccccacacggccaggtacccctctgagatgaagcttctggaggaacaatctggcagcaccatttgctgttcagccatattcgctgtactgcagcctccgctgctgatacccaggcaaaaagggtgtggagtggacctccagcaaactccaacagacctgcagctgagggtcctgactgttagaaggaaaattatcaaacaaaaaggacatccacaccaaaaccccatctgtacttcaccatcatcaaagaccaaaggtagataaaaccacaaagatggggaaaaaacagagcagaaaagctgaaaattctaaaaatcagagcgcctctccccctccaaaggaatgcagctcctcaccagcaacggaacaaagctggatggagaatgactttgacaagttgagagaagaaggcttcagacgatcaaatttctccgagctaaaggaggaagtgcgaacccatcccaaagaatctaaaaaccttgagaaaagattagacaaatggctaactagaataaccagtgtagcaaagtccttaaatgacctgatggagctgaaaaccatggcatgagaactacatgacagatgcacaagcttcagtagccaattcaatcaactggaagaaagggtatcagtgattgcagttctttcaaagagtttctgttttgattctttcaaagagtttgagaaggattagtgttagttcttatttaaatatttgtggacttctccagtgaggacttctccagtgaatctatctggtcctggccttttttgttgggaggcttttaattactatttcaattctttactagttacaggtatgttcacatagatttcttatttcttcatgatttagtactggtaggctgtatgtttctaggaatttatccatttcttctagattatctggtttggttgtaatttaatactagcctcataattctttttatttctatgacatcagttgaatgtcttctcttttatttctaattttagctatttcagtcttctctccattttagttattgcagctaaagatttgctaattttgttcatcttctcagaataccaactgttggttttgttgtattttttctatcttttttcctgtttgtttcatttgtctctgctgtaagctagttgtggatttagcttatttttcattattcctttaagtgtcaggttaagttgttgatttgaggtctttcttcctttttaataagactttcctcttaatactgtttttgttgcattccatcagttttggtatgctgtgttttcattttcatttatctccagatattttctaaattcccttgtgatttcttatttgacccattggttgttaaaaactgcattaattcctatacatttgtggatttgcctgttttttgttttttttgctattgatttgtagtttcattgtgctgaggttggagaatatatttgtatgacttcaatcttcttacatttaaggcttttttcgtggtctaatatgtagtctgtcttggagaatattacatgtgcgtttgagaatgtgtatcccctgttgttgggtgaagtgttctgtatatgtttgttagttccaattggtctaaagagttattcaagtcatctgtgtcttctgtttgatcttctgtctggttgttctattcttactgaaagtggggtattgaagtcgcctgttagtattgtgttgctgctcatttcttctttcagttcttttttttttttttaaaggcggagtttcgctcttttgcccaagcttgagcgaagtggtgcaatcttggctcactgcaacctcctgccgctgggcttaagcgattcttctgcctcaatctcctgaatagctgggattataggcgcctgccactacacccaggtacttttttgtatttttagttgagatgaggtttcactatattggccagactggtctcctgacctctggtgatccgaccgcctgggcctcccaaagtgctggaattacaggcgtgagccaccgcacctggccatcttccttcagttctgtcaatgttgcttcacgtatttgactgctttgatgttagatgtgtatatatttattgttatatctttttggtgaatttaccattatgtcattatataatgcccccgtttttctcttatgatagttttttttcttaaagtctattctgtttgatatatgtatggccactcctgctctccagtttctcatttgcataggatatcttttccaccttttcacttttagcctatgtgtgctttttgtttgtttgtttgagaaggagtcttgctctgtcacccaggcaggagtgcagtggcgcgatctcggctcactgtaacctccacctcctgggttcaagcaattctcctgcctcagcctcccgagtagctgggattacaggcacacgccaccatgtccagctaattttttgtatttttagtagagatggggtttcaccatgctggccaggctggtctcgaactcctaacctcatgatctgcccacctcggcctcccaaagtgctggcattacaggtgtgagccaccgtgcctggtccccacgtgtttttagatataaaatgattttcttgtaagcactttattgttggatctcatattttttagccattcaatcaatgtcttggtatgtttgatctttttacatttaaaataattactgacaggaaaggactattacttttgttcattgttttttgtctgtcttaccgctttgtctttcctctcactgtgttttttgttgattttttctagtgacgttttgattcccttatttccctttgtatatattctacagatatcttccttatggttacccttgcaattccataaaacatcttaaaagttctaacaatctgttttaaactgaccttttaaatatttcaaactgacaaattaacttcaatcacatataaaaaccatgatccttgtctctctgcctcccattctatgttattgatgactcaaattgcctgtttttacattgcttatcatttaatgtaattattactttttatgcttttagaaaaattctgggccacgtgccgtgactcatggctgtaatcgcagcactttgggaggccaaggtgggcggatcacttgagttcaggagtttgagaccagcctgggcaaaatggtgaaacctcatctctacaaaaaaacacaaaaattagccaggcatggtggcaagtgcctgtggtcccaactacttgggggactgaggcaagaggatggcttgagcctgggaggcgaaggttgccgagagtcgagatcatgccactgcactccagcctgggtgacagagccagaccctgtctagaaaaaaaaaaaaattatataccagatttataagtgatttactcacctacattacaataatacaggattctatatttgtctatatatttaactttacctgggacttatgtttttattaatacatggttttatgttcctgtttatcagcttttcacttacttgtaggtgctcttttagaatttcctatagaataagtctagtggtgataaactccctcaatttttatctgagaaagtcttaatttctgtttttgtttgttttgaaagggcacttttgctaaacatagcattcttgattggcaccgcttttctttcgaatacatcatcccacttcctagcctgcagggtttctgctaagtctgctgagaatctaatatgagctcctttgtatgtactgggttgcttttttttttttttgctgctttcaagatctctgtcactagacagtttaattataatatgattatatgtctcagtgtagatcccttagatccctttagatttattctggttggaattatctgagattcttgaatttgtatatccatttctctcagatttgggaagtttccaaccattatttcttcacataggtcctctacccctttctttcttctccttctgaggttcccataatgcatgttttcttctatttgatgctatcccagaagtccctcagattctcttcattttccttcattctttttttttttttcttctcttcatttcttctctttttcttctttcttttttggggatttatcctgcttggtgttctcttaacttcctggatctgtggtggggtgtctgaaaccaatttcaggaaatccctagtcattataactttatttattgcttctattcttttctcttttaattttcttgatgtttccattatgcatatgctacattttctgtagttgttccatattcttgcatattattccattttttccgtcttttttctctttgcttttcagttttgtaagtttctagtgacatgtccttaagctcaaagatactttgctcaagatgtgtccagtatactaatgagctaatcaaatgcattcttcatttttgttagtgtttttgatctctagcactttttaattctttctcagaatttccatctctttgcctacattaaccaaccattgttgcatgttgcctaatttttccactagcaccctcagaatattaacggtggttgttttaaattcctgatccgataattccaacattcctgccatatctgagtctgtttgtgatgcctgctctgtctcttcaagctgtgtttttgccttttagtatgctttgtaattttttgttgaaagctggacatgatatactgggtgaaaagaattgcagtaaataggccgttagtcatgttagtagtgaggtacagggaaggggaagcattctatagttttataattatatctgaacctttttttaaaattaggacagagcgaagctctcactctggtacctaagctggaatgcagtggcataatcttgactcactgcagcctctacctcctgagttcaagccatcctcctgcctcagcctcctgaatagctgggactactggcacacaccaccatgcccagctaattttttttttttttggtagaaatggggtctttctatgttgcccaggctggtcttcaacatctggaatcaagcactcctcccaccccagcctcccaaagtgctgggattacagatgtgagccaccacacttggcctgtctcagtctttaagtgagcctgtggcccaagggtctgaacttcacaagtgcccgtcacttcttttcccagaattaggtgggacaagatggctggcgggagctggagttgggtatcttctgttccatgtaggttagagctgatgggagttgggtatttttgccctttccccaggtcagttagattctaaaaccacagtagattatgatctggtaaaatagtttttcttggggaaaggccttgttcagaacataatgcttctcccgaccacccccaatacctgaggggatttttcctggtagagcttcaggaggtaaaactcaaaaaagcactgggtcccctggaagtgttttaactctcagacttgtccacactgagtctctggcaatttatcacagttcaggcttggctaccagtactggttcttatggtggttttctactcagggtttctgctaagttgtgactctttgtatttgctgtctgtcagaaaagggaatgtttctcagctcttcaaaaggaatacttttcagaaggcccacaaagcagtgaaataactgaggatgcaagttgggtgaggaattactaccatggctatggttcctaagaaatcagtgcattcatgagttatttgaaaaggaactgttttattacctcatgtccagagataaagatcctaaggtctgtactgtaatagctttgactgaaggaaactgagagagttggtgctataggttgatttgtatcatggcactcttttatcatttgcctgtagctgtatttgcttaggagaaccatgcttcagtccacccctgcctctttctactttagttggggttgtttgtaccaaatgggttatttagaattaagttggattgggatgggcattgcaccaaatcaaaatttgataatttcacattttaggtcttataagcatgtaacacatactattatgtagtatgaaagcaaactgtgtactttgcatacatgaattcagttagttttcagagcagcctaattaggaaaaactgtcatgtctactttatggataaggaatatgagacttagaaaggtcaagtaaattacctgaggatacacgagcagctaaagggaagtggcagggctgcaattcaacctcctgactccaaacactagtaaatactactaccctactcttttcagtcactaccatttcatggctttcattcttcccattctccttctcttgtcattccctccaccctactcctacttttccttctcctcttcaactcactatgtcaaagagaaaaggaaagaccatttttgagacaaactaatttgctgaaagttcaagtctactagcagtatataatactcatttcatcatattctacattaacaaggtaaaatatccatttatatttctgctttaaaacctggcatgccctttgttcacatttctgttaggagcattactattttattattgatttgtatgcactatttagaaggaaattttatgtatgacttcctgtagtcacctttgccactcagagccgcaacaaatattagactaatctaatcaacaagcagaagtcatctagaagcaattgggctttatgcaaaaataatgtaggcccactgccccaagtgtaactgaaacggacaggttttttatttaatttcctttatatgtaggaaaagaaaaattttagattaggatgtacataaatttgagtttgttgaagttggctctggaagggtgttgtacaccctcatttcctagtggcctgaaaaagaataataaaagaataataatgaaccttctgtacttagtaaaaggaaatgctttttttttttgagatggagtttcgctcttgtcgcccaggctggcgtgcaatagtgtgatcttggctcatcacaacctctgcctcccgggttcaagcgattctcctgcctcagcctcctgagtagctgggattacaggcatgcgttacaacgcccagctaattttgtatttttagtagagacagagtttctccatgtcaatcaggctattcttgaactcccgacctcaggtgatccacctgcctcgacctcccagagtgctgggattacaggcatgagccaccatgcctggcctaggaaatgctttttaagtacttgaggtctggcacaatatttaccattccaaaactcccattacctttggtttttctcctcaggatgataaatcttcattcagaaaggctttgggtacagttgtagtttatctgcatagataatatcaaccaagttagacccaataaagagtaatatatagaatgactatttaaaatactatagggaaaagttggattttttttttttaagctagattacccaaagttaaatttggccaaagtggatatcaattcctagacttgggttttaacttaaatggatttatttatggcctctaagacaatcattttattctcactgcattcatgaaataattcactaacacatttctcccagagttgctaatgcaatgctctttccctcagtggagtcatctgattgttttagcgcaggcactatcatctcaccatcagaatatataagaaatgtttgaccttcaattaaagttgcagaatattatctgctattgtgtagcattctagaaatgtttataaaaatatgaaaccatgggagatgggaataaaaaatggtcttcatcccttctttgtgttaaatatctgaagaaaaaagtgttctggcttatgaattggaaacattttcatccctagtaaatacgtagctgcttaagtatatttcttaacactatgaatcgaaggggaatatttaaatgtgaccaaaaattctacatacataacctaggaggcaatataatacaacataacagctaagactgtgcaaaggctttagagcccaacagacctgggctggaattctggatcccccatttattggctgtgtgaccttgtgcaagtttcttaaccttgccaagcacccattcatgtgtaaatgtacctaatagtacttaattcacaaggtgtgtggtgggagggatttaaatcagtttatgaaaaatgcttacgatagtgcttggcacatagaactcaacaagtggtagcaattattattataaaagcaaaacaacctcttaaataaaaatcataaaatattagtgtcatcaaaattcagttattaaacatattttatgattaaaaagaagactgccaaaatcgtgaagcagttggaaaataaaaacattacacttgaaatttcaataacagtaagtttgagctagttgtatgtttgttttagaattttttggttatcatgagatttgacatcttaagtaaaaggtctgtttgttataccatgttctggtgtactctagtggttttgacaaggtatatacacacagatgttagaaaaaaaaaaacctttggttgttgcaattttctccttattgcatctaattgaaaacatagaggaaagtgtagaacacatctgtgggtacttttcataccagtgatagtaccatggaagccatggaagtctttaagagaactcctataggcttagaatgtagtgaaaatgttaggggactctataacatttgtattaccacccttacccttactccttacccacccacctgcaaaaaaacaaaaaagaaaaaaagaaactatcatagtaatcagctgcttcactgtgctaaaacgtatttctgttttggaaatatttgccaatgaaccaaaaagaatttggcatttggaaatatcttccattggcatagcttgtaatacaattcacagaaacttttaaaaacaacttgaatatagtatctgtaaactttcctatttaccacactttggggacaggatcttaaatcttcctatcttattcatcttcacttttgaagttctttcagaaatgttcatgctgattaatagttaaatgatttaagtattaacttacccatttctagcatatataatatagtagtagccttttagttgttttcttgcttctgaagcagccagcatccttacacattttttcattactcgttattgtcctcaaaaattgctcttcaagcaaaatgtggtttcctgtatttcctgtgtcattcaattaatgtatttctccaagtctaaccataagaactagataccacacactgtttcctaacagatggaaaatccttatgttttcacttaacatccctctattaagcagctctctctgggagctgtctcccttgccccattagtatgttaaagcagccagatccctgaaatataaatgataaaagtagatttcatatctgacattttaagttaccaggcatttttcctttatggcttaatcattgagatttttgaagattatatgtacaggaggggaaagatttttatttcagagactggaaaaaagcaacatagcattttagtagatttcataaaaatggagtaatagttaatttttataatttttttaaattttataattttttacttataaaattttactctagctattaaagacttctttttttataactacattttaacagcttttaatctaaccttaataataaatattagttcctttgcccagggcttggaaataatcagaaagagttctcaggcaaatctggctttttaaaatattttatcctgttgtattttgttgagatttcttgggaactggtacagggaaaagaagaataaaaaataagattcatttatttcttatttgctagaaaaaaagctgctattcataccaaacacacttttggactacagggcaattaaaaagaattcagtactaagaaaaaaaagctgctattgttttcttcactggcagaagcagcgagtaagtggcaactcatgactctaatgatgcatcatccctaggcagattatttataatgcatatgtaaagtcagtatcactagtgaaatctatatgtatttaaccctgaatcttcaatctcttttatcttttactttgaggaaacctattcttggtttacttgatacccgaactagtttggtatagaactgaacaattaacttctacatcaatttgtctgcactgtgactattttaactagctcagtttcaagccttgtttaaaaatggtaattcctctttctaaatttaattttatgtccaaatgtttttgttacagcctggccaaattcaggtccccatctaacttactatcatatttattcaaagactgaaagaaggccacaaggatgaagcatgaatgaagggtggattggtatgagatgagacaggatgtgggggtagagggatcaaatcatatatagctatatgaaggccatcataaggaggtcaaattttattctcagggaagccatttaaattagaatggcatgatgtgatatttcatttttaaaagatcactctaggtgctaaaaactacatggggcaggactagatgggagaccagagaggaggctcttagcataatctagaagattagaccagagtaatcaaggtgatggagagaaggggaaagattcaggacatgttttgcagataaaaggttccaggatctggtgacagatggtatgaaggctctaagcaaaagaagcatcaaagataggcctaggcctgatatttagttcatgccactgccttggctacctaggtctttgtgtgagtcttgttatgaagggccaatacttttctgtatctgatgagccaaagttttgggcttgaaatggggaaaaatcatggatgaacaagtttaaagaggagacaatctaagttctgtccagctacatgttttaacattcccagattgatgagatttactttaaaagtaccttcatgaaatttttctgaaactttattctacagcagttccaaaaacattccagacaaaagtgtgtcttattgtttcatataacagacatgaatctgatttcttccacaacttctgacatcttatccactagtgaattagcaaagttttgttagcctgcaggggtttctatgagggtttctcaccctcagcactactgacatttagatggggtactttggtttagggggctgttcagtacattatgggatgtttagcaccatctctggtccacaagatgccagccgcaactctcagttatgaaaaccaaaactgtttccagatatcaccaaatgtcctttgggagcaaaatcatccccagtttagaacccaactcatggtgctaatagtaacaaaactaacacttataaagcacttgttatagcccttttataatactaccagagccagtaggtaatgtttaaaatcttataaatcataaaaatagataaatgcctttaatttctattttaaatgtaattgtaaatccactcaacaattgatgttggaccacagccttttgagtatgaatccactggctggatttccaaattgccatggtacatgaagcattttctaccatttttagtttcaagtattttagtgggggaaaaactggattctgctttcatccttgctttctacatttgtccagtcttttagtttttttacccatacccaatttaaccactttttgactggggatgggttgaggggagcaactagctttttttttaaagtatttctaatgcattcaacctagctttcaaataaaaccagaagtcttttacactcacagtttatggactgctgaatatttaactaaattacataattaccctaagtaaaacaaacaggttcaatgaccactgccactagccttttgtaagcatgcagctgatcatctgttgggacaaaagcataaggttggttagagaatagcctcctagccagtcttctaccatgtgataagtaagtatgcctatcggctagttttactaggtaaaaattggttaagaggtattgtatgtgcgaaacaccatgtaaattactctacttgcattatctcttttaatcttcacaacaaccctaatacataattatgttaatgtttgtgttttgcctttgagaaaacaaacataaagataagtgttttacataaagttacatagctaataaaaggaccaggatgggaacctcaggcattctaatatgtgctttaccatttcatcacaagtccaaggccataaaggttaatttgctacagagcactaagctccagtttggtccatgatcacaaactgtaccttggaatcttgacctgtcatcttcaaactaagtgctacggcaataaaatatgggatattaatataaatctactacttggaacaattcaaaggattgataagaaagctcagtgattccaaatcatcaagtctatacatttaaagataacccaaatatacctgtattagtttcctatttatttgataacaaatcaacaaaagcttaatgccctaaaacaacaaaaatatattatctataggttagaagtttgacacaggtctcacagggccaaaaccaaggtgtcagcaggactgtgttcctttctggaggttccagggaagaatccatttccttaccttttctggcttctggagggcactcaattccttgacttgtgacccttcttccccctatcttcaaagccagtagttgcatctccctgaccattcatctgtagccacatcgccccgactctgaattttcctgcttccttcttccacttttcaaaacccttgtgatcacattgagctcacatggataatacaggctgatctccctacctcaataaaatgagccttagagccttggcacagctttgagccacagtcagttcctgttcagctacattaactgttttgtttttagtaggcgttttcaaaaggtgatgtgactcaaaggttgatttgtatgagaaatcagtcatgattgaattgcataactatctgtcctcaaagtccatgtaaatagatctatgtaattataattaaaaacaataattgcagatatatcagaggtcctttagtcttctaatagttgagtctaataagtctcaccaaattccacacacaagattctaacacatgtacatatgcatttgttacagaatgtaatttagatactatagtaaccaaattcaaggtaatggacaaaacttagtaattttcattaaagctttctatttcgggcttctcctgaatgtgtgttttaaatgactaggacattaaagggattgtttcagaagaactatcagcaccttttttatgtgtcatgttcatccagactatccatccagataattgctttatttctgatatgtcttccaaggttgttaccccgtgtgggataggcaatgaatttaactgtcttttgtccctaaaagttttataagtttttatctaacatattcatgtagtggaaaaaaactcacaaaagtgctttcaagcattcacagtggtgtctaagccactattaattgaaaaagctgctgtatttaaaaaaactgctagttcctgtgaaccaagatcatgccactgcactccagcctgggccaaaagtgcgagactccgtctccaaaaacaaacaaacaaacaaacaaacaaaaactgctagttcctttaaaaacttaaaaaacactggaactccaaaaagagctatgaattaataaatttctatgattataaaactgataaattccacagtaagacaattaaagtggcaatattaatagtataccctttattgaatacctatgtgcctggccctttgctcatttcatccttataacctgcaaggtaagttaatctttttactgataaagaactggatggcaaaggctaagcaacttgccaagcaccacagaatttggtaaatgctagagatttgaagtccagtgtgactcatttcaattctgtttttatttgctaatatagttaaacatttgagtatattctcatgtttccatttttatttaaaaaatgactcagtttgaacattttagtagtgaaattttatctggcattaaatatttcaaaactagcatttggttaggtagaacactgatgtaattatgagtcttactaaaatattttgcaaagataatcaaggtaaacaaatttgtcatcaatttttaactagtttaggtaaaatgttaattacttaaattgaaacttcaggtcctaggacttagataagcagatccttgagtccgatgcaaaaggcatcattcaaagataaatacatcaaaaggcagtaactgaggactaacttgaaaagtttgaaaggtgaaaaaatagttctctacatattttctgttttcaggagatgagtatgatgtatgtgccatttgtttggatgagtatgaagatggagacaaactcagaatccttccctgttcccatggtatgagtaattacgtactgctttgaatttacatatagtaatttatatttaggttccatattccaggggaagagatggaaaatagttattagcacaccagaagccaggccctgtactaattagtggtctcattcaaggatggaggtgtatttataaaaatttataaactttcaggccgggcatggtggctcacgcctgtaatcccagcactttgggaggccgaggcaggcagatcatgaggtcaggagatcgagaccatcctggcttacacagtgaaaccccgtctctactaaaaatacaaaaaattagctgggtgtggtggcgggcgcctgtagtccccagctactagggaggctgaggcaggacaatggcgtgaacccaggaggcagaggttacagtgagctgagattgtgccactgcactccagcctgggtgacagagcaagactccatctcaaaaaaaaataaaaataaaaataaaaaataaactttcttcccgtccctacatgatacatacagaacactgaataaatatggcaagagattaaatataaaagtatcaaccgcagcatactaactaaagatgtatattttgcttcaacagcttatcactgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccactttaagatccagtaaa

SEQ ID NO: 399 - DNA, 56585 bp, Homo sapiens
agcggcggccgcatcgcgcctgcgcagtgccctcgtcccccgcagtctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactgtgagtccgggccgaggcgacggacgccgtggggctgagtcagcgggaggccagggcccgggctgggggaggggaaccgggctccccccgcccctgcctccccacccgcactcccgcatcccgaccgcgccttccccgcgccggtcaaccccctccatccctgtcgccgggttccctccggccttggcggcccggcctccccagccactccccctccccttccctcccctccccttccctccgtctctccgggtccaccttgaggctccttccccactagacgtggccaccgcacctctgccctgggctgatattttctccaaactacctcccgtccgcccttatcccttctccctcctcctcactcctcctaggcctgacatctcccggcctctctggatctccccagtgatgtgccagaaaaagagtgacaggagagcgaggggagacttgggggagggggaacatcgggccaggcccagcctgggggcctcgggtttcttccccacacgctcctgcctggctggtttggggaagcaggtctggacagttctcactggctgctcagagcttgcagggctttccgaatagatttggctgggaagggttcagccccatcgtgatcatctagcgtttaatgaacgcggctagtgcctggtggccttctagtgggctgagctactgcccggccggtgttgcggagcggggagtagaagtagtggagggaagggagaagaggttgcgtttgggagctccaagttcctgcgcttccggtgtggtgttgtgaataagcatcttgcggaactctttaaaatgcttttttttttttttaaatcgcactacaaccctggtataatgtgaggtttggaaaaaggcctgataccatccataggaagtgcttactgtttatatatgaaggggctgtggcaggacttgatcttggattcctgtaaattaactaattggatagtagtgagtttttaacataacgtgtgcagagttgagaggaaggagaaaaatcgaagcttctccatggtgtaggtgtgaggcctgtacactgtgcctcctccagctgtgtgtctttgtggggctgtcaccagataggggttctagcatatttggacaattccctgggttatgtttgctacccctccacctgcccatcttgcagtccctgttcttggaatagaagagggtcccaaacagttttctttttccagaagaactgagttgaagtcagagttagtgcccagagccagaaactcttaataaacatgtctcaacttgagggcccctaactactatatgacctcattgtcagcttcttttttatttggcttccaaatttcagtgtgcttttagaaagcacgtgtaaatataagccagatctaccgcacaagaggctttgggatttttactccagatggtaaaaggaacgcatggtccatttctaaaaatcatggtgaaggagccactcatttggagtttccggggttgcaaacaatgagaaataactatttcactctttactttgctcaatcatggcctattggcagcctcctcatagccactccctgcccccatgcccatcagattagtttacagtagccaagacggctgtcgccctagttttaaacatagagatgaagttcaggaaaactatagcccccatccagcagggcagtttcttctgtttcgaatgccagactggggtttggtgggatgcacctgcctgtggtgcagtgggaactgtggggcctgagagtggcattccttctgtgtggtcctgtgtcacatagctcaccaaaatacccgagcagggcaggagcagacagctgtactggagagctgctcctcctgggctgagtgtattttgggaatcagcgatattactggggtggagggttgtgaattaaggaggaagaaaatgtgtcaaggctagatagatcaggagggtgtaagtaaaatgttcctttccagtttgctatgggatagtacattttcagaggatcagagtagtttttatatggattaatttgcctttgaaatccataccagtgttttatgagataatgatggaatgccttttaaactgctactatgaggaaacaggactaatacttgtcttatacattgcctatccagctgttgctgaatgtaattgttaagatcaaggagagggacatgatttgaaccaagttagacctaaatctatgtaatggtattgaggttttgtaggactgtattcttgattctaagacacaccagcaatttaccaatagcttttaggtaaaataatctaatgctaccagatcaaaatatatatgctgattccaaggtgcatcctcattttagaaacattaaaaccctcgggaaatggcaagacttgagggagggatttgtgaatcttggaactgagaaagaatgctattgatagtattcctgtgtgatgatgccgtttctgacctaccgtcctgagagtgcatgcattgtgaagctgagtttcttctagtccttcctgcacgccagcacacattgtggggttgtatttgtaagatgactggctggagttaggcatagtaggaggctattgaacggaggaaagttcccatatgagaatccaacccagggtcttaatgtggtactctccagaaactgagccaactaactggcagcaaacgtcttatgagctattcctgaatttagccgagtaacatttgtcagaagccgaacagaaaatatagtttttttttttttttttttgagacggagtctcgctctgtcgcccaggccggactgcggactgcagtggcgcaatctcggctcactgcaagctccgcttcccggggttcacgccattctcctgcctcagcctcccgagtagctgggactacaggcgcccgccaccgcgcccggctaattttttgtatttttagtagagacggggtttcaccttgttagccaggatggtctccatctcctgacctcatgatccacccgcctcggcctcccaaagtgctgggactacaggcgtgagccaccgcgcctggccagaaaatatagttttttaaaacagaatgcatctgccctgatttgcttacagatacatttgtaaaggtcccaaggcacatgtctccctcgcttaggatgttagcactggaggtgaccccagatggtatagtttaatgccctcatttctaaagttgacacaagacaccaagagttaaatgacttacctaaggtcacccaacccatgcagaacgtatgtaaaaacactttgtaaactgtgtacactaggcagatgaatgttggtggttattagtggctgagtcaggattagatctccagatttccagactagagttattcttcaacaccacattgcctcatccctcataatgttccaaagggttttaataaaaataatttagtagtccgtaattagccctgtaggcaagggcttgttttgtcatctgagatgctgcacagccaggcaaaattttgtgtcaaactgtctaactaaatatttattcttgccactttaaaaataatattttttatcacacattctgacttcaggaaggtctttctttttttaatttgcatcaactaacagaaaagcaaatgtgaagttgggtatttgaagtcttttctacttcttatctgtgagactgccgcattccagaaagcaaggtggagaggcagatggggctgagaggaggagcgtgcacattgggcagctgcgggcttatcttccacctctcagaatggaaccttttgtagtttctgggagccataaggacttctaaaccctctccttgggaagcgcggaggcagcctgacctctggaagcaggcagacttgagttcagatccccatccagccatctcctggctgtgtggccttgggtgagttatgttacctctgaatgccagtttcctcatttataaccctggaataataactatctgttttacagggttgttgtgaagattaaatgaaagggagtatgtagagtgcttgcttcataagaaatagcaatgattattttatattgactaaagcataaaatagcaaataatggtttcaaaattgtttcgtgatttaggtccatcttggactctcagttttgtagcccccatctctcagcacccctctcggtatttgacacgaacagagaaaaggtttgtaccgggaagacccggcacttgcattattatttcaactgccaaaaccggagtatatgaaatgtatctttgctccatgtattcagccaacctgaaagactggcaggacaggagcatttgactttaggaggcacagatgtggtgtgcttgggtgtgtggtgggggtggctagttctccagcagggaggccagtctggggagtggtcttcatttgaaatagaaaagctgctgagctcttgcttgtgagggacacacatgtggtctttattgacttcctcaactggtagaggcatagatttcatcggtgactttgctaaaatcagcttctgcatccgtgagatccagggggcaagggaaaggagctattcatcttaagagggaaaccttgccagtgagcagaggtaaagggaggtcattttggatggagagaattacagactggctcaaggcagaaactactgagtaattaaagaaccagggcaagctgttcaggtgcaagagcaaaagtgaatttaaattcctagataaatttcagtagggaaggaaatacccatgtatagacatctaaagattgaaaagaaacgcaataatgtttacctctgggaggtgggatttgggtgtggggaagggaaaaggagactcaaaggggaacttttactttatatgtttttgtatttgacttgttataagaagcatgtatgctttagtcatttaatgaagaccaaatagaatgggtagtgattgttgttcagtaaatacattttggtacaaaagaagcagctgcctttacttggagcctcccatgcctggggcaaatagggtttgacagcttcaagcaggcccaggcagtttgcaccaaatcaagctcttaagtgagggcaggaccctccaaagtggctgcttcccggtcagcccagggtacttaactgaccacctaccccatcaactcttcctagtcttttcactcccctcttgagaatagtcccctccatctgttgaccagctaaaataatcataattattctaataagctaattttcagctattgatgaaaatggcatctgactatatgaccttcatgaaaaattcctgcctcttagttaatgtcaagagggcttgaagtttaaagggacccaagctgaaatgctggcacactgtgtagctaagttctaggtcagacctggctggtacagcacatctttcacataatgactgattaactgcttctggtaggaattactggtaaactctgataaaatccttaaggattgttcagcttttaattttgtcgtaagttggccagctgtattttctagccagatgtcatgtttattatagaaagatgacacacctatcatttggacatgtgctttgggttgcttacccaggagttaggatgggttatgctgagtaattcacattccatcacccagtcttccctttggccaagagtacaatttcgtgtgacagttagccaagtttcgtgaagcatgctgtggccacggatggtttttcttgtgcacagagttgactggccaatactagcataagcctagatcttgcactcactagcaccatgccctaccagctttgctaaactgaccagatgttgttagtcaactttttagcataacgtcagtgttttaggctctggatgcttcatttgcctcaagtaaataaggacttgtcctatctaaaatgctttaactccatgcaaaatgattttttccctgaaactatttcctagatataggagatacataccacttgtgtgatacatttaaaataactgagcaagaagcatggcttcaaatctgccttgtagcttgactatatataaaaaagcttaaaaggatgtatatccttagaccagaaagtgccattctagcaatatttagaaaatcagaggtgtgtacagaaataattgtaaaagatttattaatgcaacattactagtaatatcaaacattgaaaacaaccaaaagtgccagcaactgaggattggtcaggctcgcccaaataaaatactgcatggcattaaaaacatttggagaagaatattaataccagaacttttaatatcagtgaaaaaagcaggatgaaaaatagtatgccaaggaaaaaaccatatttataaagaaaaacatgaaaaagatactagaagagcatgtgccaagtcataagtgattgagtaatgggattaaaaacgaatggctttccttagtgcttgttggtgttttctaagcttttctgcattaagcaactataacttaattatgacattttaaaaccagtgacttctagattccatgtagtagagcaatctttagagtcttctttgcctcttccttttactgtttacatgtatcggaaggttttagtaaaaccttgtataccacagggctctgttttgggtggccttcttttcccaggtgtcttttcagattctctgtattcccagttctccagtgttccaggggccttttttgagggttttgctcattttttggtgtggatgtgcacctgtctgaattgtctgtttcaaaagactctgcccaggcccactacagttgccttcctccctttgccctttgtcaccttccgttcagccatgagctcagaggccctttttccttccagggatagagagggttgggtgcccacctgtggccacccgatgggcagagccctatgtagacataggctaggccactccccctgtgccacaccaggtccatggagctgctgactgtgttggtagggcctggccgggcagctgtcctctggcctcatctttcccatccacacacacacactgtacattgcctagatggcccagtccagtggactgatacctgccttcaaccagtggtggagtctgcccagctctgagcactgagaaaggggcactttggcctcctcctgaggatccgggacttcgagttgaagaacatatggcctgtcacatagctcgaactgtgctgtgataaatgtttgctaagcaggatctgcctcttcctccaaatggtctggctacccaaatacttgtcctagatggggtggaggccttccctgctgctggaattattagtgagcaagtctttgggtatggctggctggagagactccaccactcggagagagtgattgtgggagaaacagtcatcttatcttgagggcattgtggtcctggtcaccttgtaatttatatggtgttctctgactggtaagaaatgaaatcttaactgcttctgagtcagcaagatcatagttgggtctaaggtgtgtgttgccatgtgaaaggggcaggtcttagaccactagatgaaattagatacctttcccatgtgaggagtgtttcacgcaggcttatctccagtggcataatgtgtgctgtgtagccaggcctttccgcagcaccagactcttggcagccagccaccctccacccccacccgcttccctgaaggttattgacacttacctgggactctgatttggtccttgatttgttctgattttagatgcttagagctcatagctgaaagctctcagtttaggcatcctattaacactcttaagtgacaggatcactgctaagtacagagatgtgttatgctggccccaaaatagcaaggtacagtgtcttgagacaacttgataagacttctattaccccaaaagtatagttcccaggtttacagattattcatataaatttgcatatcatcttcacaagacatgtaagcatgctctcagcacgtattcttcatcaagccctttctctgttttgtattgttagtcactatgggatataaaggaaatgagactcaacccttgtccatgaggaggctgtaatgtgtgtggaagacaagatggatatatggaatgattagtgcatatgacaatattgcatgtcagaaacacatctttggtgccttattctataagacacagtgtcagcccttaaggaattcagctaatattctggcaaaagagttggacacaaaactgtatgtcactgtaacatgaggggatggaaccttatcagctatgggaaagggtgctttggtaagccagaaggaagagtcaccctgagcctgtgagaaccagaaagacttcagagatgaagacacactggagctgggtgtgcaggttgatgtggagactcatcagaggacagctgaggaagagaggcaaaagaaatgaaaagaacagtgcattgggtgtcactggtactacagagtctaaattccaaaaggatgctgagaggaaaataatcattgtgaactggagtaatcagaaaagacttcagtctaggtgcaatggctcacgcctgtcataccaacactttgggaggccaaggggggaggatcacttgaggccaggagttcaagaccagcctcagcaacatagcgagaccccatctacaaaaattgtttttaaattagccgggcatggtggcatatacctatagtcccagctactagggaagccaaggcaggaggatggcttgagcccaggagtttgaggctgcagtgaactatgatcatgccattgcactccagcctgggtggcagagtaagggccaatctctattaaaaaaagacaagacttcacaaaggaagcagaacctgaccttgtctcaaggatgagcaggctgtgagttgacagaacaccagagagggcttttcaggaggcaaggtacagcatcagcaaaggaatggccgtgggaaggggtgtggtggggtttgtaggcagggcagccttaccagactgaggatgtgtgctggttttgagtttggagaatattggtgacattaaccagaaattaggaagtttgaagagacagtttggaaaggagttgctttttagacacagagagctaaaaacaacgtgactgtgggttgcaggacatccaagttgagtgatctcatagaaccggaagctgagggtcaggttgtggatggagctgtagagtgggagtcagcagcacagaggagggctggattccctcaaaggaatctctccagaggtcttgcatgcagagtacaaagaccagagccccaagtaataagctttgagaactgtccatagttaggaaaaaaggaacaagatggtgggaaattaggatgattcagcagcaagggaagagaaaatgtctggaagagagtttcagtgctgctgatttaactagatttaaggatttaactagaaggcagtcatgatgattgcttagggtatccattcagtaaaacactggagtggtttaaggggaaaattgacagagaaaaatagaagcaatggctggtcaccagagaatggcagcagggagggaaagaaagtagtaaccagaagaagcaatcgaatcaaatattttatttttgtaaaataattctattctttatcagcaaacatataaaattgtagtatgtggttcttaaaatatattttgtgtattaaaatgtgcttcatctgcagacttctctatattgacataatccatatatttgtaacttcacatatttcattcctttggtggtatcccatcatattgataccagtatgcttaacctcaatctgttgttgggcagttggagtattttgcaagtgtaaatatctctgatttgaacattactgtacaagtgacatttttttcttttgtggattatttattcatggtatattccataaagtgaattacagaggtgcaaagggtacgattttttaaataagctttttatacaacgttcttcatggtgatctaaccaactttcaattagagtaaaagtttggtattgacgaagaatcattttttataagaaggaggtctgagcatgtttaatggcagaagggaaaaggagttatccaaagaaaatagtacacagacaagagagaaataaagcaaaaaggaatgatctttaggatcccagggaaaggttcctttgaagagaagagggcatggctctttctacccctgacttttagggtgaagtccaggatagattactggggttcctcctaagaaaagacctttctttctttagtaaaatagagccaaggccacttgctgaggtgggggagggagagggttggtggggaattgagttcttgaaggtctgaattacccacagtgagaaataagtctgggcatatgagagatgaataaaggtcttattgtgaatgctgcattggacctatgaattcataatgggctgagtctttaaagtcctctggccagagaagcagcagtgagtggggacgggcaccaggaatgggtgttgcttggcatgttcagggcaaggtttctgaggagtcaaaacttaagatgcagtgaagtagctggccctaaggccggaggtagaggaagggccacaagttgaagacaggcgctggttgtcagccagaatgaggaggcagaggaattacaggggccagtgggaacggaaaacaggtttagaatatgagggatgagcagtaaggaggccactgacagaggaagattttcatattaaaatttggcagaggcttcttttacttttgttcatctttgtataatgtttacgtttctaacacagacgtgtaaccactaacatttcttaaaggaatatttgaaatctcaggagtcgagctgtgccttccgggtgtggctggattgctgagatggatgaaggagaaatgaagatggagctggatcatggagcctaccttgaaaaggtgctgggcctctaaggagcctccacgtgtcagccagtggcttctgtggtctcagcttgtcacaaaagagtggcacccagccagcagccctcctccacctacactccagtagtgttcaaaatccaaggaggcccatcttcccaggcttgacagtcgactcttagatgtgctgttgcgtgagtctggtggtttccaactctctgagcagatccctactgagccatgcctctctggcctctgtgagtgaaggttcttcctccagacagatagagtcccttgctaggaatgcagttttgtgagtggagcttgggttctactcattttgtgagggttccagccctcatctcctccacaaggtgctttgtgcagtgtacaaagtgtacaactgtttataacagccctgtttctctcttgcctattatgaaacttggcctaaagtcctttcctcctctgacccctctctttctcatgtcctcctagatcattcactttgactctgaccctgtctaacaccctgggttgtggtctttattccacctgctggattcacattactttcatgctgcacaactgaagccatttacacagctcaccatgcaaagcagccacaggggctgatagcaggggacttaactaggtgggaatatgtggaaagtcaggtgcaggagtcaacctgtggaaacggaaaagctagggctgctttctttccagggccttacactgacattaccttgcctggacattttgtagtcccgtttcatgaaagccaggacctaagcagaagtatggctccctgccagtccctaccaggaaggaacaaacagcttgcagtacaggcctcaagccaggtggggcaggagcaaaagtgcattgtgttgcctgtggaattaaatggactctctataaacacagcctcctgccactgttcttttctctttccacctagtcagcctacctgagaataattagcccttggcctataattaggtagaatgattattttactactgtttatccatttcactagataactagcttcatgaggcagggaccatgtgagacctagcagtatctggggctcaacaaataattgcagaatgaatggatttctaaggcatatttgttgctgtccatccttaatgctatgaaatggtacctaggagtgagtatatagtgaccatagtaactaacgaaaaagccctcacatttgtccctaatggacaagagtgccagcaaaagcaatgttttggacttctcaaagtcaaaactcagagactctcaagatttggagtagcattgaaaattaggaaggcccaacccagctcctgtcagagggaaatggaaagacatgagaggaagatcccactaccgctaccactatcctgttcaataaagcctcacttgggcagagttaagcttccagtaagacagagacagagatagacattcagagacggaacccaccacataatctgtgcttgcataaattaaaaatcaaatgtgtagtggagcctttccgaagggtgcatttcccactctcctaggtatggatgactagatcttccaggagcccactgggttccaagcttaggctccagaactccttttctccatgcagcacccccaaccctgcctagcaactctccccaagtactgctctgcttcccctgtggcttctcagacatgcaagcctctgattgaacttctcctggcctggaaggcttgatttttcaggacccagcaaggcactgctctggcctcgtggctgtcccaggatgtgttaggaggtcataacacaagaggactcatgcctctgaggccctctcgaagggtattgagaactcagtgataatgcaggccctgtcaagggtacttaagaagatcccatttgtacctttatctttaaaattcatcatttgaactcagatggttctcccagtatctagctgttctgtggaaattatgttgcttgccacctagagcagatgacctctttgggaggcattaggaaataactagttgttttaaagctcccagagctgttagctaaaagatcttatatattcctttcagcttggttttctggaattgacagccttttctaattccaaagaggctgcctgtcagcttccttaagaagcttcccaagatacccattgaaggcccaaggcaagcaaagagaaacaactgagaagcctttgactccaggtgtccctgggtagcagctgcccctcaccccgtcccttccccttgttggggatgtgaggtttggaaagaacttcctcagatgactgccaagtccacagttattcctctgaagaacactcgagaatttttgcatcacttgtctcaccctcaccctaataatgtttgtgtccatgcattagctttcccatgaatttaaatatatttatatattattctcaaaatcattacgaccttgcccatattttcagagaaacttgtaagagtgttatgtgtttaatgcctttagtgtatagtcataatcaaaaaccccttgctggatgacaaatataattcaaaattgcttttagaattaaatatttatgaattaaaacattgcagaaatgcacaatgcaaaaagtagaagtcctccataactctgtcccccaaagagaatcactgccactattttgttgaatattccaacttttttctacacacatactaacatattattttttttaaacatggaatctaactatttttcatttgtagaaaaattggaaaagatagtaaagagtaagtgagaaaattagaactacttttaattctaccactcagacagcagtggcaccagggggtggtttgggtgggctttagcactgccctcttcctgaaagctgccccaaggaaacatatgctccaaatacaaatgtgtccttcttctgcatatgcagcttcaagactttcttctagctccctcttcccaccagattaccaaccctaagcccctccatacagaaagctcgttgccaccattgcttttcactgtggtgaacatattactccattttcttccagtcgcacataaatcttttaactaaggatcatattcatttatagtttttacagtagtcatatcaagttccagtgtaaattacatgcagaacgcacttcccattgccccaggtaacattagttttgattttgtccccagtagcactatttccaagacatgtcagggaactgttttgaactcacccctaggagatgctttcactgtgccagtggagagctgaaacataggggcaatgacttgtttaagatcaaaatgaaactctgccttagctaaacttacccacaggtgtctaaatgcccaagatcattggctgaactgcctgagtttactgcagcatttgggaaggagtagaagggacatccctaggtcctgaattcttcctttttctttagcctcaatatcatttgcttagtaccgtttaggtagatggtgcttcggccctgagagagattgttaagacatgtgctgttgaaactcttcttcccttttggggaaggatgttggcctttcctcaagtcaggcagaatcctacctgggccatcttcccagctcctgagataattcacaatattctcattccaaattctgttctgtgcatctcatttctccatgtgcaaagacttagccagagagcattctggcagcatagatctgagttggtgaagctattcctatagcagtaatgtggcagaagcaggccctggagaccctccccacttgctcaggtgtggcccagaccagtgctgtaccatactgccatggccacagggcaaccaccataactcagagcaacccctggagaatgagagagcagcctaggaagtcccagtgagaggagacctaatcagccaggtattcatttcttactgctgcctaacaaattactgtgagagttctaatcccccagaactggtaaatattcctttataggacaaaagaataggtattaccttatatggcaataagtgttaattaagttaaggatcttgagagagaggtttatcctggattatctgggtgggccctaaatgcaatcatatgtatctttataagcaggaggacagaggggtgttgagagagaagagacagtgtggccacagaagcagagattggagtgacctgaagccaccagaagctggaagagaggcagggagcagattcccccaagagccttcagagggagggcagccctaccgatgctgtgatgctggacttctggcctccagaccagtgagagaatgacctttgttgttttcagccacccagtttgtggtcatttgtcacagtaggcacaggaaactaatccagtgtgccaaaatcaaggtgttggcaaggctgtgtttcttctggagcctccaggagaaaatccgcgtctttgcctcctccatcctctaaaggctgcccacattcactggctcctggcagcgcatcactctgcttccatcatcactgttctctgactgacccttctgcttccccttataaggaccctggtgattacactgggcccactcagataatccaggataatcttcccatcacagaaaccttaatcacatctgcaaagtcccttttgccatttaagatgacatatttatatgttccagggattaggacacggacatctttgagaacctaccatagtctgtaagcctaaatggtatgggtatgttcaaattagatgctactccctgaatcttgagaaaagcagtatcaaaggaaacacttctttatacagaagtggtatccatggaatgtattacctgcacaggttctctcaggcagaaaacatggaaagctacgtcagctgcaacagaaagatgggggtatgaatgtgagctaggcaagatgaggttctccctgtaagttttcgaggtgagagcgtgggggagggtcttctacagcactcacctttggtccttctcaggcagactaagctggatgggcctttggtttgggccagtaagggtattccgtgcagccatcaatcatagcactggtgcctgtggagacaccggccactggagaagatccagaggatgaatcacagcagtagacatggtatggggattagaggtaatggggcatgcttgtttgaatggagagtgagagggctgtgggagatgctatggaagatggaaatggtgcttgtggagtgttggttggagggagagtgggaagctgaggagccaccgtgtgaaagagtttccacctagaggtaagaactcaggagggagtgccccggtaatagctacccttgaagtcagacggaattacttgaagcggtttggcttcacatcaagaccatcaaaagccaagttcccattctgctcctgcctatctctctagctctggaaaaaatgatttcttcctcagaagtaaataaaatttcctccttgtatatcagtgtaatgtgggaataaaaaaataaaaaatttcctccttgaagaggatgaaaaagcattaattattaatgtttattttcatatttacagatgaaagacatgctgagttcaaagaggtagagttgcgactgaggaagagaattaactctcagcattaaaattatccactagaaaatatttatgcctgttttgaaaagtctggctgggcgcggtggctcacgcttttaatcccagcactttgggaggctgaggcaggtggatcacctgaggtcaggagttcaagaccagcctggccaacatagtgaaaccctgtttctactaaaaatacaaaaaaatagctgggcatggtggcaggcacctgtaatcccagctactcgggaggctgagacaggagaattgcttgaacctgggaggcggaggttgcagtgagccgagatcgcgccattgcactccagcctgggaaacaagagcaaaattccatctcaaaaaacaaaaaaagaaagaaagaaaaagtttctaggggttgaatacaaagttggagaatttcaaaaagagatctgacaatcaataaagggatcagagaagaatcttattaggacagaaatgtttgtgttcctaaccacccagactcatttctaggacaaggcattagacaaaggtgtcagcaagcagccacctcctacatgcttgtgaaacactatgagaaattatggtgcatgcctcggaaacttgccagataattaatggcttaattctgcttcagctcttcttttcataacacaaaggtctgagactccaattaatgaatttcactttaaaaagaagtttgttgaatacttgctctagtttaaagcatgaagttcaaggtaggggacacaaaaagaacccattctcctggggccacctctctagacaacactagctcctaagcaggcgggcctgctggaggccaggttctaactgccagagccattgctacatggtgtgtcccttggcccactgtgagcagccacagcaaagtgataccattgtcttcatgggaccagcatcctgacctgctagaaggggaggctcctccctgacagtttttaaatacaaggacattccagcatctcattattctgtgatggtgtgaggtaatatctgtcctagtctctagcttgttttttttcaacttgtatatcagagcatcaagaacactgcatacatttagctgcttttaaaaatgttggcagaagaaaccagttagctaagtggtcattaatagctgcaactcatcattgaaatttttcagcaaatttttttatatttgttctgcaagttgttttatctcatcacaacattctggaatccaaccagaaaggagactgaagtttctggagatgagggaaaactgcaatgtaaaactcatgctttgccctgactcagcttaatagtcagtccactgactgattaacagtgacaagaacagtgctggtaaatggggaaatcgtgtgtgtgttctctagagcggggttctcaagtgtagtcctgctgctgactcaccaggaaagccagcgaaaaatgcagactctgaagccccagcccacaactgtccctctctgagggtggcccaaggaatctgcattagtaataggccagtcacctatgtgtaccctaagttttgggaacctcttccctagagggggtttcctccttgaggtatgtggagttgatcttggcttgaaaacctttacccaaagccaaaagtggcccctgacactccttggcagaaaaactctcctgcttctctctttgtatccccttggacgcagagaagagttgtgctccagctcagcacctctgtgtgtggtgaagtcccagtttattattcattcttgctgcccgacaggtagacagcatcaccacctcagctttttcataatagccacgtaattccagcaccaatgtatcccacattgataaagaagccaagccttggaatgccaccatttcacctttcactgtgtgatggcattctgaagtttttcttggcactcgaagaagaaaaggctatgtagaatttctgatggctgttttgcagaacatccagaaacacccgctaggctccaaagccctaggcagtccctgtttagttgtggtcagggaaagaaatgactcgtctctgcatgagctgggtgctgtgcaggatgctttccatacactgcctcgattaataagaaagtgatccggagtccgtgcaatgcaagggaaaggacaataacagcagaaactgaatgaaaggcaggcttgaattctgttctgagctgtggtgtgactcatcagggtaggaaagtcggttccccagtgcctctatgtatccttctgtaaaatgaggttattgctgttcccatcgcccaatcatcaggtcagagttgggaatactttgaacttcccagatgaaaggtgatataaaactacaaagtgaagagctggtgtagaggagggtgctacaaaactaaaaatgagatggctaagtgacagcaaaatctaaggatgtcaggatgctccactctgctgccaggagactctccggacttcgtttgccttgcttgtcttatgaaggatggtgtgaatactcgctatcacataaggaggggcagcctagtgtggtggttaagagaaaagactttggggtcactgacctgttgaatcagaatattgagttaggagatggagaagctgcagttttaagaaatttccagctgtgtgtggtagctcaggcctgtaatcctagcactttgagaagccgaggtgggacgattacttgaggccaggagctcaagacaagcctagacaacatagtgagaccctgtctctacaaaaaatcttaaaattatctgggtacagtggtgcgtgcctgaagtcccagctacttggggagctgaggcgggaggaacgctggagcccaggagtgtgaggctgcagtgagcctgaaccattgccctccagcctgggcgacaaagcaagactgtcttgaaaacaaacaaaaaattcccaagtgattttgatgcagaccaaagtttgaagaacagtgtagctcccctggactcctgatggttcccaaggaagctgtgtatttccacaccccctcctatgcgccccatgctctccccgctccctgagccgctttccactcagtccttcctatgcatgcatcagaagcatcatcttttgggtttgcttccactaagtgaactcccactcttccttcaaaactaggttacacatcacttcttgcccaaaacttttcctgaacctttgcagaggaatgaatccttctcagataccaaagaataccatgcaaccatcaaagagaatgagggatggaaaactaaccatatttttagaggagaaaaaaaaactcacaatatttctattttgattcagtttttcttaaatgactgtacaaataggtatatatagtttgaatatgtatatagaaaggtctgaggaatatacatacctggtaacaggaaacttttaaattttatgcacctctgtgttttttaaatctacatactatttttataattttttgaatttaataacaattagagtaattaccaagagagtaattgcttaaataattacagggaagaatcaactgctgttatagctctagtatatcatgttatggttgcatgtgtcttcctgcactgttcagctgtgagctcctgaatggcaaggccttcaggctattctgcctgtcaccagtgcccagcatttccctgacactcagtgggtgcgcaccacgtacttactgaacttaagagatccacggccgggcagtctcatgcctgtaatcccagcactttgggaggccgaggcgggcggatcacgaggtctgcagattgagaccatcctggctaacatggtgaaaccccgtctctactaaaaatacaaaaaaattagccaggcgtggtggtgggcgcctgtagtcccagctgctctggaggctgaggcaggagaatggtgtgaaccgggaaggcagagcttgcagtgagccgagttcgtgccactgcactccagcctgggcgacagagtgagactccatcccaaaaaaaaagagatccaaacagattgtagggaagcttagtcaatcagtcccaggggaggtcgggtctgccactgaggtacagcctgtggtcagttggtatgtctggtcctagtggaaagacaatagcaggaaggaagtgatagtggtggctggaccaatactgcctacagcctcaccacaaaagaaacagtttggtggtggtgatagggagaagaggactttgttggtgacaattggctacaaatggtctgtgggtcactgccgcttgctttctcaaatccctactccagttctatcagctgtgtctgcctgccccgaggtagtccctactctttttctaaacaatagaattccacattcattttatagagccccacataaataaaagaaattggcctattttcacacagtttatctcctttctatttccatcccttcagaatcctgtaatcatgagattgcctaaatggtctctctggaaggccctggcaacgtctaggcacgcatcctgtcttgcatttgtagatcagattctcagactccaaattgggccagatgtaaatgggtaacaactgtctgtgttctctctatcccactaaaagcatcgggcattcctcctctccttctcttattgaaataacttgcgtaaatcatgctagactttgcaccttgacctccttaggccacacgtggaaattgattccctgcctttcaccaccaccaccacacactcatatactttgtgccagattcctaagagagattgaatgtgtataattttttaatctcatgattttggaaaatcagaaactgttactactccataactaagggagaagaataaaagaggtatgttcatatttattatatttatatctaagtgctatagcaataccttttgacaaaaatatacttttaaagtcacattttaggagaagcgtagtactcattctcactgactaatgttaccagataattttttttttttttgagatggagtttcgctcttgttgcccaggctggagtgcagtggtacgatctcatctcactgcagcctccacctccctggttcaagcgattctcctgcctcagcctcccaagtagctgggtttacaggcatgcaccaccacgcctggctaattttgtaatttagtagagatggggtttctccacattgatcaggctggtcttgaactcccgacgtcaggtgatccacccgcctcagcctcccaaagtgctgggattacaggcatgaaccactgcacccggcccagataatttttttttttttttttaatcctgacctatactaagagtttggaatggatatttgaggggaggagaagacaggtcactcagcaaacatgaagcacctacttcagccatgctttggaatttaaaaatgacaaatgtaagatactgcctcatccctgcccttgaattcatgttatagttttaacacaccccactgcaatcatgaaatgtggtatacattccataaaactagaatcaaataggatcaattgcatcttactcattgatatccttgtgaagactgtgtaggccagaagtgagaagatgatttgaaacccttctgtttcctacatggagtgttgattctgtataatgtgttgcttctctcctgagaaatccagtgttctgttttatttcctattgcacatgttgtacttccatgccctttttatattctgctactttccctagtttcagtttagtcatagggattgtatagctcccacttttcctttctctggaaataccatgcatgttttaactggaagaccctgatgaggtaaaatattaggacgttattagccaggcgcagtggctcacccctgtaatcccagcactttggaagccaaggtgggcaggtcacctgaggtcaggagtttgagactagcctggccaacatgatgaaaccccatctctactaaaaatacaaaaacttagccgggagtggtggtgcacacctgtaatccctgctactcgggaggctgaggcaggagagttgcttgaacccaggaggtggagattgcagtaagccgagattgcgccactgtactccagcctgggcaacaagagtggaactcatctcaagaaaaataaaaaaaattaggacattattaaaataaaaccagaaactggtttgttaaagctcctttcttaaccatctgttctatcatcagtcacttcaggctgtttggtgtcaaaattacagagtcccccaccatattacaccagtttctctacttagagctaagtccttctccaggtcacagaaagaagttgttccagggatagaaaaaattcctgttgagggaaagttctggggaggtcgggaggatgtgtagctcctgcctgatgtccctaacacttcaggtggtgactaaactcttggtatggatgtgactccctccccatgagattgccaggttgaagaccagctgaggagtcatctgcccccttctcagccttaccaactcgatttttgctggatttaggaaataggacagttctggttctttatcctactactgtaggccctacttggccatgaccattgattgtgtccaaaagttcatgcctggcaggaaagcaagaactcatgatggatgtcttgagaaccatgcttccttgagtaggagatggcgctctccccccagacagagactaattgagaagactgacattaaggaatgctaccagaataccccagaatttgacttgagccctaatctttgtgtgtgggagctgtccaacatttcagcatacttttgcatttgcctactttgaaagaaacatgataataatctggctgtcttgactgttttactgtgtgccatgttctgaggaaactgacacaattcaggatctagtctctcaggtattttgatctgataacttaattatcagcttttcttgaggtcaccaagccctgagaaaactgacttacatttatttgcttaggcacatttgtaccagaaagtcaatttaataaatatacttcttccctgtatcatggtggcttgaaaatcagaaaggtaatcagagcttgatttataagcatgaaatcagagcaaatacagttggaagttaagaaattatgtgttatccacaccatggttcaagcttgattaattctcctctctctaccagaggagacatcattcatcctagtgaccagaataccaattccagctaagcagagtggtccattggacagtgttacagttgcactaacatagttttcctttctaactatctttttctctagattccataataagccatcccctttttataattgccattacaatcagcttctacatcatgacatcgttacagtttgccaagtttgtagcttattttgcactgataaattttaagtaagtcctgctctgtgacatctaggaagacattgtagttttatttacaatatctccaaatcactctatttctcctgataggtaatcctgtctataacatgtagatacttattaactcattagcagggattggcagacattttcctttcttcttcttcttcttcttttttttttttttttttttaagaaatgagtgatgtcttactctgtctatcacccaggctggagtgcagcagcaggatcatggctcactgcaaccttgaactcttgggctcaagtgatcttcctgcctcagcctcccgagtacctaggactacaggcacaagccaccatgcccagctaattttgttgttgttgttgctcaagacggaatctcactatgttgcccaagatggcagacattttttgtaagggccagatagtaaatattgtatgctttgctggccatattgtctcaagtcaaaactactctactctgctgttgtaaagtgaaagcagctatagacactaggtaaatgaatgggtgtggttgtgttccagtaaaacatcttgaccaaaagggaggctctagctcataatttgccagcccctgcttattagtcataatcacagaggggactctattctttcctggttttgctgcagtcctattttgtcctagatattaataggttgtttaaatcttcaaaagtagtttccactctcccctaaaagaactcagaatcctcagagaaatgccttgcttcaagaccgaggcagggaaactgcaagttgatcctggaacaaattattcttctagaaagtaaggaacttaccaaagaatgatgggatgtgtcaacaagactcaagagccagctgtaaggggctcccactgtggccaccaatactgggacactatgaacatcaaaataaatgataataatgtattataaccctttgaataaaataatcatctatgagtttatactggcctaaataaataaaagaaaaaataaatggaggaggaagggatagcttttcctttatgatggagttaaaagttaagaacagttcttaagtaggttggaggccaaatcagaatggggactttttcaaatacctgagggtctttctaagagaggtgtgtgtgtgtgtgtgtgtgtgtgtgtgtgtgtgtgtgtgtgtgtgtgtatgtgtgtgtgttttggaaaagctccccacaagatactaatgggccttttctgtttggggactactgatattccggccacagaagacagtggaaagatagcagagggaagtatgtcttcagcttgcttggcccattcatatctgcctatcgcctctattccttgttatcctcatcaatctatttggccatcttggaacctggtgtgagtccaaaaggaggagctcctgcttctggggtttgttcttgggtacccatagaaacagatgagacattagaagataggaattttattttattttattttattttattttattttattttattttatttatttttgaaacaaggtcttactctgttgcccgggctggagtacagtggtgagatcatagctcactgcagcctggatctcccgggctccagcttgatcctccccactcagcctcccgaataactgggaatacaggtgtgcaccaccttgccccactaatcttttttatttttagtagagatgaaggcctcactatgttgcccacactggtcttgaattcctgggctcaagcgatattcctgcctcatctcccaaagtgctgggattacaggtgtgagccatcacacccagccaacaggagttttcttaactagcagagactaaccatacaaggtttccttgttaaacccttcaccagggccgggcgcggtggtttaagcctgtaatcccatcactttgggaggctgaggcgggcagatcatgaggtcaggagatcgagaccacagtgaaaccccgtctctactaaaaatacaaaaaattagccgggcgccgtggtgggcgcctgtagtcccagctactcgggaggctgaggcaggagaatggcgtgaacctgagaatggcgtgaacctgggaggcggagcttgcagtgggccaagatcacacctctgcattccaacctgggcgacagagcgagactccatcccaaaataaatagataaataaataaataaataaaaataaacccttcacctgaggaacagaaaaatacctggagggaaagtatctagtgaagaaacggctctcactttccaggggatcttcaagagagaaaagacaagcccattagcagagaaattaaagtcaagttgtgaagtaagcatttaaaatatttttattctattttgaactagtgtagatatctggagaccaaagttgtaaaatacatgatatgtgatccctgacttcaaggcacttatctttttgggaagatatttgaaaaaaaaattaaatggcaatagtagaaattagcagtccccaacctttttggcaccaaggttttgtggaagacagtttttccatggatggggtagagggtgggggttggtttcagaatgaaatttccacctcagatcatcaggcattacttagatcaagcttgtccaatccgcagcccatgggtcgcatgcagcccaggacagctttgaatgtggcccaacacaaatttgtaaactttcttaaaacatggagtttttttgtgatttttttttttagctcatgagctgtcctttgtgttagcgtatgttatgtgtggcccaagacaattcttcttcccgtgtgacccagggaagcccaaagattggacagccctgagttagatcctcatacagaacacgcagcctagattcctcaaatgcacagttcacaatagggtttgcgcttctgtgaggatctggtgccgccgctgatctgacaggaggtggagctcaggcgggaatgctcgctgttgctgtgcagcctggttcctaacattccacggacccgtactagtccacagcctgggggttgggaatccctggtagaaaggatagtttggtaatccctggtagaaaggatagtttggtaacttaaatgttgtgtagcagggtacatatatgcttaatcctcaagtgaattatgtaaactcaatattcactaaatgtagaggagtaaggaattgctgaaggctagagaggtcaacgaagacagaataatagaattgttgcatctattagaagggaccttaagaagtcatctaaacataaaatctcagctagtccagccttcagtctggttcttgaccccgatagggcatgcccacagggtgtcatcagcttgaagacctgccatggtgggacctcaccctttcctggggtagacatgctgcctttaaccatgttaaagctgtcagttaactgctttaactgaagcagtactgggaatgtttgtcttcagtgggtcaacatctgtttttctgtatcttcaacactttggtcacagttttacaaacgctgtggtcacagaaaataagtgtaatccctattcttcctctgggcccttaagtcattaaaggcagttctcatgtcatgctgagtttttcttctgtctctaagctaaccccttagtttctccaccaggtccttggctgaccgagattggagcatatccactccactcactgtcatggtctttctctttaaacaggcctgcttgtgaatgttattctaaaagtttgctgcacagaactgaagtcagtattacaggtgtcatctgacaagcccagaggggaggaatattatcactttcctcattctagaagaaggactttataaccagatatctagtttcaaatcagttctgttctcactggctgtgttaccttgagcatgttacctaagctctctgagcctcagttcagttctgctaatatctgagaacattctatgtgctggacaccatgccatacaatagggctgaaaaaaatcccagccctggggaagctcctagtgacgtggaagaaatagacatacttctgtgttagaagtatctccacacagtattacagaagtacccagaaggctaggctaacccagcccagaggaacaggctgggagtcaggaaaaactttccaggggagttgacactggagagagtacatgccagtgtaaaatccttatgtcttttgcacacagttttgcaaaccttatatcttctgccaaatatcttccatttgttttttaagatacaaatgcagaacctagtatgtgtttatttggagtggtttagcttcttcctatagcctgtcacagcactttggaatcctgattctgtcagctagtgctcacagaaatggtgggacatgagcttggccttgaaaggaggagagcattccagtacaagccaaggcggggagggattcagtattagggagactggcaggaggaagaacaacagtctgactgaagtgaggggcttggggttggagacatcagagaaagggtttggggaagaaggaagtggaattgatcctacagatgtttggtcttgatcctacagaatagagatatagagagccattggtgcttaggggaagggggtaactaaagcagtgtttttggaaagtttgtcttgcaatgagtagcaggaaaagttgaaagaatagggaccagaggcaggaatactatccagtcacaaaatggcaacaacctggacaaggatgatgtcagtgagaatggaagggacaagatgaatgagaaaaatcaatgacttgatgacaagttggccaaagcaagagaggcaggattagggtccaactacatgcacttttttcttctttctttccttctttctttttttttttttttttttttttttttgggatggagtttcgctgttgtcacccaggctggagtgcagtgcagtggtgtgatctcggctcactgcaacctcctcctcctgggttcaagcgattctcctgcctcagcctcctgagtagctgggattacaggcatgtgccaccacacccagctaattttgtatttttagtagagacgggtttctccatgttggtcaggctggtctcgaactcctgacctcagatgttccacctgccttggcctcccaaagtgctgggattacaggcgtgagctactgtgcccagcccaactacatgcacttttaatgtgactgacatctcatagatttttttttggcagatttttttaaccattttagtggataatacaaatttgaaatacaaattagttctaatattttaccataaaacatttcattttttccacattatcattattaaggtttccatttcaattctgaatatagttctcaatattttacaactgcagtaaggaagaaaaaatattgttttcaaactacttatctttctaccaattctcagttgttggttcttaaaaaatgacttcacaaaaatttttaagatgctaataacaaatttccacttaaatatatggatggctgattttacaaataaatgtacgggtttgtgttactattatgctctccctagataacaaaacaataaaagaaattttagtaatatcaagtaagtactgaccaggtgagtactgtgagacagtgtcatgaaaaggttcttaggggttgaaagacatggtttctgctcagaggactcaccgcggagcaaaggagagagacccgtggacagataagtacaaggcaggctcctgtgagaaatgacagaggtatgaggctgtggaggcccagaatgttctccattatgacccgatgaggagggaggagggaagtggaaagaggaacaagggtagaagagaaaggagaaaagtgaaagacttaaaaacaaggagggaaaagaatgaagaagaaagagttacaaggaaaataacttgccattttttacacctaataatgtatgaagtactttcagattggttatttcatttgattctgccaagaaggcaagagatgagagacaggaggaggaggagggaagcaaggcccatgaccaggagaaggagctgcaccacaaagagctcagagcccctctggcctcctaggccggtgcagctgccggtgtccgctggtgaaggtggacctcagtggccctagttagaagccagtgggaccttgtaaaaccagggctccagctgggaagtctgaacctcctggacagaaagcaacagaagccttaaagtagttatcttggcaactattgtcaaggactcattgctgcctgaccacaagatttatccaattatttatctaccttgttttattttttaatatttttttctcatcacgaaagtaagacatattcgctgtagaaaattttgaaaattcagataaacccaaatatgaaaataaaatcccatataaccgtaccatcagacagaaccacaattataattttagaatatacttcacatttttcttcaacaactgttggtatatttttgttctgtaatacaatcatacattgcttaatgatgggatacattccgagaaatgtgtcttgtgattttgccattgtgcaaacatcatagagtgtactcacccaaacctagatggtattgcctactacatacctagactgtatggcatagcctattgctcctaggctacaaacttgtacagcatgtgactgcactggatactgtaggcaattggaacataatggttagtatttgggtatctaaatatatggtctgggtatggtggctcatgcctgtaatcccagcactttaggaggttgaggcggcaggatcacttgagtccaggagttagagacagcagtgagccatgattgtaccactgaactccagtgtgggtgagacagagtgagatcccatcattcatagatagatagatagatagataactgatagataggcatataattgatagataggtacgtagatctaaacatagaaagggtacggtgaactatgattgcaccactgcactccagcctaggaaacaaatcaagaccccttcattaattcattcattcactcataaataaataaatgcatatatacacacatacgtacatacatgtatacatacatacattaaacagaaagggtacagtaaaaatacagcataatcttatggaaccactgtcgtacatgcagtctgttgttgatgtaaacattgtgatgcggtgcgtgactgtgttttcccccggcttcatggactgtaaacatctttccatgtgttttatcaattgggattgtgttttgaaacaagtaacagcaaaccctgtcaacagtggcttgaacaaataatggggtattttgctcgtgaggcaggagtctgaaagtaggaggtctaggctagtggaacagctcaaggacgttgccaaggacactcctgctgtcttaggcggctgtgttgctttacggtctcaaggtggctcttaactctcagggaggctgagaaagcaggcattttgtgttactggcctctctattggagacaggtaaggaagaagggtgttgggatgggagctgagtcacccagccagcagtgccagcatcattacatattctagaacatccctcttttcagagtggcattgtttggatgtgtcacaatttatttaacaattcattgttggacatttcggtggtttccagtttttcattattgtaaacatgctaatatctaaagttttacacatatctataattagtgattcagtataaaattcctagaagtggaattaaggtcaaagagtatataaaatctaaaggcttttaatctttttttttttttaaccaaactgctctccaaaatggctgtactaaactatattctcaccaatcatgtttaaaagaacccatttccctgtaccctcaaaaccaggttttttgttctgtcattaagctgttataccatgcccattagtgtgggtttaactttgtattagccctgaccagactctgaactgcccatcttggaacccagagcagttgcacccttctgtgttgcacctgggggtgtgggtctgcaggctgtcctgtatgtccaggcaggctggtggggcccttgtgctgatgggcactgcagaggacccatgatgtttcttgtgagcatgcacctcgctcatctattcttgttttgaaagtcctttctgccactgtgaagtcatcatttgtcccacctgagtcctaattcaaggccatcctggcttgtcttagattgagatgcacctgggaactggcctctttcgatacagtgcaccccacatcctcactcgttgctcttactggcctacctcaggtataatggccttacaggtctgtgtcatcatctgtaacagagaaggctgagaagatggtgtcagtagattctggggacattttaatctattaagctgcttttgagacgtactacagtttcctgaggaggtggccaaaagagtgagtgatccctatgcatcaacactctatgaagtaattactaactggtgagcagttagccactacgtacggcccttctcatccagtgaggagtcagccatgggtgagacagaaggagtccctgaactgcaatcttctggccagattctctatatgcacacagtggtgtttcaatattcatgagtgtaggcagatagtcacgagtaaacaaatgagcaatgaatccaaatgagcaagacaggctgaatgcagaacacaggccaaagccccagaccacatcactacccctctaaaatcagaaaaaaaaatcagaattctgattccaggagggaaatgataaggactctatttcaatgctcccttcaggaccttaccctgatctcttgagaggtgacaccctcaagagagaagcaccatcttagggaatcagctgtctacgagcttttctcatagccatggctttacgcttctctgtcagttaccatcaccacttggaaagggaaactacaatttatgaagcatctgttatcgatccagctaatgctgggaaggtgatacctgaccagtcactactgtcaaacttccagctcacggcttctacccagatccctcactttccccatgagagggtgctgctcagtatggcatccacaaaatcagtccctcacacaacttacttatttaacaatatcacagtccccatccccttctccttacctaatttcattgttaccggccccatgtcaaagattatttaaaactccccggctgtcaaaattccattaacaacctctgacctataaccgtcactcactgaattgacacgtgtgaggttctgtgcggatgctccacttgagttagcttgaaccttcacaacagtccggcagcataggtattttagaattattagtaatgttgagcatgtttcacatgtttgttggccatttacacttccccttccatgagtcatctgtcaagaggctctgtgcccacgagccatacacataatgatgtccaaaaagcgcttctattttactgtaagaaactcaggcaaagagaggccgcctttgcccagaggatctctcatgcctgggaggtcgtgagaggcagagctggagttgggtgctgtggagtccttttcaccacctttttcatgcaccatgctgcccgtccacatagctcaatgtgcctgtttatttcttaggaaatacaccacagggctactatttaggtagtgcaattaaagtttactttctgaattctctatttcccctatctttagcagaaaacttgggaaagcctaagtcattttccacttcttagccccttcctcctccccctcattttctaggcaaaaatatgataagagagtagcttggataatgtctagctttgttttggttctctggtgatgtgaatttttcccattgttaccaaactcccactttttccacgtcgaaatacatttcatgatagctggagtatggcaacagcactcctgagttacaggcatgcgccaccatgcccagctaatttctatttttgtaaagatagggtctcactatgttgcctaggctaaaaccttctgataaggatattttctagtatctcatgtttagagcaaattactagaatatcaaggatctagtaaaaaaaaaaaaaaaaaagtaaatgccatggatatgtctgggatcagtacagatttatcccaggatactagatctttagtagaaggcatgaatggtgagaattcctcagcaggatttccggatgtttgttagacatgagcacacagatgacttgtgggttctcaaactcgacagcccaaaacagttcacagaagagtaaatatatatgggtaataaacatagaaatatgttctccctcactagtaatcaaagaaacattattttaaagataaaaaaatacttctctttcaatcaacacactttttaaaataataacaatgttggtgttgaaatgagcactcataaacttctggggaaaaaatgaaaggtacagcctttatggaagctgttagtccttaaaaaatatatcatgccctttgacccagtaattccctgcccaaggaagtagtcacagatttagacaaaaattgaatgttcaaatatattaattccaggactatcaaaaatcaaaatgcccagcaactaaagctaatgtaaggatagcatggaatattatgccccatggaagatgatgcttcctaatatccttaattattctttgaagtgtccacagcataatcttaagtgagctcgtggtcttcactgcactctcaaacctgctcttcctgcagttttctccatccttccagtggcttgggcaagaaactttggggtcatctttgacctctctcacatctcatagtgctctgcagcaaatcctcagtcccacattttgtaagattctccctactttccaggccttctgcaaagcatgaactgcaaaggctcgaggaggaaagaaagcaacactgaactcccttgagtggttagggttttggttcctaaattaaggcacagttttccttttccttgaattaattatctaactcttcctcctagggcagaatcaatgggccaaatggcctcattgagaacatgacatccaaagggagagtggcaggagtcaaagtattattataatgaatagaaataggtgagggagaaagtaatgggatttcattggtggcaaccctacttgctgagaattgttgtatattttcagtgagcaacaaatattgtacagcatggaggaccatcaaatttaaaagagaccttaaaaccaagagtgtgtcggccgggcgcggtggctcacgcctgtaatcccagcactttgggaggccgaggtgggcggatcacgaggtcaggagatcgagatcatccttgctaacacggtgaaaccccgtctctactaaaaatacaaaaaattagccgggcacagtggcgggcgcctgtagtcccagctactcgggaggctgaggcaggagaatggcgtgaacccgggaggcgtagctggcactgagccaagattgcaccactgcactctagcctgggtgacagagcgagaccccgtctcaaaaataaaaacaaaaacaaaaacaaaaaaaaaacaagtgtgtggaagccattagcttagctgctgtggctattagacaagtaggctttgccattgggtgaagagagacttagtagactattgatgtctgataattcccattattggggaggaaatgtaatttcttcttaaccttcataagttcatagttgggacagacccctgtaacaaaagacagatcagcaaaagaaaaacaagcaaagtttttttattttgtttttctcttcagatacagggtctcactctgtcactaaggctggggtgccgtggcatgatcacagctcattgaagccttgaactcctgggctcaagcaattcttcctcctcagcctcccaagtagctgggactacaggcatgtgccaccacgtcccactattttttttaaaattttttgtagagacggggtcatgctatgttgcccaggctggtcttgaactcctgacctcaagcagtcctcccgccccagactcccaaaccactgagattataggcatgagccaccatgcctggccaagcaagtttattaatgtgtggagggcacagaatgcaggagaaaccccaatgaaaggcaacttcaaggcagtggcgtcaaactctggcttatatgccatcttcagaaaagaacaatacatttgtagagaaataacaggacagaagaaagcaattttaggcttccaaaagggggaaactgtgggaagttagatacatgggaagaaaccaatggtgtaaggtttgtttacagattcctctggtgctgtgtctgggctgataagaactatctccagtaaagaagaatttatatcctgtctttaggcagaaaagcaggagaatagagctcatcctctatttgctgctctttaattacttttagctcaaaaataagtcaaataggcatattttggggtgacatattctggttttcctttaccttgaagttgagtcataacaccaaaggttcgtctatatcttgcatgtacaaataggtagaaaggtttatgctaattaggtgagcccagattggcaggttgttgaagggctaatttaactcacaaaaggccttttcgtgtttagaatcccaaggaagaagtttggacttggttaagttatcctgtgattattttagaaaagttgtaaacctgctatcctcattagcccggattcttcttaattgtgtcttagaagtaattgggaaagttttgaatggcctgtggtctgtcagaagtaaaggatttactgccctgggataaattatgttctgcataacgaactttattttgacaatattttagtttccctttgaaaaccttatgccctttctgaaagaaaacagtagatagctggaacagtcttggagcttatctttagaacacagcaaaaggtcatccacatgtcaaacaacagtagaataacagatatttaaggtccttgaggttgtcattcaggacttgtgaaaagtacagagggggcccctgttaatctttggggcatcacagtccaagtatactgttaatgttcccaggagaaggcaaacaaatattgcctattttgatctaaaggaatactaaaaaaagtaaaatacatatctacaactgtaaaatatgcagcttcaggaagcgctggagataaagaagtatttgattctactcagagaatgactattctatttatgacctcaaggtcctgagcagatgtctatccccacctattgagttttttgactgggagggtagggatgttacgaggacttgtttaaaatatgatgagtcctttctctatcatgcttttgactatctcagtccttctttagctctggtttagagggtattgtgcaagtttgggtagaaatttagatggatgtttctgaatctttatggattcagccccaataatcctacagacaattggatgtttgaaactttgtcctctttctgttctaaagtgcctctcaaacaattttgttcatcaaagcttccttgactagtgactgtaattctaaattatccttggtgaaattatggcatctggaaaaataaggccacaaattttagtgatagcgtaaatgcatttaagaagcgagagtcttctgggctgggcacagtggcgcatgcctgtaatcccggctacttggaaggctgaggaggaggatcgcttgagcctagaagttcaagaccagactgggcaacatagtgagacttcatctcaaaaataaataattaaaaattaaagttatgaaatttattttaaaaagaagaaaaaatctgaatttggattttttggagggaaaaagaagcaggaatcttatgaagcaggagtacaggtttaggattaaactgagacaaagccataattctaggaacagtcagtccagagtaactcaggtttaactcctcctgccctaagcaaatgcctgggccttccaactacaaactccaagcagattaacagttcctagaggacagaaaggtttggagaggagaactctcccagagccagacttccatggacaaagcaagagaagactgaggaaagttctcatagggtgtatttgtaatcacccaaaactggagacaaccctgacatcctcagtgggtgaatgagtagactgtggtacatccatacgtgtgccattgtttggaatactactcagcaataaagaggaaccattaatccgtgcaacaacttggatggaagttaaaggcgctatgctgagaagaaaaaaagccagtctcaaaaggttactggatgatttcatgtatataacgttgacaaaatgacaaaattatagagtaatggggaacaggtctgtggtggccaggggatagggttgggggggagggcacagctataaaggggtagcatgaaggagtttctttgagattatagaacaggtctgtattctggtagggtggtgattccatgaatccatccatgtgataaaatttcatggagtatatgccaaaaaaaagagtgcatgtaaaaactgatgaaatccaaataaggtctgtagtttacttacaaatgtgccaatgtggatttcctggttttaataattgttatgtaagatgttactgggggaagctggatgagtagacatgaaatacatgagaattatttgttctgttttgcaactgtgagtctaaaatcatttcaaagtacaaaagtttacagaaaattggagggactctcttgggaatctcttcagcttttactagaaaagataatataaaatcctctgcagaattataaattgaatgcagtttctaagcactgtaatttcatttgttgtaattttgatttggaaattattttaactatagtattagcaatattttgtattgttgactaaaatactgtgtacctgaaaagaaaatcctctggagagtttcccttctagataaaataactccttaacaatggcatacagagctactggtgatgtggctttcgtctgcctttttagccacatcaccttctgccccagcatgactctgggatgagctacttgcagtcctttccttcctccccatgcattcccctttcctcttaactcttacctgcctgatgagtttctccttcaagacccagttcaaaccatgtttcctttacaaagctttccctgatgcaggaagcagagttgctccagcagctcctgtatctggagttggagcatgatgtgttgccctttggttatttcgttcagttgtccagctctcacctaagttcattaatttctcgagggcccagagtgggttcatttcttcctataggtcctgtgctggcacaggggctggcacacagcattgggtgctgaagcacacactccacaaatggtgatgagtgactgattgaatctgaggctctgcaatgtccttagaaagcaattttgtctattcttcctgccttaatacagtaattttccacaaaaccaaacattaaaaagggctctgattaaccacagttaaacaaagttaatcaatatgtacaacattattttccaaacattcaacttagttaagactttattatataaacacatttcttatcttgcttttcatttgtgatacagtgttgtgagtagctggagaaagatcgtgagtcgcactcatgggtcttcttggacagataaaatctagaacttgagggtaggatatggagtctgaagggggatgggtgagatgttgagataaggagcacaagcctacttttaatctgtatttctttttttttttttttttttgagatggagtttcactctttgttgcccaggctggggtgcagtggtgtgatattggctcactgcaacctccacctcccgggttcaagccattatcctatctcagcctcccaagaagctgagattacaggtgcgtgtcaccatacccagctaatttttgtatttttagtaggggtggggttttgccatgttggccaggctggtctcgaactcctgacctcaggtgatccacctgtctcggcctcccaaagtgctgggattacaggcatgagccacagcacccgggcccaatctatatttcatttcaaattttaactgaaagaaccaaaatgctctccaccctgcaggcagtcactcactatctacctgaagtgctgcagcagacacacatggctgtgatgacaaatgcctgatgtccctctccagcttcctcctgggcaagtgatcaaggactccacaatcatctgcaggtctagctgctgtccccatactccaacaaaatgactcagagtttcatcatttcttattgcacaatttaatgaccatatcgccacctctggtctggtagcttcattaaacagggcagatgacctcctctttgaaagtgggccctcccttggctcctaagacatcaccttctctccacctcctctattttcatcgcgtccctaacattcctccaggactgagtcattggtcttatgctctttttttaaaataaaagtaataataaatatgtttcccatgtccagaatttcccattttctcctcgctgctttctggcatcctgtcatctttaaaggcccaattaggtgccaccttcctccagaaaccctctaactgctgatccccctctcatctttttcatgtgcctggaacacttaaaagccaaaggtgctttcactatttagcacttcatatattctgctttgtggcgtcccttgttattttataaattactcttacctcttcaaccaaagaaaagctccttaataaagacaagacccatgccttgaaatgatcccatgtcctcatgatgcctcactgggtgttgagcattttgtcagtggtcagtaagcacttgctggtcgagattaaggcaatgctaggccggacctggtggctcatgcctgtaatcctagcactttgggaggctgaggcaggtggatcacttgaggtcaggagttcaagaccagcctggccaatacggtgaaacctcatctctactaaaaatacaaaaattagctgggtgtggtggcacacacctgtaatcccagctattcgggaggctgaggcaggaggattgcttgaaccagggaggtataggttgcagtgagctgagatcatgccattgtactccagcctgggcaacaaagcgagactccatctcaaaaaaaaaaaaaaaaaaagaaagagagaggttaaggcaatgctgcaatgtcttgaaaaaataagtataaagaagaaaactgggccaggcatggtggctcatgcctgtaatcccaacactttgggaggccgaggcaggcagatcacaaggtaaaaagtttgagaccagcctggccaatatggtggccccatctctactaagaatacaaaaattagccaagcatggtgatggacgcctgtaatcccagctactcgggaggctgaggcaggagaattgcttgaacctgggaggtggaggttgcagtgagccgagatcatgccactgcactccagcctgggtgacagagcaagactccatctcaaaaaaaaaaaaaagaagaagaagaagaaatcctctgaaattccctttccctcctcctaattctcaaggggtgaaatctgggcaagtcatcctgctctagagctgtgaaaaatcaaatcgtccttcctgcaccagtgtggtggtgtggaaagagcatgggatttgtgttcatttggccaggttcagctctgatcttgccagtggttgatcttgaacttggaaaagtcactggaatcctcatccttcatttcctcaaaagcaaaattgaggtaacaactcaaaggctttctggagctggatgctgtaatccacaagagtggcatttctggtgggaatttcgggcactatggtagggcaggagagaagctatctgcaggccttctggaagctctccagtgcatgtccccactggggtgggggctgactgtctccacgtggggttagtcctgcagaacaggcaggtagagtagagtctgagggcatgaggaaaggcagtctactggagagggcacagagagttcaacaaacactgaaacttaagtttgtcctggacatcttcagcatccgactttctggtggaaagcttaaagtataaatgactgtgccctctcaaaagggcacagaagtaaaactgggaggattttgggaggggactggatgtggggtgaaaggtatggtgagagcagagaagaggggcctgagcctggggtcaggggaaagtaggctaaacaattcacaggatgcagacatttcagagaagggtgacacatcacttggccctgaacaacaactataagccagacagtccaaagagacatagttccaaaggaacataaagtgacatggcttgttatgtgtccccagagacatggatgtgcttttggaacttgaaggataattaaaaaaacatcagacccaccagggctgctgcaaacatgacagttcccttcccaacacgtcatggcagctgctgcagctcccttccctctatcctgaggctagccacagatgggccagcagcccacccccagagcagaccaagcagagaggtgctcccaggagttaccaggttccactctcggaaccatcttaaaatcctgttctgggaaatccagcagcaccatgttatatgcattagagggagactgtttaaatcccttgccaaggttcccaaggcttcgtgctgcatctgtttgcgtgtagccagggagtgcagctagcattctcctctccttgcttctccatgtagccagtggcacctcctcagggtcaacaaacaagaaataaaagcagaaaaccacactttctgagtccacctgccatctgaaccccccaaaccctagtttaacctctcccattcattcattcattcattcaataaatatataggtactgagaagctattgtgcactgagccctgagccagtactaattgagggaagaaatgggcaacatagcttcaaaagcacagctctgtctttctgcctgaggcagcagagagtggatacccaaggctgtccctactctctccctgctcaggaccctgatcagagggtctgtgggaattgggtcagggtgcaggaaagaagatgttgagtcagatatgtctatgtcagtgatcttgcctatcagtaaaggttgctcagcccccaaagcagcgtgatggtgaacctttggctcctgccagcggtactcattatccttccaacagccccatgctcaatcataccatcattctgatgcttcatgagaactgaggcttggatatcttcgcctacttgcttgtgtctcacaggcagcgaatggcaaagcctgtagccaagtcacactgtctgccttctgctgggagccttggattgatgggtgactccatggacatttgttgacctaaaaagtaggtgtttgaggaactgaaagatctccagcaaagaacgtttagaaagaaaatattgcctatctgcccacctagatgaaccctactgaaatggattgattttagcgatgagaaattttgtttactatactgcagggtttccgttaaccctcgaagttatggtcagatagggtgacctagccagaacctaccccaaggactccttccctggctagcagctacagggatgtggcaccattatcccaaccagcctggggagagccttagtaagagttcagatcattattcagcaggacatgtccaggatcccagtggctggaacttcagcagggctcagggtcttagagttgtgacctaaaagtgttgtgagaacaaaatcctggaggagtttcagtccctacctgaacccacagccgtccagatccctgtcctggatgtgtgggagggggcgcatgctgggctccaggccaaccctgcaaatactccacttgccccgtctctgcattgattaatccagctttgagaggctgagcctctcaatgaatcaggtccttgctcagccataagaagaaggtgattggccaggtctgccagggctttgtgacccgctggcttgctccccagcccctcagaacccctcagccccacctgcacatactgcctccatgcaagcccagaataacctggatgtgtgactcacaggggtaggggtagcaattttgcagattttccaaacaggtgacttcagcccccgggcctgggcaggaaggggtagcccagtgacaatgggcatagtcccacttcaggaacgggaaacgtgttggctggctctgtggagttctctctcttctgatcccacagcatctgttccagttgtcttggccggtaggatggcgtctacaaagcaggctatatgggaaatctggagctggggagggattgtggtcagagcccagctttgggaagcccatgtggctgtctcaaggcaaagcagcagagaaaagttctgtagtctgtctcctttctggactggcatttccatggtctgagaccagaggctggctgtgtgtcaggcacctactcctcgaacaaatgcccttagattctcactgtctgtccccgcgatgctgacagcacttgccaaatacatactgaatgtcaggctctgtgctcagcactgtgtacacatggctcacttaatcctcataactgttctgtgaggtgggagctgtcactgtcctcactttatagatgaggacactgagacctaaagtcaagtcagacagctaggacatggtacaactaggatttgaacccacctgatgtgcctggagatctagtgttcttaagcactacctttctggagcttgctggaggcatgctggccacctccttcaggactggtagacctggtgtgtctttcatagccacgctgggcagagggtggaggcctggaaactgcagggggttcttccagggaccagccagaacagggctaaacttggggtaaaaagagctctagagaattagagaagactgagggcccctaaattacccttaagacatatttgtggaagacagatttaaaaacaaaaagccaaaattagatttaggctggtgataaggtcattaaataatagaatgtgaaatttcagttgtgcagacttattggccatctttatgatttaagaatataagtgcctagatctaagtgcagtcctaatcgcctgggaaggaagcagatggtctctagaaacccttctgaccatgggttagtgggatttggtcttgatgaccatttttaaggcctcagtctgcagaatgaccagcagcttcccctcccgcaatgagagctgtaattgcctttcccagttgcctgtgaatgcaccatgaaccttacagtcctagtataggaaatgactcagcaaaatcaccagattaaacctcctcaacttttctttcccttggctccattcctgatagcaggagtcgaggcccttcagagcaggctttccccaaagccacgttgtcggtctgatcctcgaatggggatccgcctggatgatgacatgccacaatccaatcagggtctgtttctcctgacagtcacatgtgccaaagatcatggtagaaacatgtggatggggttggaagacactgctactacatctcttgggacagagcctgccccctccgagtggctacctaccattctctccggggaggtgaaggagctcttgggaacaagtgtgttattattaagagtttcgtcaggttatgtctttttttttttttttttttttaagatggagtgtcgctcttttgcccaggctggagtgcagtggcgctatcttggctcactgcaagctccgcctcccgggttcacgccattctcctgcctcagcctcctgagtagctgggactacaagtgcccgccactgtgcccggctaattttttgtatttttagtagagacggggtttcaccgtgttagccaagatggtctggatctcctgacctcatgatccgcccacctcggcctcccaaagtgctgggattacaggcgtgagccaccgcgcctggcaggttatgtctttgctgtaattggaggcagctggtccacttagaccctgatgcttgggcaaatactttatacacctctgcccccagcagctggtctggtgtgagtccaggcccaagtcaacccccaatgcaaaagccaatcagaagttggacctctttggtgagttcaaactgtggttttaggggatacggaggctggcttagttcagtccaggatcttagaacagccccaatgctccaggcccctcagccagcccagcttttagaggctcccaatttgagctctaaactgagctctggaaagggggtttgggggatgggggatacatttaaaggagtttttgctcaggacctgggtgccacctgctggccatgtttagttctacttacagagccaaagctacgagaggaaaattaaaagggcatcctgccctccccaatgtgatgtttgctcaaaggaaacaaggaggctgttacttcatgctgccctagcaggtgcagcagagaattcctgcagagacccctgggtgccctggatgagtcctcctgagccaaatggacccccattagggcagagtgtagcaccagttgtgaggacctgagcgagtcctgagtagggactgaagctgtgttcctgctactagctacctgcttccccagaagccccatagtgggtaacagcatgattcgttgctgggtcctgaaaggagccattttttccagcttccttcacacaggcactgctgccactcatgggaccctagagtcagaccgaaggtatggaaaatgccctcccttcatcaggcattgacaagactgggtcaatgctgagaagacctgggcatttttcaagccgctatgtggctcttagtgactcttgggagccctaaaagcaaggcctttagttgtgttctaaactccagggaaactggagattttccctgtgtgccaaggactggctagtattttccccccagataagtggcagaacatcccaatgttccagcctttgccattgcaacaaaagccagtaaatcacagctaagtatgcatatcaaatgaaggctgtggttctcatacagggctgtgcaccagaatcatctgggctattctttaaaattatgtgtgtgtgtgtgtgtaaaatatgtgcatataacatataatgtatatataatatatcatacacacacacacttgggctgcactgtagcctcttgaagtctctgcaggagaagccagtggactctcctagtaaagaatctctgcaatgcatggaagaggcctgaaccattagcaggtccaatcctgtggaaccaggaaagctgcccccaggctggaagacccttgaggctcaaatgatttcaatcaaaaactggaggatatatttggactaagaccattgcctttccttttcttcagtagtcaccccttgaaattcatacactttaagcagaacaaagtccctaaagtggctcggaaactcccagggccaacctaagactactccttgcccccagaaccacccaagaccagatcagcccctctgaggcctgtcagccacagctggcccagaatcactctgccccaggggcctcatagggaaatgagtctctgagcctgtggaacactcctgcagagtcattctggacagttcccggaatagctggtgccctctgcaccagctcctggccgtcctctgcaccctccctggggacctggcagagtctgaccactgtggccctggggtcattcacatccatctctctacctctgcatgccctctccttccctattcttgtggcacttgctgtttctagcacactttggggcatttggttatactgttctcatgtgtgcattactctccccaataagattatgaactccttgaggacagggacaaatcttttcaatttcttgcagtccacaactaaataatactcatcaaaatcagatgccctttccttgaccctacccactctgccccttcggcaagcttagcatccatccacccatccactcctcctcctgttactttaggtgcatcctgggaactcagaaacactcccctgactccagtctgcaattccactccaccaatatggttaggcagttattatccaccaagaactggtgtagaacccgaaagtgaatggaacagagcctgaccattgaagagcttacagtcaggtggaaggggcaggcacacacatttttatttatttatttatttatttatttatttattttttggagatggattctggctctgtcacccaggctggagtacagtggcatgatcttggctcactgcaacactccacctctgggttcaagcaattctcctgcctcagcctccctagtagctaggattacaggcctggctaattttagtagagacagggttttgccatgttggccaggctggtcttgaactcctggcttaggtgatcggcacccccctcagcctcccaaagtgctggcattacaggcatgagccaccgcacccgctctcacacacatgatttcaacagaccatgtgggatgccatgaagagccgtgcccagggtgctgtaggatcatgggcacatgtctcccacagagggggtcagaaaaagtcccctggagctaaagcagagtcctgaggctgagtgctgggggagggaggatggcggggggatggtgggggtatggcagggggatggcagggggacccaggccagaaggtgatgagacatgattcagaaagaggagaggacatgaggcatcactcaatggttcaacgttactgaacgtcttgcctgtgacaggcctggataccccactcttggcttcaagacatggggcgcaggcatttaaacaagtccaatggtgagcgcaagggccaagatgcagggcagtgggcgcagagacgttgtggaggaggaaactcaagtgcagtcaacattactctcggaaagctctgaaattgccaggtcttgagtctttaggcgctcccaagacaataattcatttctgtttctcttggctttttggccccgcctggcctccctttgcctgggcaatgaaggacaaggtttatttttcaaaggaggaagaactaggaataaagaagagggttttctctcatgatttttcttcaaagcattcatttaagttaaacatgctctgtcctatgtacttggggtcaggggtgggaacgtaagtggcacacagctctgcagatgccttgctgagcctccctgtctaaagcagtactactcaaacaggactgtgcctgcagatcctccgggcatcttggtcaaaggcagtttctcatttagttaggtctgggggaggacaagagaattggaatttctaaccagctgatccccatatagtcccactgcgcaggtctggggccacaattgagaaccatggaacagagaatgaatgaactttggggtggggacggcattccagacagagggtgagtaggaagctgcctatagctcctaactggggaatcaaagtaggagataaggctgaagaggtggggtccccttatgagtttgataagtggtcaggaggagtcacatgataacagcagatgcctgcgacaggcagggaaatattctttctgtaagaatataaggtgtataagatgtatcttatttcacagagacactttacatattaaacctgaagaaatattcttcactcactccagaaacacatgtcctcacaattctcggaaaacacagtccttttgacctatcttgtttttccatttctgataaagatgtggttacaagaaatatgtccttttcttaacagcgcaagtcagttagcagcagcagctgacccttggcctctggggtgggaaggaggctcactgctggctccactccaactgctggtttcagtgcgggagcatagggtcagagtggccaaaagaagccagaaatcccaagttgttaaacatctgaactttaaaatattgggcactaattcaaaactgtttccaacactatgagtgctgaacagtttaagtctgcaaggcaaattcggccaaggagtgtctcttttatgactgctggctgaaaggacttgaagtgggggagggcggtggccagacctgcttttaggtagattctgactacagcaatgtcaaggatggattaagaggagggagagactggaggctggaaggccttttaggaggctcctgctagcctgggctagagagaaaatacagtcagcccttcacatccgtgggatccacatctgtggattcaatcaaataccgatcaaaaatattcaggaaaaaaaaaggattgttgcattgcttacagacttttttttcatgtcatgatttcctaaacaatacagtataacaactatttacatcgaagtgacatggtagtaggtattataagtaatctagagatgatttaaatcatacaggaggatgtgtgtaggttaactgtaaatactacatcattttatataagggacttgactgtgcattgactttggtatggggagatgttctggaacaaattccctcatgaataccaagggacaacggtatgcataaatcctgagggtaagcagaaaagggcgaattgaggaagtcgggttccaggacttgaggaatgacttgataggtgcatgagggagagtaagctgtctgggatgaccccgcaggtttctaaggtggtgattaattgctggtgatgacattcactgggataatgaatacaggagccagaagcatattctaaggaaaggttgtggacaagcagaatttagatgcctctgcatcagccacaggaatgtggagtctgaagtcggagcagaggcaaaggttagctggctttctaaaacacaaatctggtcaggttactgtcgcttaaaaccctctaatggcttcctgtcatccaaatagaaagtccagattcctccttctggtaaacaagggcctggcaacctgtccctgccaacctcattgtgccacaccccaacagaaaaatctgctccccgggcctgctccacgactcagagtgcccggaataagctctgcctttgttcttgctagtccctgtggctgaaatgccttccacccatccctttttatgtctggaaaattcctattcttctcaggctccaacatctctgctctgaagccttcgctgaccctgcccagcagatgcgctcacacccttctttgtgctgtccctgaacatttatgtgcctgtttcactgcctcatcactccctactgaggggatctgcctgtctgtaaatgcctcaaggcagaggccatttcttaattaacttggaattactggctcctggtgcacgtctagcatatagtagatgctcatgaaatgtctaaggaataaagaccctccctctggggataaactgcgaggccaatctggagggaatgtttcttacttcccagtatcatacagcccctctctcttgacagctaaggagctacatgaggccccagtgctgacctcacctttcttcttgctttccagctggggtatggccgtcaatgtgtactccacatctgtgaccagtgaaaatctgagtcgccatgatatgcttgcatgggtcaacgactccctgcacctcaactataccaagatagaacagctttgttcaggtaggaggctgggaatatgggaagtggccctgctggaaggaaaggaaagaaaggtcggaaggcagagcagccacaacagggaatatacagtcatgcatggctgaatgactgatgtggccagagaaatgcatccttaggcgatgttgttgttgtgtgaacatcacagagtgtatttacacaaacctggatggtgtagcctactacacacctcggctatatggtatagcctactactcctaggctaaaaacatggacagcatgtttctgtactaaatactgcagacagttttaacacatggtaagtatttgcacatctaaacatacctaaacatagaaaaggtgataataaaataaaaacatggtattataatcctgtaggaccaccatcatatatgtggttcatcgttgaccaaaccatcgttatgcagcccatagctgtagcttgtgattagattaaggaggagagctggaggccctgaactagtcagactgtctggagctgaagtcaagaaatggaagcagggaaagagaagagcaggagaggcaccatgaaggactgcagggaaaggaggagcggggagctgagagccaggatggcagcagagccacaggtctgaccacacctctctgggtccagctctcagctcttctggtggtgcaaccttgggcaagtcactatactgccctaggcctcagttttctcatccataagatggagatagtatcaccaactaactagagttcctgttgggattgccctacctacatgcagtgtttggtgtggtgctggttcataatacgcatcaataaatagtcattgcttttattcttggaaagctggggggattctggccatgtctatcctgaaagtaggactggtccctggcccagaacaaggagagagaagaggagacggggtttggggaagtgagagagagcagctcacagaaggagagcagcaagacccctcagccagccatccttctccacaggggcagcctactgccagttcatggacatgctcttccccggctgtgtgcacttgaggaaagtgaagttccaggccaaactagagcacgaatacatccacaacttcaaggtgctgcaagcagctttcaagaagatgggtgttgacaaagtaggtgcctgcgctctggggggccctgaggagcagtgtgaccctggggaagaagaggacccaccagcccaggcaactggggctgctggggtcattccggtgctcgtgcctccctccacctcccgactctccagagggaattttccccctgctcaaggcacaatggaaaagcccacaacacttgccatgccatcatgacaacattcctttcccttcctcctctctggaccctgcccaccccaacactgagctctgtgcaccgctcctgtgaagttccacctctctctgtctctgtagggcccaagaaagtgtctctgctcactctactgcctcggtggctgcagacccccagcccacacgcaggcagtagagccaagggacgcctccccacacagttcttccacacggtgcctgtagagaagggatgcctctggatctgacactagggcctaccagcctacctgtctgctctggtgccgtgggaggggggcaagtggagaaggtggaggacgctgcagcccaggggctggctttcctgagagcagtggccctcagcagaggaaggcggtcctacagcagcaggtggctaaagtactctgcttatgtggtctatttcagatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccaggtgatcagatcttcaacaaatccaagaaactcattggcacagcaggtaacgtgcccgagccgggggagggagcgtggggggccgggccggcaggcctctatagccaggagtgccccctgggccacggcccggccctgccagcctggaggagacttgttatcacggagttcggatgacgccgcctgctggccagttagaccgggggagtgaaagtagtgggtgagagagctccacaaattggtctaagaggagagccaccagcaccagccatggtggcaactggggtaggaggcccaaggcactttgtttcatagcacgagctaacttgtttgcctcaagatgatggggcagcaaggtggcttggtttctccatccaggtgcatccagaccaagagcctggtgccagcaccacagccccttcttgccccctgccccctggatggccaggggcaggagttgccaagctggatcacacctttccccactctaaaggcccaatagtcctaagtcctcaaaagatgagtctctagaaacgaggctttgtctgggtcctggaggggaagggagaaaagcaatagggcctttgggaagcagcagcgttgggaggggaagggagaggagcagccccagcccgcgtcggaccccgtcatagcagagccacctcctctgtctgcactgctgttctgcctgggcctgccccactcgcccgcctgcttgctttgcactagaagcagcccgctctgtctagggaggtgcagtcgctagtgagcaagtcgccacggcatgctggctgcgctggggaggagctggggtccctgatttggccaccactgtgcagatacctggtccagcccagcagagggcaaaagagcccatcctgacacagggcccctggaggggcagccacccagggacaatggctttgggctggggcttctgttaggaaagaccctgtgccagctgcctttcctctagctatgagtacgagagggtcccgcacccttccaactctacttccccaaatttgcgtcctaatttctctcctctatccctcaggccagctctctccctgccccaacacctcacaccttgtttagttccctatagtttctgctctcccgggctcgccaaagggctgcccagctgctggagtgtccatgtggccaagactcggggcctagctgtagatgcccttcctggggtgggggcaggggggtgagagtgcctgcctgtcgcatgggcctgcccccgcagtcctcacaccaggctgtctcctgccacgtgcgctgtgggctcacgtggacttacctgactcttttcctctgggcagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacaggtgagtgggatgggtaagggtagctgagatagccctgtcaccaaagccaggcccttggggtgtctgcagggacgagaggagggcaggcaggggaacctgaggtggggacctctggcttgaacatcactttgtccccaagcagctggtggacttgaagctgacagtggatgggctggagaaggaacgtgacttctacttcagcaaacttcgtgacatcgagctcatctgccaggagcatgaaagtgaaaacagccctgttatctcaggcatcattggcatcctctatgccacagaggtgagcactcccaggcccattgggccctccccagtctggcctggccctaagaccagaagcgcgatagggccagaagggaccgtggagaacatttactgatgagagagaggtgaagtcactagcccagggtcacccattagcagggctcctggactcctgaccccttgctcttcagctacttacagaacctgagaagccctgcctggcctgcctggcccaccactttcctctctctcccaccctccaggaaggattcgcaccccctgaggacgatgagattgaagagcatcaacaagaagaccaggacgagtactgagggcggccgcagccctggctgactgcacagcttccccgtgcctccctccctgctccactcccacattatagtcctttcctaacacggtcggccgggtgctttgtgtcagtgctgcagcactggggagccaggcgaggggggcttgggggcatggggccggaaagcaggcagaagcccgtcctgggtggtgctggcccagttggtgggacccctgtccacacccaccctatttatttccgttgtctctctgctgtgtcgcccaacacttcccagggtgctgctgccacccgccccagccagccacctgctcctgacagccagcagctgtgtatttgacaaagtcattggtatatttttacttactggattctccttgcactttacctgttcttttccagagctgacagcacgggctccggcgcagtgtgcctggcttggcttcccttccccatggctgggggctggggtaggactcacccattctaatttattttgtcttttggcttctcagtagctaaggggaaggctgatgtcaggagagggagagggggctgaggaggtagtgctgtaggcccagggggtcagggaaagggaggggggcatgtgagggatggaaatgacctcctggcaccaggctcacccacccaaggccccctgccccagcactgaatcccagcgctgccctgaggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagta

SEQ ID NO: 400 - DNA, 31631 bp, Homo sapiens
cggggccacgccgattggcgcgaagttttcttttctccttccaccttcttttcatttctagtgagacacacgctttggtcctggctttcggcccgtagttgtagaaggagccctgctggtgcaggttagaggtgccgcatcccccggagctctcgaagtggaggcggtaggaaacggagggcttgcggctagccggaggaagctttggagccgggtgagtgtggcgtccagcgggctgcgagggactcgggggagggcgcatcggaacctctgaaactgaggacgttctctgtagactcagtcattgattcttttagctgacatgtaccaagcgcctgttcagtgccaggcactgttctgaactgttaagagcgttcctctgttccacactccgattcctaaaaggcttcccgcgctgcagggaactgagtttgcaggggggaaggcggaagccaacagcctagaagcaggagcattcctgccctccgcaccctgatgctcagtgatgactttccctccatctgcatttgtaaagcactctacttgtttcgttctttgagctatagtgtaggaaccactacagggaaggcggagcagaggttattaccccattttacggacgtaaattgcgcccagggagggacgtgtcttaggtcgcttttcgtgactaagcagtctgggctcctacccagatctttttttcagatgagctcctaactgctgggctgtctgtcattcaccttcttttcagaagagaagtctggtggcccccttcctacttctcttttctaaccccggaattgaagagtcttctgctgtgacagttggaaaaggcattcttatcctgatctatttgtgaaactgcaatgattatatacgattctagttgtctgtaacacatgaataatagtaccctcgtctctgctgtgttaggtgggctggaaatgccaaaggagtttccaatatgacagaatggtttaagtccctttgcaacagtttttaactttaatggagggcaatatgtggactttaggaggtttgtgaatctgccgaaattgaatgcaaaattttgcttgaattatgttagttccatagtattcatcaaatgatacttaataaataaaaccactgtaccttacaaataaatgcaagggattaaggtagtgggaaagtggatttaccattttgcattttttcacttaatcttccattatcctaaaatagtgcctggcacacgatgggtacttaataaatattggttgaataaacggaagattctattttctccattttgtgggtaagcaaattgaggcccaatccacaatgttcagtcagtggctgggaagcctgatttattgtaataagtacaccaaaagcaagctctcagttacatattaacattatccagtttcacacagtgtgttgtaaggtgaagtagttaagagcacagtaattgcagtctggcttttccgggtttgagttaaggctgtgccatcctgtataagataggataagttatcaccttgaagtgataataacatctacttttcttttttttattttgagacagagttctgctctgtcacccagactagagtgcagtgttgcgatctcggctcactgcagcctccacctcccgggttcaagtgatttgcctgccaccatgcccacctgatttttgtatttttagtagagacggggtttcaccatgttggccaggctggtcccgaactcctgacctcaggtgatccacccacctcagcctctcaaaatgctgggattacaggcgtgagccactgcgcccagcctttgtatttctgttttatccttgtgtgcattttataagcgtcatgaagacatttacaacccctgtatcactgtcttttaatttcactttgttagatgttttacacctattgttctgccttattcctagtatttctaaatgttacagtttcatttcttaggaattgacctttctgttttcctggatggaaagagatacggcatagtacaagatggacacagatgatactaaattgcctgtgtgtaatcttcgtagaccatgacttcaaataaaatgttttcttagtctaaaatgtatgggagtgtagcaggggcagaaaataagtctgatctcatttgaagggagggactgactatgtcttagaatccatcagataaataccaaatatttatcatggtaactcagagtttggactcttccacagaagccatggcacactaccccacaaggctgaagaccagaaaaacttattcatgggttggcaggcccttgttggatcgaaaactgcactaccaaacctataggtgagtgatggggtcctttggttgtcctggaaatacagcttctcaagctaaacagtcaacttgtatctagcctgttctaattactacagattgaccatgaatgaacaggagattagaactgattgtaaggagggttttgtttgatgcaagaagatggtgggataaatatagcagttagtgatggagcaaaattatggcaggctcataaaattttgtatgtaggataatgtcatgtctatttaaggtgagttctatataacttttgatgaaaacgagatgatagatgtttttactatgtctttcccagccctggagatctctgacaatttgacattgttactgggcagcttgacagccttgggaaacatttgttgtgggaagcatttgttgttctttgtcaataactgagaggaattagggttcctaataagacctttggattcattactcagctaaaacaattcattcaacccattttgcctattcttaaatataactgggcgaattggtttcccagtaggagagttggtcagcagaaagaaatcaggattggagagccctctcctttgtgcccaggggatctgaagagcttgacccactttaagttatttcctaatgtgcttctctgttacttcctagagaaatgtgtgtgaaaacagaaggttgttccaccgagattcacatccagattggacagtttgtgttgattgaaggggatgatgatgaaaacccgtatgttgctaaattgcttgagttgttcgaagatggtgagtttgggactggaataataaaccattccttgtcatgaatgattgggaggtggggagattgtggattcttttgttcacagcagtgtgcagggcacattagactgaggtgggatcacgtaagaactagctgcgtcttcttccatctaaaaaatttctttactcaccaaagcagtattgagtaaaacggaactggaaggctcaataatttaactttttcattattttggggagtaagcaaggctattaaggcagaattgggggggatggagagaatggatgaatttgggggaaagggagaaggaaaaaacaggtaatttgtactatcatagagatgtgtcctttagttttggcatgaaggttagtaatatattttgcaagtgctacttcgttacaagtgaagaggtaagttggatttggaaggtgtagcaattggggtttcagtcagggaaaacaaaaacacttaagatattttacccagaggaacttgtgtgttaatgttggaaaggctagaagaaaaggtgacatttaccagagatgagtaagtgcaggaagccacggctgcccctaggctggaggaacaaaagggaaggtggcatcaaccagagcctacaagcccacatcgaaagccttagctgatttgctgaccttctaaccctctgcaaaacaagaggagagcacagaaatgtgggagtggggcacagctccacaaggaggattaggaagatagcaatttgaaactatctaaaactgcctcgttcaagagacagaagaagggcatggtcattaggtaatcctgtggtagtctgtatgcccaagagaaggaactgatagactgagtggataaagatgttttatattactatagtcccccttatccgtggtttcaccttctgcgatttcagttacctgacaacaaccatagtccaaaaatattaaatggaaaattacagaaaaaaacaagtcataagctttaaattgtgtgccattgtgagtaatgtggtgaaatctcacgctgtcccacctgaaatgtgagtcatccctttgtccagtgtatccgtgctgtacagtatgtgtgtgtaggaaaaatcatagcatatacagggttagtggcagcatctgcaggttcaagcatctactggtcttggcgcgtaccctcagcagataaggggagagtactgcacatagataaggaggattttggacatactttctctttgacatacttagaagtatggagaaaaacctcatcaaactaatgtccagtagaggcagcacatcagaatcatgggcttcggtgtatagattctagaatcctctcttggtgctccattggatgactttagtctttctctgaagaaagctaagcagggaagagaggatgatgatgaggcactaatgagtgttctttcggttggagctattgctggtacggagtgatactaatcgtatgctgtaataataaagctgaagattgcaagcatttgccagaagtcatctcagtggttgatgctgtaattcttgtgtgtgtgtgtgtgtgtgtgtgtgtgtgacagtgacagaatcttgctgtgtcacccagactggagtgcagtggcacaatctcagctcatgcagcctcaacctcctgggttcaagcagttctcctgcctcagcctcccaagtagctgggatgacaggcacctgccaccatgcccagctaattttctttttctttcttttttttttttttttttttgagacagagtctcgctgtgtcgcccagtctggagtgcagtggcgccatctcggctcactgcaagctctgcctcccgggttcaagccattctcttgcctcagcctcccgagtagctgagactacaggcacccgccaccatgcccagctaattttttgtatttttagtagagacggggtttcaccgtgttagccaggatggtcttgagctcctgacctcatgatccgcccgcctcagcctcccaaagtgctgggattacaggcgtgagccgccgcacctggacaattttttgtatttttagcagagatgaggtctcaccatgttgggcaggctggtctccaactcctgacctcaagtgatccgcctgccttggcctcccagagtactgtgattacagacgtgagccactgcacccagcctgatgctataattcttgctaggatttttgttttgctgctgtttgatgctgtctttatagtcactgatttttatttgttcgttgcctgtgtttagagtagctcctctcagaggcctttttgtcattcctttgccggctgatagcaccattaggaaatggagcaatcccagaagagcgggtgtgtgggctggaattagattgctgcagttggtcatgtgacctttgacaaactctttaaggtcccccgtcacttgatttctttgcctgaaaagggggatagctgtagtacctaccttgtagggttattagaaggattaaggatcggccaggtgtggtggctcatgcctgtaatcccagcactttggtaggccgaggcaggcggatcacgaggtcaggagattgagaccgtcctggctaacacggtgaaaccccgtctctactaaaaatacaaaaaaataattagctgggcgtgatggcgggcgcctgtaatcccagctaattgggaggctgaggcaggagaatggtgtgaacctgggaggcggagcttgcagtgagccaagatcaaaccactgcactccagtccaggtgacagagtgagactccgtctcaaaaaaataaaataaaataaaagataacacatgttgggccaggcatggtggctcatgcctgtaatcccagcactttgagaggccaaggcgggcggatcacttgaggtcaagagtttgagaccagcctggccaacatggtgaaaccctatctctactaaaaatataaaaattagccaggcgtggtggcacaggcctgtggtcccagctactcgggaggttgagccaggagaatctcctgaaccagggaggcagaggttgcagtgagccgagatcacgccactgcactccagcctgggggacagagcaagactccgtcacaaaaaaaaaaaaaattttggcgggaggtggtggctcatgcctgtaattccagcactttgggaggccaaggtaggcagatcacgtgaggtcacgagtttgagaccagcctggccaacgtggtgagacctcgtttctactgaaaatacaaaaattagccaggtaggatggcaggtgcctgtaatctcagctactcaggaggctgaggcagcagaatcactttaacccaggaggcagaggttgcagtgagccaagatggggccactgcactccagcctgggtgacagagactctgtctcaaaaaacaaaaaacaaaaccacacatgtcaagggttaagcacagtgtctggcacataggaattgctcagtaaagtgtccttgagttgtcttaacctttccctttccaccaaattctttctagactctgatcctcctcctaagaaacgtgctcgagtacagtggtttgtccgattctgtgaagtccctgcctgtaaacggcatttgttgggccggaagcctggtgcacaggaaatattctggtatgattacccggcctgtgacagcaacattaatgcggagaccatcattggccttgttcgggtaggtgatgccaccatccttggttctaccttgaagcttatttctgtctgcctcctgaacttcatgaccccagaaatattaccggctctaataccccatagggaatgcattatttcctgtcatcttctgtgcttgcctgtctgtttcatctcaacagatatttattgagagcacgtatcatgtgttaggagcctcctacaagaggtgacatttgggttgtgacctgagggatgagcaggaattagcagatgtatctcagggggatgttatatttagctatgactgtggcatgcataaagcattgtgaggctgaatatgctggcttaaacgaggactgcaccttgagtaaatcagtacaaagagtgctagttgctacagacaaatttgtatgacaggatttcttaataaatcaggtgctaatgagcggctggtttgcaggctgaagtaagtcactggttatgagtttttcctgaagtgacttcaggctccccagcatgggattaggttgtgatgtgaggtgtggttgtatgctgattatgtggttcattgagcgttagggtagagactctcgtctggcatgattatcttaatttatctttgagttaaatgagtgaaggagagaaagctaaaggagtgtgaggcagatgcaaaagttgaggcagcaggatgagtatacgcggagaggcacagggcttggagcatctgggcaggagcacagtggtgggaatagcaggactgtgacaagacctcttcaaggagtattgcgcactctgtaggtaaaatgaggccagatcttagaaggcattgaaaaattagtttaagtaatttggtcttgctacagtgggagccattattggctgttgagcaggcgagcatgtttagataagtttgtggggaaacttggcataggcgaacagaatggactggaaaagaaagcaatggtagggtataagaatatcagctaggaggaatctgtgaaaataacccaggagtgagaggatgcatatttgaactagggtgataataataggaattgagagatgaacaataaacatttttaaaatgaaatgaaaggaataatttatttcactgatgtctttaaagtgattaatgataaaatgagtaaatactcagtaaatattcattattatgtgtttttctagcaatatgctatgccatgtctatgcgtctttagattggaaaggtaacattttaggtacagatgtggacttcaatgtttttaattgtagctctgatggaatactccttggctctcttggggctcatctcttcctacttatctatacttcctaaattcaggtgatacctttagccccaaaggatgtggtaccgacgaatctgaaaaatgagaagacactctttgtgaaactatcctggaatgagaagaaattcaggccactttcctcagaactatttgcggagttgaataaaccacaagagagtgcagccaagtgccagaaacccgtgagagccaagagtaagagtgcagagagcccttcttggaccccagcagaacatgtggccaaaaggattgaatcaaggcactccgcctccaaatctcgccaaactcctacccatcctcttaccccaagagccagaaagaggctggagcttggcagtaagttgtggaatggatcaccgtgggcaatactggggctaaagggttatgtgataaaaatgataatttatgggaaagtattgagttagtgatcacagtgcactatagcctggaactcaagtgatcatgctcaagcaatccttctgcctcagcctccccagtagctgggactacaagggtacatcactgcacttggctccattttctgggtttttttgtttttgttttttgagacagagtcttgctgtgtcacccaggttggaatgcaatggcacaatcacgacttattgtaggcttgacctcttgggctcaaatgatcctccttcctcagtctcccaagtagctgggactacaagtgtgtaccactatgcctggctaattttattttaattttttgtagcaagagggtcttgccatgttgcccaggctggtctcaaagtcctgggctcaagtgatccacccgccttggcctcccaaagtgctgggattacaggcatgagccaccatgcccaactatcaaagtttgtgtttaattttaggacttctccctttttttatttaattttttaaatatgtgaaacattaatataattcgagtcaaaactacttaaatgtacccagaaaagcactactcctttccttgtcctccaaccctgcttactccaccttctatatgttaattaattgtttccctttctggtttatctttcctatgtttcgttttggaaaaatcagcagatacatatacatatatgtatacctatatgcagacacacatatatttttatttttcgttttcttaccaaaagggtagtatactggatatattcttttccaacttgctttttccccttacaatgtatctgaaactcaccccacagcctttctgagagctcatcctcatcttgttgtagtcattcatccttttttgaattttttgtgtaggtgtcaacttcaagtataagttacttgtattcttgatagctctatagtacagtatgtgttttaggagctgaatataaatgtataaaacatttagaaaatgcagcacaaatattaactaatctgtaatatcaccttcagaaattaaggggctgactgggcatggtggctcacacctgtagtcccaacacttttggaggccgaggcgggtggatcaactgaggtcaggcatttgagaccaacctggtcaacatggtgaaaccccgtctctactaaaaatgcaaaaaattagccaggtgtggcagcacatacctgtaatcccagctactcgggaggctgaggcaggagaatctcttgaacctgggaggcacaggtggcagtgagctgagatcacgctattgcactccagtctgagcaacagagcaagactctgtctcagaaaaaaagaaagaaagaaacaagggagtttttcttttttttttctttaggtcctcatatgtcccctcttcttcctctttcaactctgttgaaattttacctttctttcaaggtatgtctcaaaagccatctttatgagcactcaggtgcttctggacacttatttcactttatgtaatataataggcagtcatgtgtatcatctgttagactagagtgttttttgtgttggaaccaggattgagcctcattcagcttttgtttaacctcagcccctggcacacgcctgcctttttaactgctcagttggtatctgcaaatgagcagctggggtccttggtgctgtggtcctcgtgatgagggagcaattccagacagttttgtgtattcacagaaccagtggattgtccccaggaaccccacttctctctattggcagatataatctgggttaagaaaaatcttggcctcattgttacttgatagcatctctagtataaatctcttcaaatgtcattgagttagggttgaaggcatgcgatgtcacccctgattgagacccactgttctgataggttatttcagggaaacctgttagagatgagaaaacactccatttatctgcaaaagctgacttaaaagttgacttatggttctaactaggaaaatcactcctaaaatttaggtgagagatgaaaaattattagagctacctgggctggagaaagcaagcctggaatgattaaaaatatagataattcctgttttacatataactcagtggctgaatttggctgtgatgagattgtgggtttgtatattgttaggtaaaaaatttacacattgtgatgatttctcttagacttaggtaaccctcagatgtcccagcagacttcatgtgcctccttggattctccaggaagaataaaacggaaagtggccttctcggagatcacctcaccttctaagagatctcagcctgataaacttcaaaccttgtctccagctctgaaagccccagagaaaaccagagagactggactctcttatactgaggatgacaagaaggcttcacctgaacatcgcataatcctgagaacccgaattgcagcttcgaaaaccatagacattagagaggagagaacacttacccctatcagtgggggacagagatcttcagtggtgccatccgtgattctgaaaccagaaaacatcaaaaagaggtgaccagggacattacccacagagcaaattgaaatccttcacatcacgtgaagtatgtgagtcatagtcaaaaaagttagaacagtagttgaaaaacctatgtcacagaagtattggggagctttcttaaaatacagatttctaggcctcttcccacacctagtgagtcagactccaagcactggccctaggaatctgtatttggaaatgctcttcagatggttccagtataccgagctgttatttggggatcattgctatagaagataacttcccaaacctgcattgctatccagtttgggatttcattagttcctgtggctttttgccacactttaacagtcattttttaaagcagtttttcattgttgttgttgtttcattttatttcaatagtttttggggaacaggtggtcttcggttacatgggtaagttcttaagtggtgatttctgaggttttggtgcacctgtcacctgaccagtgtacattgtaccctatatgtagtcttttatccctcacccaccttccacccttccccgagtccccaaagtcccttatatcattcttatgcctttgcatcctcatagcttagctcccacttataagtgagaacatatgatatttggttttccatttccaagtcacttcacttagaataatggtctcatctccatccaagttgctggaagtgccattatttcattgttttatggctgagtagtattccatggtaaatatgtaccacattttctttatccactcattggttgatgggtatttaggctggttccatatttttgcaattgcaaattgtactgctataaacatgcgtgtgcatgtgtcttttttttaatataatgacttcttttcctttgggtagatacccaggagtgggattgctgaatcaaatggtggatctacttttagttatttaaggagtctccacactgttttctatagtggttgtacaagtttacattcccaccagcagtgtagaagtgttcccttttctggctgggcgcggtggctcactcctgtaatcctagcactttgggaggccgaggcgggcggatcacaaggtcaggagatcaagaccatcctggctaacacagtgaaaccctatctctactaaaacataaaaaattagccgggcttggtggtgggcgcctgtggtcccagctacttgggaggctgaggcaggagaatgctgtgaacctgggaggcggagtttgcagtgagcggaggtcgcgccactgcactccagcctgggcgacagcgagactccatctcaaaaaaaaaaaagaagtgttcccttttcaccacatccacaccaacatctattattttttgattttttaaattatggccattctaacaggaataaggtggtatttcattgtggttttaatttgcatttccctgataattagtgctgttgaatattttttcatatgtttgctggctgtttctgtatcttcttttgtgaattgtctattcatgtcctttgcctactttttttttttaccttttgtttttttttttgagcgggagtcttgctctgttgcccaggctagagtgcagtggtgcgatcttggctcactacaacctttgcctcctgggttcaagcaattctcctgcctcaacctcctgagtagctgggactataggcactcaccaccacgcccgactaatttttgtattttagtagaggtgggatttcaccatgttggctaggctagtctcgaactcctgatctcaagtgatccacccatctcagcctcccagagtgctgggattataggcgtgagccaccgcacccagctctttgcccactttttgatgggattatttgtttttttcttgctgatttgtttgagttccttgtagattctgggtattagtcctctgttggatgcatagtttgcaaatattttctcccactctgtgggttgtctgctgattatttcttttgctgtgcagaagctttttagtatcattaggtcccatttatttattgttgtttttgttgcatttgcttttggggttctaagtcatgaattctttgcctaacaatgtctagaagactttttccaatgttatcatctagatttttttttttttttttttgagatggagtctcactctgtctgacgcccaggctggagtgcagtggcatgatctcagctcactgcaacctctgcctcccgggttcaagcaattcttctgcctcagcctcctgagtagctgggactaccagcgcgagccactacacctggctaatttttgtatttttagtagagacggggtttcaccatattggccaggctggtctcgaactcctgaccttgtgatccacctgcctcagcctcccaaagtactgggattacaggcgtgagccactgcgcctgcccgttatcttctagattttttatggtttcaggttttagatttaagtctctgatccatcttgagttgatttttgtataagatgagagatgaggatccagtttctttcttcttctttttttttttttttttctttttttggagacagagttttgctgttgttgtccaggctggagtgcaatggcacgatctcggattactgcaacctccgcctcccgggttcaagcgattctcctgcctcagcctcccgagtagctgagattacaggcacctgccaccatacccagctaattttttgtatttttagtagagacagggtttcactgtgttggccaggctgatctcaaactcctgacctcaggtgatccacccacctcggcttcccatttttgtatttttagtagagacagggtttcaccatgttggccaggctgatctcaaactccagaccttaggtggtccacccacgtcggcctcccaaagtgctgggattacaggcgtgagccaccatggccggccccagtttcattcttctacatgtggcttgccaattattccagcactatttgttgaacagggtgtccttttcccactttatgtttttgtttgctttgtcgaacatcagtcggctataagtatttggctttatttctgggttctccgttctgttccattggtctacgtgcctatttttataccagtactatgctgttttggtaactatatccttgaagttatagtttgaagtcaggtaatgtgatgcctccagatttttctttttgcttagtattgctttgtctatgcgggctttcttttttggtccatatgaattttagtattgttttttctagttctgtgaagaatgatgatagtattttgatgggaattgcactgaatatgttgaatctgtagattgcttttgcattgtggtcatttacacaatattgattctacccatccatgagcatgggatgtgtttccatttgtttgtgtcatctgtgatttctatcagcaatgtatcagatctaggacctttttggatgagtcttcagggttttctaggtatatgatcatatcattggtgcacattaacagtttgacatgctcttttttaattcggatgccctttatttctttctcttttctgattgctctggctaggactcattttttaactggagactattctcaaatacaaactgtacaaaaagataagacatttagaacaaactttgctgtacaaataaaaatgcaacaagccagaagttacaatttgtagtatttgctacctagaaacttcagcacctgttccataataggttgctcagtaaatgctttatattgaatatatagctgcatttctgctaaccttgagcctgtgtggataataaattcatgcatgcatcagaaacaaaaaaggacaagcacctctccctgggagtagcatattttggtctctagttggggagttggtgagtctaatttaaataaggttaaggcagactttgaactctgggtttgagtcaagcttcaattataactttttagttataattttttgccaactttttagcagaaagaaagttttactcttttcaaagtatatataaaaagactgggagccaatcaggccacttgactatcttctagtgccttttgtacactctggtatccaaaactgcttcccgtgacctcgctgtggtttcttgcagggatgcaaaagaagcaaaagcccagaatgaagcgacctctactccccatcgtatccgcagaaagagttctgtcttgactatgaatcggattaggcagcagcttcggtaagactactccttggcaggcagagaaacattgctgccatctctgatatctataatcttatctcctaatgcctcttatactgtttatttgccaatccattgaaattgaccttttacctagcatgtctggaattatgttaagtttcaaataattgtcttagtctgaaggggcaagaaatacttcctgggcttaggtgactcccatccctaatcatcatgtccagcaagactgttggtgggatggggtgcctaagagcatgaacttggattctgacagatctggatttgaacctgggctttgtcatttaccatctgtgtaaccttgggaaggcaaaattacctttctaagcctgaaattcctcatctacaaaatataataatatacatgtcataaagttgttgaggggtttaatgagataatataaataatgctcctaacagagtgtctcggtagcaagcacccatgtcacctggtcacaggagggaccctgcaatacttgtaatccacactaatgttatagagttcttcttatttagacttgaacactgagtatcaaaaaatatgtccctaccattcaggtttctaggtaatagtaaaagtgaccaagaagagaaagagattctgccagcagcagagatttcagactctagcagtgacgaagaagaggcttccacaccgccccttccaaggagagcacccagaactgtgtccaggaacctgcgatcttccttgaagtcatccttacataccctcacgaaggtgccaaagaagagtgtaaggttcttctaggtttacttcccattgaagcatccctctcttagtttaaaagttacaaatgctgaagtcacagattagtaacagctggaatctgaggacagatctgttatattcaatgctattctttgtggaatattcatggagaaggggacctaagtgaacactaggactgaaaatgaatctagtagagagtgatttttgaggtaagtcccttttacggtacagaatcagatggccaagagctgaacttcctgagggaagtaagtacaagacccactcctctttgcatttcccacggagcactggcagagtgggtatcgcatgtacggccaccgagctgtggtgttagttttgttgtcccacttgatacacctgagaaaccgggagtgctacttacatattggtaacaaatcatgtcacagcaagatggaaggaggagatcaatgaacatcttttctgcttcctgtggaactttagcagaacactgaaaaggtattcagatcaggatcttctcatgttcgaatgtgcttgagaaatgtttgaattaaagttaaattgacagagcatcttattctttggaacacagttgagaaatcttaattagaagactttctaaagctgatgtccatttttccgtatgaagatgtgatttggcttgggttgaaatcaaagaaaaatctcggctgggcatggtggctcatgcgtgtaatcccagcactttggaggccgaggtgggtggatcacttgaggtcaggaattcaagaccagcctggccaacaatggtgaaaccctgtctctgcttaaaatacaaaaattagccaggcatggtggcaggtgcctgtaatcccagctactctggaggctgaggcgggagaatcacttgaacctgcgaggcagaggtttcagtgagctgagatcgcaccatagcactctagcctgggcgacagagtgagactctatctcaagaaaaaagaaaagtctctagggaaaggaatccagtagatcagtagtccccagcccctttggcaccagggacccccttcgtggaagacaaactttctacggatggcaggggctggggggatggtttcaggatgaaattgttctaccctagatcaccaggcattggattctcataaggagtgtgcaacctagatcccttgcacacacagttcgcaataggatttgcactcctatgagaatctaatgcctctgctcctctagcagaaggcagagctcaggtggtaatgctcaccccacccaccactcacctcctgctgtgtcctggttcctaacaggcctctggtttgattgtgtctcctggcccccacccaaaagtagggatatagggtgtagggtaccttcagcataataaaaaagggcagaagcccatcaggtttcttgataccttctcagcaaggccttgtcaacacttttctgttttctccaaaattaataaatgtaaggcctttttgtttttttttgagacacgctcttgctctgtctcttgcccaggctggagtgcagtggtgcaatctcaactcactgtagcctcaacctcctgggctcaagcgatccttccacctcagcctcccaagtagctgggactacaggagtgtgccatcatgcctagctaatttagagggggctttcacctctgtgttgcccaggctgtcctcaaactcctgagtttaagcagtcctcccttcttggcctttctaagttttgggattacaggcgtgagtcaccgcaccagcctgtaaagccttttaaacagtttaagtgctttctgcctcgggaggaaatggagagattgttctctctctagccaggctgaaaacagagggtgggtggagtgaaatgccccatagaagggaatgctttgtagaaacgccatgaagatgagggaagcagcagcaggcttgttctagcaagccatgagcaaggaagaagatagagggctgttagactacactaagcggtgacctgggggtttggagtggaaaaatctgccaaggtttctccaggtcccgcaccgtgggccatggaagtcctgggctgatgcttggccatatcttcaaataagcccagggaaagatctaatgaatcaaacctagtttatgcctcctcttctcttctgtatttgggcagagtagttagggtgtcttaaacatttcttgtctttcaagataatattttacttttaaatagtatttcatccaaacttaattctttcctcagactgatattgttataaatcctgatactatacatacattagaaaaaagaaaccatatttggacgatgaacaaagtttatgcaatgtgaggtgagagagggagagtcatggtcctttatccaggaaggaactaagaggaattcaccacctctcttccttttatcagatcagcacaaatcacatttgctggtgtgtcctggatggtgttttgctttttccttgtgaaatatgttctttgttttcaatacagctcaagcctagaacgccacgttgtgccgctcctcagatccgtagtcgaagcctggctgcccaggagccagccagtgtgctggaggaagcccgactgaggtactgctgctgttgattccccttcagagaggcaggaaccatggggcctctgctttcattcacataaaattagcagtcactggtctacctaataaaggtagatacactgtgtgtctatacttttacctatctaggtaaagtgagtgtatgtttagaaaaaagaaacctctcaggcagcatctgggttagccagtgtggacaggccctgggaggactggccttcccgtctactgccatcatttccgcagggatggaagatgattagtcaggacagtgcctctttgttttgatgccctttagaaccatatggagactttcatataagtctggatcctgtcagaaatcaagcaaaatctgaatctcctgtgggatgaggtccacccatgtgatttgggtggagaaacggaggccaaggattatgaggccaaatggagggatttgagaatgaagggattctctagcatttgaaattgagttttcaggtagaaacatagacaagaaaccataatcattttccattgattaatgagtagatggttggggaatgttcctaaagtcttccttttctcccgtttaccaccaatggtaggctgcatgtttctgctgtacctgagtctcttccctgtcgggaacaggaattccaagacatctacaattttgtggaaagcaaactccttgaccataccggagggtgagtcatgtgaggcaggcagggtagtttggggaataaggcccctgctagtggaatgccttgggtgttacagttcagccatacaggctttctccagtatcagcagactagaccaaatcgttgctgaagcccaaagcttctgaaacatttgttgccaaagtaatcctatagtaacagaaattttgcctttcagaaagaatgaaactggccttcattgagtaggcagtttgcatatagcattatgcaaactgtggaatgaatgattctatataagcaggtcctactctgaccagcttccaaggatggtccctactgcccccacctccacatttcaagggtctcggtccttccctcagtatacattcccacactcctaactgattataacgtgtagtggctggctgagacctaccccacgggttttcctctcttgctctaggtgcatgtacatctccggtgtccctgggacagggaagactgccactgttcatgaagtgatacgctgcctgcagcaggcagcccaagccaatgatgttcctccctttcaatacattgaggtcaatggcatgaagctgacggagccccaccaagtctatgtgcaaatcttgcaggtaagcagagctgtttaggctttttggaaaatgctgtttcttcgtgacacatgaaaaaggaaagagttacttaattttgcgtgtattgcatgttcatgatataccaggcattgtcctttctgtagaggtagcaagggcaaggaagacagaattcttaccctaagagacttcaaagtctaggagctggataatgattacaagccaggaagccagtacttacccacatggtgaaaactgtgagcttacaggtagcagtgtggcaacatggaaaaggggtccgtggcaggccagaggttaagccttgctctttgtccatgggctgttattttggagcaggtaacatccagttatagaattctgtaatagtgattttaagggggcttctggcccagcctgtgactcatttgcatttcaaactcatataccttctttatcttctctttcggtgccttctcttgtccttccaagtaaaggttaagactagattgggaggcagaatataggataccgaagtcctcaggttaaatgcctccctccatttgcagatttaactttaagcccaagggagtaagacccttacagttcctcacaactgtgtttctcctaatgcagaagctaacaggccaaaaagcaacagccaaccatgcggcagaactgctggcaaagcaattctgcacccgagggtcacctcaggaaaccaccgtcctgcttgtggatgaggtgaggtgcccatgggcggacaggagaagaaacagggctgtacctcaggagcaagtgctggatgggagggaggaaagtcctggctcccttctccattcatatgagcccattttctggtgctgagaggcgtgtgtcaatggattgttttggtgctatgacttgggaaacatgcagctaaagcagtggttataggtcttcattttgaagcaccagctcagtctctgtgattgactctgcacctctctcctttgccctggcagctcgaccttctgtggactcacaaacaagacataatgtacaatctctttgactggcccactcataaggaggcccggcttgtggtcctggcaattgccaacacaatggacctgccagagcgaatcatgatgaaccgggtgtccagccgactggtaggttctagggcagttcccatgctgttcttgcagatctgtaagcttggccaagaagttctgcaaaaatggtccaggtgtggtggctcacgcctgtaaaccccgcactttgggaggccaaggcgggcggatcacttgaggtcaggagttcaagaccagcctggccaacacagtgaaaccccgtctctactaaaaatacaaaaattagccaggctaatttttacttaggaagctgaggcaggagaattgcttgaactccggaggcagagtttgcattgagttgagatcgtgccactgcactccagtctggcaacgaagcaagagtccatcccaaaaaaaaaaaagttctgcaaaaatgaatactaaaataaattgggatgttaagaaatgtgatttctgcaatgcttgtagtttctatgttggaatatgtaaccattgcatgattttctgcaaacatcatatcttggtgttctgctgctcgtggacttttaaactgcaccaaaccatggaggtttaattatttaaaaaaaaaatgttttaggctgggcacagtggctcacgcctgtaatcccagcactttgggaggccaaggcaggtggatcacctgaggtcaggagttcgagaccagcctgaccaacatggagaaaccccatctctactaaacagacaaaaattagccaggtgtggtgacgcatgcctgtaatcccagctactcgggaggctgaggcaggagaatctcttgaacccgggaggcggaggttgcggtgagccaggatcacgccactgcactccagcctgggcaacaagtgtgaaactctgtctcaaaaaaaaaaaaaaaaaaaaaaaagttttagcacttataacctgccaggcagtgttaggtgcttggaataatgcaataaaccaggcagatgcaatgtctgccctcacaggccttgcagttcagcaggaagcgcaatgagaaatcatgaagagcctggtaagtgaagccaagtgcagtgacaatgtatagcatagatctgaagatcctctcacccacttcaattaaagcacctcagcttttatctacttccaaatgattctgatagaatcaaaggtccttaggccgggcgtggtggctcatgcctataatcccagtttaggccgggcgtggttgctcacgcctgtaatcccagcactttgggaggccgaggcaggtggatcccgaggtcaggagatcgagaccatcctggctaacacggtgaaactctgtccctactaaaaatacaaaaaaattagctgggcgtggtggtgggcaccagtagtcccagctacttgggaggctgaggcaggagaatgacgtgaacccaggaggcggagcttgcagtgagccgagatcatgccactgcacggtagcctgggcaacagagcaagactccgtctcaaagaaaaaaaaagaatcaaaggtccttaaatgaaatgaaaaaatagttcaaaaactactgccctacaggacaccactggtcattgtcagtaaaggcagtggtagtctaggtatgaaatgtgtaatttgttatatgggacctgggaattgggtttgggggcccaagggtgactttccacctggataatcactgggcagtcaaccaacttattcctctgtcattttggctccccagggtcttaccaggatgtgcttccagccctatacatatagccagctgcagcagatcctaaggtcccggctcaagcatctaaaggcctttgaagatgatgccatccagctggtagccaggaaggtaagtcaccagctgcacccataaatcagtcagcacatctttgctgagtacctgctgggtatgaggccctatgctggtgctctgaggttggagagaaatttagaaagtcgtgtaaaaatatcaaaaaagacaagattatgagaaattccttagccttgttattttatgattagagggccctaaatattgtgggtttatatgcaaactaatatgaattcattcagggagcaagcagttttgcatgatgaaagggacaatatagtcaggtagacaaacctggtttgaattctggctttaacgcttagtaggcatgcagaaagttataggaaagttacttaaaaatttcctgagcctcagttttcttctctgaagaagaatgagagcacttccctcatagggtcattgtgaaaatataacaatatcatgtctattacatgcccagcaaggcacactctccaggctagatatgaggtattagatgcccctctcctccaagtctaataggagaatgctccctgagagttcaccacagactagtctccccggctgctgaggaacaaagtgggttaaatgtctgcctcaagcagaaagaaagaaagaaaaaccgtacatccacaagtatttcagcatgtaaaataattataaacttatttctagtttcctcttgccgacacactcttcaccctgaatggctgtagcagcagcacatgactgtgactcctgcttggaactagctactgtattagggactggggtaagaggtgagccaattgtgtgcctgtctccaggctttgctttccaggagagagatcctcaaagttatcatctaggcattttatgggtagagtttttcacttttgctattatgctatctatctagactatctaagaggctttttcttttctttgaatgatcctttttttatgccacccttttttttttttttgaaacagcatctcactcggtcgcccaggctggagtgcagtggcgtgatctcagctcactgcaacctccgccttctaggttcaagagattctcctgcctcagcctcctgagtagctgggattacaggcgtgtgccaccatgcccagctaatttttgtattttagtagagatggggttttgccatgttggccaggctggtcttgaactcctgacctcaggtgatccacccaccttggcctcccaaagtgctgggattacaggagcaagccactgcgctcggccaatgccatcctatttatttgaaattgtcctttcccgttttcctccaagatgcttctgtcagttgattttggtctctatcttgcatcgttagagactttccacagttgtcttggttgtcctctcaggtgtaagggtggagattaaacagctggctctgaacatgtgagtggggcttattcactatgagatttgctgtgggatgatctgagtgggccagtatcactgtctttcctcctttcccatgggaatagtcagatttctcagtatgcttcccctgtcctgtctggagggcagtgttctgggaatgaggggctggtgtcaggtacagaagaggtcttccagtttggcatgcatatagtaatcatctatttttggtaagggacacctcttctacaataatgcctagcattcctaggaccagagactttttgctaaactttgcttgagaataaatttcctttgttttttttgttttttgttttgagacggagtctcactctgtcgccaggctggagtgcgatggtgcaatttcggcttaccgcaacctccacctcccttgttcaagccattctcctgcctcagcctcccaagtagctgggactataggtgcacaccaccacacccagctaatttttgtatttttagtagagacagggtttaaccatgttggccaggctggtctcaatctcttgacctcctgatccacccacctcagcctcccaaagtgctgggattacagccaataaaacttttatttataaaaacagatggtgagccacactttgttgtttcctgatctaaggcatctttagtttcttaacgtcctcaactttttttaactttcaaccacaaccaaatattctctacttttggctgggtgcggtggctcacgcctgtaatcccagcactttgggaggctgaggcaggtggatcacaaggtcaagagatcgagaccatcctggctaacagggtgaaaccctgtctctactaaaaatacaaaaaattagccgggcgtggtggcacgagcctgtattcccagctactagggaggctgaggcaggagaatcgcttgaacctgggaggctgaggttgcagtgagccgagatcgcaccgctgcactccagcctgggagacagagcgagactccgtctcagaaaaaaaaaaaaaaaaaataccctactttagctaaacaacccccctttacctctttccagcaccactaactcctgagcattttgaggatttttaatgtaacttagatttgttcttggattcctcaatataggtttaggatttggctttctccagtccactacactaaccgctactcttccatgtctttctaacttgcagaattattattattataatttttttttttgagacggagtctcgctctgtcgcccaggctggagtgcagtggcacaatctcggctcactgcaacctccacctcttgggttcatgccattctcctgcctcagcctcccgagtagctgggactacaggtgcccgccaacatgcccagctaattttttgtattttcagtagatacggggtttcactgtgttagccaggatggtctcaatctcctgacctcgtgatctgcttgccttggtctcccaaagtgctgggattacaggcgtgagccaccgcgcctggcactaacttgcaaaattatatttttaaatcttctcctgatgcttcccttccttttagagtcttggggtgggttgttgttgtcattgttttttgagacagtcttgctctgtgacccaggctggagtgcagcagcacaatcttggctcactgcaacctccgcctcccaggttcaagcaattctcctgcctcagcctcctgagtagctgggactacaggcaggcacccgccaccatgcccagctaagttttgtatttttagtagaggcggagttttaccatgttgtccaggctggtcttgaactcctgacctcaagtgatctgcctgccttggcctcccaaagttaaaggattacaggtgtgagccactgcacctggccagagttttggtgttttgtttgttttttttttttgagagggagtctcactctgttgcccaggctggagtgcagtggcacgatctcagctcactgcaacctctgcctcgtgggttcaagcaattctcctgcctcagtctcctgagtagcaggactacaggcatgtgccaccacgcccagctaattttttgtatttttagtagagacggggtttcaccatgttagccaggatggtctctatctcctgacctcgtgatctgcctgctgcagcctcctaaagtgctgggattacaggcgtgagccaccgcgccccgccccagcccggtttttttaacaaagattcagaagacatccaatttggatgctgctcttcctcaaatctcttgcccatagtttcaaagccctctctatttctttacatatgacgaagcgaatctgttttatattctatatcctatagttatgatacctgaagtctttaggggtctgattctgataaccattgattctgctggttcccatgcatatgtggcttggttttcttatttttttgtcttgatttttattttattttactatatgcatggaattcagcatgctcctttatttgagagttaattggggcctgggttgaagttgaattcatttagaatttgtttttttttttttttttttttgcttctaggggcactaccaactgttaccatttttaaaataaaattctccacttgagaattgtaggaaatacaacataaatttgggctccaaatccaagcaagggcttatggttgtaaaaactcgagagtgtctgggtagggtggctcatgcctataatcccagcactttgggaggccaaggtgagaggatcacttgagcccaggagtttgagaccagcctgggcaacatattaaaaccccgtctctacaaaaaatttaaaaattagcccaatgcgatggcatgtgcctgtagtcccagctacttgggaagctgaggtgggaggattgcttgagccgaggaggtggaggctgcagtgagtcatgatcatgccactgcactccagcctgggtgacagagcaagaccctctctcaaacaaaaaaaccaacaaaaagtcggctgggcgcagtgggtcacacctgtaatcccagcactttgggagggtgaaaccccatctctactaaaaatacaaaaaattagccaggtgtggtggcagatgcctttaatctcagctattcgggaggctgaggcaggagaatcgcttgaaccccacaggtggaggttgcagtaagctgagatcccaccactgcactccagcctgggcatcaagagtgaaactctgtctcaaaaataaataaataaataaaacccaagttttttgtgtgtgcccacatccacctagcaccaaggtcaagtaggccgtttttcctgccatccgttctgcgtgatgggtctcactcaccctgtactgaggctgaagtggaggtcaagtttcaggtgcctgcaggatgtcctgttaggttccatgttggctgggccttagcttcttcttgtgtctcccttgtcccagcagcagcccgaagggatgcatagggttgccaagtgtcactgatacccttggggtcagactggtttaggtgtttccttaccccccagagttcccctttcactttgtcttgaggcccttgagtccctgctattcaccacacaaagtgcctcttcaccaggctgtacaggtggtaatgggaggggaggagaactgacgaagcaggaagggctacaggacacccttaccagttcaatactggggattagaggaagggaaaaatgtaagccgatagtcatgtttgtgtcctgggttacttggaaagtgatttttttttttagatggactctagactggagtgcagtggcgtgatcttggctcactgcaacctccacctcccaggttcaagtgactctcctgcctcagcctccccagtagctgagattacaggcatgtgccaccatgcccggctgatttttgtatttttagtagagatagggtttcaccatgttggtcaggctggtcttaaacttctgacctcaagtgatccacctgcctgggcctcccaaagtgctaggattacaggtgtgacccaccgcgccccagaccctggctaatttttgtgtttttagtagagatggggtttcgccatgttggccaggctggtctcaaactcctgacctcaggtgatccgcctgcctcggcctcccaaagttctgggattataggtgtgagccaccgcgtccagccccttcctacattcttgattctggtcctcttagccattgaccaagccgaccccaaattcaccacgtgctgtaaggggtgcctggctatggctttatctccagataggctccacctcaccctcttgtctttggctggctgcttctgggggcacacgtctgtctctatgcaaggagtgagaactctgtttgcagatgcttcaatagtgatcttgaaccaagcgtctctgattttagacttcatttcctgaatagtaaagctgagaatttctgtgttgtccactgtggagttaactgtaaaaccaagacagaggtttggactagaggattagagtcccatgcacaatgtaataattcatttctattcttcctccaggttccctgccagggctaagtacttaactttacgcttatgtccattgccagcactaccaagaatctcttggttcttctgggctaaggtggcctcaggaataaaatattccctcttgtaggtagcagcactgtctggagatgcacgacggtgcctggacatctgcaggcgtgccacagagatctgtgagttctcccagcagaagcctgactcccctggcctggtcaccatagcccactcaatggaagctgtggatgagatgttttcatcatcatacatcacggccatcaagtaagatgctccacttcctgagccttcctggaaggctgtagaaacatgtttccctttctaagcttttactcattcaacctgcacttattaataacacagttatgtttcatagggacattatctagtcagggaaacagaaatataaccctaggataatagaatatttgccacttattgagctatattataggtgtttagggcataaaagtgctatgataggaacaaaaaaaaaaggaagcagctgcttctctcacactgattgatgtgctcagctcatgaaatgagggcacaggtatttatgagtgaccagtgtatttccggatgtagttgctatgtttcctcacttccacagtgacattttctgtatcagtttgagagtttgggggtcagggagatccttgccacataatataggagaaattatttcccgggttttctcttttctaaagacacagaaaagttttctttggctttcctctgggctggggttacagccactgacaaaaactcacatcccctcgtttcctttaagaaattcctctgttctggaacagagcttcctgagagccatcctcgcagagttccgtcgatcaggactggaggaagccacgtttcaacaggtgatctcctcctcttttcaaatccttctagattttggacttacgcttttaaaatacatggaaatttccatgaatgtgtgacactctattttgtgccacctagagtatgtgaaagaataccagaccggcacctattttaatgtgacattttgtagagctgcatgagaagagacctttagcgactggtttctgcatgttagattgaaggcctgtgtgccagacactgttcaaagaatgaggaacaagacaaagttactccctgattacagcttatgttgtagtggagtcaaggctttcagaatgaggccatatttgagaacaaatcacagatcaatccaatccctgcatgggcatagttcaattagatcaagtgagagggatcagtagggcatgtgctttgttagtttacttaagactctagtaattggctgccttggaagatgaattgttaaaggtgtttatgagtgtgtacctgagagtgtgtatgtttgtgtatgtatgttttagacatctttatttaactaaaataagtcaggaaaacattttcctttcagctacttatttattgggttggttgtaaattcttgtttaaaattttagctactcgtcatgttttgcccattactgttctcctcctagagtctgagatagctcttctgcagagagtgactttcattttagtttgtaaacatttcctgaacatctgcagtgtgccattaactgtgatgaatccttgaaccccaagctgatttggttaacatccctgttcctgacaaactcccagtcttggggctgggacggggatagactcatagatatttagaatggaaagtgaccagaaatgctccagatttagctgacccagtagagaacgttagggtaggaatctatgtttccagctatcctcctgcctccctttatttctttattcaattttctctctaggcctttgtgcttttccaagggtcatgccttggcatttgctcactgtacctgataaggaaagtggccttgtagcaaaatttgacttgaattttgacagtctcaattatgaaactctcagcccctggagacaagactatttgtatcaccagtgagagttactagtcattttatatccattaactcacaagggatgtacagtgtattttatagataaaattgaagctcaaaagagtgcagtaacttggccaggtctacatatttaggtaaatggtagcaccaggattcgggcctgctgttttctgattccaaggctagcattccattctgcctctgcattttgtgtaccactggggcaccaactgatgccttctggagtgtttgatatcctgggggccatgtgtctgattttcccaaatgaagaaagaaaggaacagaaaaagccccaggattgtatttcctcttaacctttgccttgctatttgtgtctagatatatagtcaacatgtggcactgtgcagaatggagggactgccgtaccccaccatgtcagagaccatggccgtgtgttctcacctgggctcctgtcgcctcctgcttgtggagcccagcaggaacgatctgctccttcgggtgcggctcaacgtcagccaggatgatgtgctgtatgcgctgaaagacgagtaaaggggcttcacaagttaaaagactggggtcttgctgggttttgttttttgagacagggtcttgctctgtcgcccaggctggagtgcagtggcacgatcatggctcactgcagccttgacttctcaggcttaggtgaccccccaacctcatcctcccaggtggctgaaactacaggcacatgccaccatgcccagctgattttttgtagagacagggcttcaccatgttgccaagctagtctacaaagcatctgattttggaagtacatggaattgttgtaacaaagtatattgaatggaaatggctctcatgtattttggaattttccattaaataatttgctttttcctga

SEQ ID NO: 401 - DNA, 268098 bp, Homo sapiens
tttggaaggcagacatgtggcccatctctgtagccatcactgagaaatctggattttcaaggtaagtgcagatgacttaggtttggggagacatgaatgaaagtgctatagaaataaagcacacttaatttgttggcatagtcctaattcagaatcttcaaatggttctgctctaaaaagcaagcttattctctgaccacaactcctcctttatagaaagaattgttctattcttactgcttaggatatgctgctctgaaagtaaaacctaatatttatgggtaaatgtgaacaaaaatgatttcagaatctctctgtcaaaaaaccagctaaacatatcatagaattttttagagcagttggcactattgaatttgtgtataattattcaaatgcttatcttttaagtgatgtcttaatttccttttgttatgaaaatcctttaactctattactgcattattttcagatagagtttgaaactattcaggcagccctagtcaatagaaggaaacaatctgtaagcaatcaagtacttagaaatttctaaaagaagtatattcaaaataacatgtgaaataatggtaattataattctttccatcccacttttaaagtactacttaacaggaaggatctgaaaataacttcttaaataagataaataaaaagaacaacatctgttcaaataattttactttaagtaaaatactttctataccagtattttctacttccaagaagtaatatttttcaaatatgtggaatgaaatataatgcaaagtttttaaacaataagtcagtaatgcctaacctgaatataggcatttaattttgtttcttttacaaatttgttatatgacttttgataggtcacttaattctctggacttcagcgttctacataactgcacaattacttatctgagaaattacttattaagtactccagaattacatgtctttgttttctgttttattgggtttaaatcagttaattaggattttaatcagtcaatagaagtaatgggaagaccaatggatgaggaatcaggtggtgtgaattctagtcctctgttttctagtaattggctgcataatttgggggaatattgtctaaggattccagaccaggggttggcaaactttttctacaaaagccttgatagtaaatattttaggctttgcaagccaagaggtagaactgaggctaatatattggtacttacataaccatttaaaactataaaaaccattcgtagctcacaggctgtataaaaacaagaagtgagccagctttggcttaggtgacacaattttccaactattcttctagcaatgattttcaacaattataaaatggaagttgtagactggataagagatgctcagctaagggagttcctggatggtctttagattgatacaccaatcctctgaaattgcatgcaaaaatgtaagtgtgtgtttttcttttcttccttttgtgcgtgtgtgtgtttctctccctccctccttccttcctgcctgcctgcctgcctgcctgcctgccttcctgccttcttccctccctccctccctccatctctctctctctttctctctttctttcttcagggcctttctctctgttgcccaggctggagtttagcgactcaatcatggctcactgactgcagcatcgacctccggggctcaagtgatcctttcatctcagcctcctcagtagctgagactacaggtacttgccaccacacctggctaattaattaatttttttttttaaatagagacagggtcttgctcatgttgcccaggttagtctcaaactcctgggcacaagtgatcctcctgccttggcttttcagagtactgggataacaaacatgagccactgtgcctggcagcacttttttttttttttttttttttttaaataagaaaaacacggattgattttcaaagtggtccaaaatccattgtagttaaggaccacaggtctagctaatttctaaaagtgctttccaaatttaaaatcaatgagcctgtgaaatgtttactggtgtctactatgggtaagccattgtgctagcactataagagacgtagcatgttgtgactaaaataatgtgttaaatatattgttaaataatatgttaaaaaatatatttttgggacagggcctcgctctgtctccaaggcaggagtgcagtggcacaatcacagctcactgaagccttcacctcctggaatcaagtggtcctctcacttcagccttccgaatagctgggagtgcaggtgtgagccaccctgcctgccttttttttttttttttttctttagagagggggtctcactatgttgccaaggctggtctcaaatccctgggctcaagcagtcttcctgactcagactcagactaaaaatattttaaagaagttagaatatgtgcaagtctgtgctgtctttcaaagtaataacattgaaaacaattttcaattgatcaaagatttctgagacattgctttgcaaagtgttttcaaagctagttcatacgttataccaaagtattttccaaattatgttattgtcccatcttattttgaatgacaatgttattattcgtgacagtcataatcaaacttaatctaagcatagtctgtttcctaaaaacataatttccttaagggcaggaactatgcctttgctacctttatattttagaacagggtttgacccataataagtacccagcatctttggaatggttatatgagtgaataagtgaatgaaatgatgaaggtattatcatggagattacgtaccatagatagtgaaggcttggaactccagatggtctaaaagcagtagttgctaagtccaaagatggcttctcttttcaaaattggatgtaactgtgatttcaaaataattggccaactcaatattgcagttcctgatgattaagtcactttttaaaaagagtgaaatttgtggaatttaattaacataggagagagaaatactttttacaaggttgctagtaacctactctctgggatggcgtgagtggagagtgaaattttgttaatgaaaagcattgccatcagcatctgagcccctcgtgtcctgagactgggtagaagatagtatcagctggaacatcatgcataactggtagcttttctgggaaatccaaaagtcaagtctggtagaatttagggcaccactctgctccctgataaagaagttcagactgagctccactgcctgcccaattgatgatgtcagtcggagcactgtttcctgggaatttcccacagctacccagggcaggggaataacttgtgatcaatcaaattgtagctctgttctcactccaggaacaattccactaaaggaaatccaatctataatatctagtatatgattcattcacttcttagggaaatttaagatttaaaatgttgagaaatggtaatgaaaaacctgagtagctttgtatatagttggtgtcatgcctgagacatccttattcaaaaaagtgcctctcacctctactcttgtcatcctctcatctcagaagctgttaggaaatagaaatatactatttgctttgggatacaattatacagtgagcctgtgcagtatcactctatattaaatagcaccattttcttcacacatttagcagttctactgaggacatattcccggatctccttaaggattgagataagtcccaaatataatccaaagaccacatgcttcatgaatgggagctcgaatatgtcttatgatccaaggtctcacttggatgtggcaggaagcttagtcccctctctgaggatttctgagactccctgggcagtgcttgcatgttctacaaattcaagactggtagcacacactcctctcgcttcgactgctgtcccaagctccattttcagatgacccctgcacttccctggaaggctttactccaaaacgtggtcaagaccccttccattccctctcaaacacaagtaaacttaaatctgtgacaaagctatttttggagcaaactttttcttaaaggaccagatcataaatattttagattttgtgagccaaacaatctctgttgcaacgatacaacttacaattgcaatgtgaatgcaaccacagacgatgcataaataaataagcttggctgtgatcagataaaaactgtgtttacaaaaacgagtggccagcccatgggatgtactttgctggcccatgaactatattgaatgcttcgtgtcaacttttaaaaactactatgtagtaggctgggcgcggtgactcacgcctgtgatcccagcactttgggaggtgggtggatcacctgaggtcaggagttcgagaccagcctggccaatatggtgaacccccgtctctactaaaaatacaaaaattggctggggcatggtggtacacgcctgtaatcccagctactcagggggctgaggcaggagaatcacttaaacccaggaggcagaggttgcagtgagccaagattgcaccattccacttcaacctgggcaacaagagcaaaactccatttgagaaaataaataaataaataaataaataaaattacaatgtagtaaaaagagatataaaactgacagttagagaatgccttccagaggtatcagcacttcccttcctggaggtgtccatcattcattttagccctggcctgaggccatgctactgagacgcactcatccttcctggccagaagtcctctctcctccttgccttcacttccacaatttcaggttcttctccgcacaggttaagccccagctagggatgtgaaaaacaagttcatgtcatagtcatctgacaagaggaaggcccattgaatagaaatgtggtccatggaggtcggaagcatctctgaaactaccagtagcacttaccttccattaataccactaaagggcttatcaaaattttcctttcttgactaaagagagagtctgccataaagacaattcttttcccctttcttttaaaaattattattatggtaaagtatataaaatttaccattttaaatattttaccagatagcttagtggcttaaatacattcagtttgttgtgcaaccaggactacaactcatttccagaagtttttcgttatcccagactaaaactctttactcattaaacagttactccccattctttccttctctcaggcccctggtaatcttatgaagctatgatgaaatttatcaaatgctttttctgaatctattgagatgattacatggcttttgtctttcattctattgatgtgatatgtcagatttgtcgatttgcatatgtcaaactatccttctatccttaggataaatcccttttggtcatggtgaataatctttttaatgtgctgccagattccatttactagtattttgttgaggatttttgcatctgtgctcatcagggatataggcctataattttcttttttggttgtatccttgtctggttttggaaacaggttaatgctggccttgtagaatgagcttaaaagactttccttctcttcaattttatggaagagtttgaaaagaaatagtattagttattttctgaatgtttggtagggttcagcagcaaagtcatgaggtcttgggcttttctttgatgggagacttttttaaaattatggattcagttttattattaataattggtctattcagagtttttgtttcttcttgagtcagtcttggtagggtgtatgtgtccatgaatttatccatttttgctaggttttccaacttgttggtgtacagttgttcatggtagtcttcagtgatcctttttttttaaaatttctgtgctattaattgtacagtctcttttcatttctgattttatttatttgggtattttctcttttattcttggttagtttagataatcatttgtcaatttcatttatattttcaaacagttaagtttttgtttcatttctcttgttattttttttcagtttcaatttcatttatttctgctccgatcgttattatttctttccttcttctaatttggggtttgttttgtttttgtttttctagtccctagagatacattgtttatttgaaatctttctactttttcgatgtaggcatttatttttacaaacatctctcttaatactgcttttgctgtgctccataaattttggaattttaggtttctattttcatttatttcaagaaattttaagatatccttcttaatttcttcatgaccaattggtcattcaggagcatgtttttttgtttgtttgtttttgtttttgtttttaatttccatgcatttttacggttttgaacatttctcttgtaatatactttggatgtcccctccgaatctcatgttaagatgtaattcccggcgttagaggtgagacctggtgggaggtgtttgggtcgtgggagcagatccctcacggcttggtgctgtcctcctgatagcgagagggttttcgcaagatccactcatttaagtgtgtagcacttcccctgtcctttcccctttcacagtgcgacgtgcctgctcttgctttgccttccacagtgagtaaaatcttcctgaggtctccccagaagcagatactggcactatgcttactgtagagcctgcagagccatgagccaaataaacctcttttcttataaattacccagtctccgatattttttatagcaatacaagagcaacctaatacactcttgttattcatttctagattatttcatcgtggtaagaaaagatatttgatattatttcaattcttttaaatgtgttgaggattgttttgtggcctaacatgtaacctatcctgaagaatgtttcatgtgttgatgaaaaaaaaaaaagtgtattctgcagccgctagatgaaatgttctgtaaatatcagttaggtatatttcatccaaagtgcagcttaaatccaatatttctttgtttattttcgctctatatcatttggccatgctgagaacaaagtgttgaagtctcctgtgttactgtattgtagtctatctctccctttagattcaattacatttgttttatgtatctatgtgctctggtgttgggtcatatatatttgcaattggtgtgttctctttctgaattgatcctttttatcattgtatgatgaccttctttgtatctttttagaattttgattaaaatctcttttatctgtataagtatagttactcctgctcacgtttggtttctgtttacatggaatatcttttttcatctcttcacttctagtctatctgtattattacaggtgaagtaagtttattgtgaacagcatatagttgggtccttttttttttttttttttaacctagttacccagtctatatccttttttttttttttttttttttttgagacagagtctcgctctgctgcccaggctggagtgcagtggcgccatcttggctcactgcaacctctgcctcccgggttcaagtcagtctatatcttttaagtggagaatttaatccatttacattcaaggttattatttataggtgaagacttactcctgttattttgttaattgttttattgtagttttgtatgttctttgttcttttttcctctcttattgtttagtattgtggtttgatgattttctgtagtataaagtttgattattttctgtttctcctttgtgtatctgctgtacaagttagttttatgcttttgcatgttttcgtgatgattgtcgttttgctttagatgtaggactcccttgagcattttttggtaaggctggtgagtggtagtaaattctcttagtttttctttgtctgggaaagatgtttttatctccatttctgaaagatagcttttctgggtgtagtcttgagtggagttttttccccccctttaacactttgaatatgtcatcccattctctcctggcctgttagatttctcttaagaaatgtgttgttaatctaacggggattcctttagagtgactttatactttttattgctgttttaagaattctcgctgtctttgacttcttttttttgtgtgggctgaattgcatgctgtttttctttctttttttattacactttaagttctgtgatacatgtgcagaacatgcaagtttgttacatagatatgcatgtgccatggtggtttgctgcacccattgacctgttatctatattaggtatttctcctaacgctatccctcccctagctccccatcccccaacagcccccagtgtgtgatgttcccctccctgtgtccatgtgttctcattgttcaactcccacttatgagtgagaacatgcagtgtttggttttctgttcctctgttagtttgctgagaatgatggtttcaagcttcatccatatccctgcaaaaaacatgaacgcatccttttttatggctgcatagtattccatggtgtatatgtgccacattttctttatccagtctatcatttatgggcatttgggttggatccaagtctttgctattgtgaatagtgcagcaataaacatacatgtacatgtgtctttatagtagaatgatttataatcctttgggtatatacccagtaatgagattgctgggtcaaatggcatttctggttctagatccttgaggaatcaccacacctgtcttccacaatggttgaaataatttacactcctaccaacagtgtaaaagcatacgtatttctccatatcctctccagcatctgttgtttcctggctttttaatgatactattctaactggcgtgggatggtatctcattgtggttttgatttgcatttctctaatgaccagtgatgatgagctttttttcatatgtttgatggccacataaatgtcttcttttgagaagtctttgttcatatcctttgcccactttttgatggggttgtttgttttttcttgtaaatttgtttgagttccttgtaaattctggatataagccctttgtcagatggatagattgcaaaaattttctcccattctgaaggttgtcttttcactctgatgacagttgttttatttttttgctgcgcagaagctctttagtttaattagatcctatttttcaattttggtttttgttgccattgcttttggtgttttagtcatgaagcctttgcccatgcctatgtcctgaatagtattgcctaggttttcttctagggtttttatggttttaggctttatatttaagtctttaaccatcttgagttaatttttgtataaggtgtaaggaaggggtccagtttcagttttctgcatatggctagccagttttcccaacaccacttattaaatagggaatcctttcctcattgtttgtttttgttaggtttgtcaaagatcagatgattgtagatatgcggcattatttctgaggcctctgttctgttccattggtctatatgtctgttttggtaccagtatcatgctgttttggttactgtagccttgtagtatagtttgaagtcaggtagcatgatgcctccagctttgtactttttgcttaggattgtcttggttatatgggcttgaggagtcacatacggctgtgtttctgtaaactgaaccaataggcctcagtggcaacttgggacaaaggggatgaagcaccttgtagtggtgagtctagaccctgggatggtggggcttagcagcatcccagacttgtgagagcaggtacagtggcagcaagtaccccagaatggtggggcacagctgttggggccctgggggagcatgaagcagcacaacaatgactctactccctgggaagaggggtatctcagtagttcagactctagggggctagtccaactccagggaagcagaatactggagttgttttgcctgtaaatgtggggtgtctcagctcagccactgctgtttcccttggatgtagggtgtcatgtcagttcagccttagatgtgcagcttcttagcttgaagtctgtaaagacaaagttcccaaggggcaatgagccacttcagccagtcctggaaggcatgactagtctggatgacccgggcaccatttccttgggatatagggcactgtttcggcttaggtgctgcagggtatgaccacttcagacagtcaaggcaccatttcctgggaggcaggttgttgcttcaacttagactttggtgaggtatgactgctttgggcagccaaggaactgtttccctgggatgtcaggcatagcttcagctctgaaacctgtgtcagggcacagtagtaactggaagggatgagaagcagtgtgcaacttcagtattggtcctgtgggacaggtgcagcagcaagtgggaggggcttttggagcagctctgccggggcactgtttacttgggaggcaatgcacagccttggcttaggcccctcagggcagggtgcagcagcaactgggagaagtatatgaagcaacttcaccaaggcaccatttccccaggaaaggttgtgcaacttgagctcaggccccaaggggcagggcgcagcaacaactggagaggtagatggagctgttctgctgaagaactgttttcctagcagggagcgtgcagctgcaggtcagaccctgtcttagtccatttgtgttgcaatgaaggaatattgaggctgggtagtttataaagaagattggtttatttagctcatggttctgcagcctgtacaagaaacatggcaggtgtgcagatcacatggcaagagaggaagcaagagagatggggaaagtgccaggctctttttaacaaccagctctcagggaaattctcacaggaattaatagagcaagaattcacttattaccatgaggagagcaccaagccattcatgagggatccacccccatgaccttagcacctcctgtttggcctggattccaacattgtggatcaaatttcaacattaggcttggagggtcaaatatccaaactacagctctatcctaaggctagagctcagtgactgggaagggtagataaaggaattccactaaggcaccattttcccagcaggcagtgtacagcctcagcttagggccctgaaggcagggcacagccacgactgggagatgtatatggagctgttctgccaaagcaaggtttccctaggagggattgcacagcttcagctttagctccaggcaagggggcagatggaggagcaggtagagtggttccactgctgcttggtctccagggaagggtgtaacagctgctcacagctcaacttggggatttcaggccacagaatgggggtggttctgtggcagcttaacttcagggatgaagaggcacccatagctccatgcccctggagcaagacacactccaacatagttccagttccaaaatggcataacacagtagccatgcaggccactgggggtgggacactgtgtccactcctctgctaagagcacagctgtgtggactccaggcagctccctcagctcaacttaatgcctgtgaggactgtagagacccactggcaaggtctgtagatgtccaaagtgtggatgatgttggctagggttctcttgctcacctttctgacaatgggagaaattcctcctggctcccagctgatcctgggtgggggatgggatgtaggagtccttgtgtttccttccgttctctatgtgggtatcctaagtttccgtgttcactcaggtttctattacttcttttaggaactccgccactctgctttagccttttttattaaaatgtagttatttattcattgttttgtctgtctttgtggtgaggacatgtgctaggggcttctagtcagccatctttctgtcactcagctatactttctctttaaacacttatgtagtgtttgaatttaaaaatgtatattgacaagccaacatgccgtgttgtcactgtgtggcggtggaggttatcccctgattatctctattctactttcagtctctataaatttgacaattttaggtcccttgtataaatgaaattacataatatttgttcttttccttaaagataaattcttgcatctgttcttggaatcacatgaaaaaataagttacccatataccttggcctccagccacctctggtttggaagtacagacaattccccatataaacaatggttgacttataagtttgcaactttataatagtgtgaaagcaatactcagtagaaaacagactctgaatcttgagttttgcttaaaaatcatttataataacgttattataaaatagctttgtgttagatgattttgcccaactgtaggttaatggatgtcttctaagcatatttaaagtagttgaggctaagctatgatgtttggtaggtgaggtatgttaaatacactttcaatttaatggtattttcaacttacgatgagtttttagagacaaaacccctttgaaaattgaggagcatccatattggaatcttgtctaagaataccctgctatgtgtttttcatgcattaccgcccactgtcctccacctgttgctcctgcaaacatatattgtcaattcccttctttggaatgttatgctctatgcctggcattcaaccacctcattttcctcagcgcgacttgttattcagcccagcacaaggaccactgatgtgcacatatggaattgttctcatttctctgtgtcatctagtataatggcactcatatagcacatctatgctgccttacaaagataattttagtttaggtttaatcttattatttggttgtaatctccttgtagaacaggatccagtctttatgctatgtgatggccttgcttaaaattttggcatgagatgcaataatgttttaaaaagttaaacaatcgtcacattaatttgatgcctactctctctctcctctccccagtcacccttcatactcatttcagatgcagtaaatttgacacaaacatatataggttttcttagttgcgttttctggaaaaaattttaatagtaaaatagaaatgattttacctaatttatctttataataccatagatagatagagagtgagagagacagagagattcaaagatatttttataacccatgcattccaggagactataattagttagaaggacacaatttatatatgtaaaactaatgccaagatcagaagactttctgaaaatctatacttgtaaaatgctttatgatttataaagaggaggtagaagtaataattcttattttactgtttttttttcccagatacttaattacgagaaattacaagttaagcgtcaaattttcttcacaggaacagatctaaaacaggccaattcggagacatttgcagaaaaacagagtgattagataatctttgttagcataaatggaaaaagaacattgagtaaatatcattaaccaaatgactgagtgggtagttagttttgtagctagttttctagaatatgtcctaatacaattaaagtttattttaaaaactttaaagccttataatacaaatggaaaaatcaaggctcaaggtcacctagccagtcaggagagtgaattttgacttccagctctaagtgtgtctcagcagcctccatgctcaggcatgagttacggatgtggaccctgaatgctgtggtggtttaggaaggagggagatcagtgaaggtggcgagatcagaaggttgactcttcactgagtctcaatgtacaaatggcatttggataaacaacaagaaaattgacactcaggcacattaaggcagtgattctcaaagtgggtttgtttcagaatcacctgaaccacttatcagcaccagtctctccacaaattctaatccagtggtctgagaagaggctctgggcacgagggatttgattaatctctttaggtgattatgaaggctagtggttaggagcctggttatctctcatcttgtatagtaagtgccaataccaaggacataactaacagccgatctgagggcttaagtttaagagaaggaggaatagagaagtttctaagatattcagagacaccctgtgcatcctggcccccgtgcctggcagcatgggatacatacaggaggcttatgccacagggtgaaatataggctagtaagtttattccttattgcctagactttctttataaaaaccgtgatgattctctctgctattgagtactttaaagaaacaagcacacctgccatattccagatgcatggccttggtcagcttcatcaagcctcagcttctcatgtaagtaaaaggaagagagtgatatctaactcaaatgaaaattgtgaggatcaaaagtaataatgtgtgaaaaatgcctaggacagagcattattcaaaattattacccttcttccctcctaccaccatggtacagtttttagtttttataacatctataaataaaaacaaactatcctgtctcactattccatcagtcaacgattttcagccaaaggccacgagaacctgtgtgtagggcttatgactcattgcggggaggggaaacacacgccatggggaatcttgaggcaacttagtaagggagtattagaaacagtctgtggaaggatttgggttttggttgggtaactggggatttgctatgtattggatgctgtcagaaagcagggacaactttatgattaggtaaagaaatgtcagtcactaattttaaccagaaaagggggtatttggtattttatgggtggcccaatgaccttgtttttgtctgtgcttagacaaaattttgcaatagacttgttttgtaccactttgtcatggccttagagtgatcttacttgagctgctctctttttttaatttctcacatctgaaataaaagaaaatgtaggagcaaagctgatatatatttgaattgtgaaaggtgaagaagtgttgagacactgaatatttgttgagcagtttctgtatcctacgtcaagataaactttgatccttctgagaatgtcacaagtatcttatctacataaggtgggatttgaagccagatctagctgacttttaaccactgaaactcccagtctggtgtgctgtcaccttattgagctgtgctttgggcaccattagagcatgtgaatgaattcctgcctgtctgttgaaatggcctggctttgactttacttataatagaaaacatactttgatccagaatcacggattggcagtttttttttctatgaagaatcagatagtaaatatttgtggttctgtgggccataaagtttgtagtaggactacccaactggcaatgtagtgaaagagtggccatagatcatatgtaaacacataggtgggccaggcatggtggctcacacctgtaatcccagcactttgggaggccgaggcgggtggatcacgaggtcaggagatcaagaccatcctggctaacacggtgaaaccccatttctactaaaaatacaaaaaattagccgggcgtggtggcgggcgcctgtagtcccacctactcgggaggctgaggcaggagaatggtgtgaacccaagaggcggagcttgcagtgagctgagatcgtgccactgcactccagcctgggcaacacagcgagactccgactcaaaaaacaaaacaaaacaaataggtgtagttatgctccagtaaaactttatttataaaatcaggtggcaggtgggattgggccctttggctatagtttgcaaactttttatctagatgataagtaaacaagatcccaaatgaacttggatttttaaaaatgtattgaacacatttaaagttgctttgaataagtaaatatgtgtaataaatataaatatgagcaaatataaatgttgtgaggttttgttttttcaggggtttatttatttacttatttttaaaaatgcttatttccaaacacgacagagaatcagcatggggcctcatgccatttgctttttccatctgtatagtgacaactggatcttgtgaggccaaagtggttattgaatagcttttctgtccttcagtctatcaggcaccatacttggcccttccttttattattccttaaatgataactcttgtttgctaaactgaagcttggagagggtgaacaatttgtcctcagtcatccagatattgtggtagagctggtgctgaaactcacactttttccactataccttatccctcaatttttacaaattattcaattgatgttctgggccaaaagaagatcttggattatcttctgaatcatcgaactaaaatgatgtgatcagattgaatttagtgcagagtgtattttgttacattttacttttttgaaaaattaggattagaggctaaatgtggaaatcacaattcagtaccatagtgttgaaggtcattgcatattgagcctcagcatgctaatttcctttttatagattcttctttcggcaaagcatagcataataaccccacctgaaaaccaagattatctaccgccaccatgtcagattgtctccactgtagcttgatggtagaaagatgaggtaaggcatatcatgagagagattcactgtgaacctcctctaccacatgctatgccactgatctcaggcaaaaggaattttcaactagaatctcctattctgtaaatgtggaaaacaaatacaaacatatataggtaactggtacggtacattgttatgattttatgtttatagtcaaataacatacaaatgatatttttcatgcaaattaattaaaacaacctcctagtcatacaatttatacattcatttataccatatacccagctcctacatatttctatggataaatatggaagatatcccaacattatcacaagtatattatatatgtaagatgaaatttgaagccagatcttcaaatcttcaaatctttaatatcgccactaaacagtattctcttttagaagagtccaacctatatttttctcctactaccagcctagtaaactcacctgccccaggaaattgtgtctgattaacctgagcgtggatgctttattcttccagtctagacaggatttgcatccttagcttatgctgaaaagtgatcatataccccattgtacatggaactatgtcattgtggtaggacattattatagtgaacatactcctagtagttccatttgcaaacttggggacaatacatcttatgattcgttgtgatttggcaaagaaaagtcttccaagtgcttcaaatggaatatagaagaaaatgtatgattatttttcctaagtctctttctttctccagtacctcattgtacattcatttacgaaaatagtaataactattaataataggaaatataaatcataatagaaaaatggtcatccatgtatttctgactttaatgtttgagtgggttgttgggagaggaatggagggagacttgcttcatgacccagggaaaggcctttgagaagcaccactagatctcagctcaattctgtcttctgttctatttcacttcctatgcagacttgccagatttagaaaatgaaaacatgggactcccagtaaaatttgaatttcagattaatggtaaatatttttttagtacaactatgttccaaatattgcatggggtatttatacaaaataatcatttgttgtttgcctgaatttcaaatttaactggttatcctgcattttatctgtcaaccctacacacaaatccttaaggctctgagttttcatgtggagagttttctcattcagtggaattgtacttaattttctgcacaaccacacataagcctttagaaaacttgcttaacctgcagctaataattcatatcgtagagttgtcatgaggattaaatggagaaaatgcaaataaatctaggttcaggttaggattcagcagctgctcgaaaatcattaggtaaatgtttattttcttttttcctctcaaacttatttcaatgctttcctaacctttccaggaagaataaggagctcctcccttttccctttcaacaggctgtacttctttctgttgcagcaacctacatggtttaaggcttgttttgtaataatgacatagacataccaatttctttcttgtttggtttgtgttttgtcagacataactttttaagatttttttctttcaaaactttccaagtcatcttatttaaaacatgtctaaataatggccttctaagtaatttttagacataaagtctgattttaaaaatctcatttttaactgtagagtttggtacacaaattatatattgataaaatgtacatctatttctgccttttagttttttgtttactatttgtcaatattgttttaggttttatttttctctcctttcttcttcccttttccctccttttctcccttcctcccttctgtctttttttccttccttcctttcctccttccttcatttcttttttaatcaagtaaacttttttcttcttcacttcgtttttttacctttactagttcggaagatatacactctatttttactcttttattgctgtcaaatacaaattttcacattagtttaagaaaacggaagttaaataatcttactttcttctcaaacaatacacatatctcggaacacatagacagaaagtccccccaggagtggggagggatagcactgggagatatacctaatgctagatgacgagttagtgggtgcagcacaccagcatggcacatgtatacatatgtaactaacctgcacaatgtgcacatgtaccctaaaacttaaagtataataaaaaataaataaataaataaataaaaataaaaaaataaaaaaataaaaaattaaaacccagttcaattcaaaaaaaaaaataaataaaataaaaattaaaaaaaaaagtccccccaaagtcatataatattgttgcctagtattttagtattttctagtattttaaactgataaatcagatattgttgattcatataaaatatgtttacccacatatttacagtgttttgaggtaacatttcttcctttattatttgattttccttcctgtgtaactttcattgtttttcaaatgtatcctccatatgtacctttagtaagggtaaaccggtagtattatctttcaattttcatttgtataaaaggtctttattttgctcacattcttcaaagaattttactgtgtacacattgtaggttgattattattttcactcatttttttaaagatagtagtcgactgtcttcctgcttccactgccacttttaagaagctgtttgtctgtgtagaggattttttttagtggtctgtcttctctaattggctgcctttaatatcagcttctttttccttagtattctgtggtttcactatgctgtgtctaggtatgatttctttttattcaccctgcttaagaacttttggccttactgaatctgatgattgatgtttttcatcaattctggaaatttctcagctattatctctcaaaaaaactgccttcacttggctctctttatcttctactctggaacaaatttaacctccatgtgacttcctttttgtaattttcatttttcttacaggaacatagcatagttgctaagaaacagaattgaatccaaactctgggttgaaatgatgcctttaactcttagttggtatataaattcaagaaagtttcttaagctttctgtgcctcagttccctcagttctaaaatggagggagcaatagtatctacttcataggattgttgtaaagattgcaagatgaaatatgtgtaaagtgctaagaagcttgcacagtgtatttgctcttattttctttttgtgttgcattctgagcaatttttttcatctctattatatggttcaccaatttttattttctctttctggttctattagtatatttttcactttcaaaaatacaactttcgaaaagtaatttttggttatttttcaaaatgcctatacattttaaaaaatcacttacttttaatatattacattattttatatatgtacgtttgcattggcatttgctattgctagttaccttctgccagatacccagaaaccctgggccatttcaaactaaattttcaacatgggattttttgagacccactgatagtatagattcctttgtccaaactctgacaaagctgtcttatggttatgaatttttgtggggagaatatattttttcttttccacccaaagctaaaactaggacaagtaagtagactgtgtctttctctggagttgatttttttttttccaagtgttttccttttcttaggttgtagctttgtgtgtgtgttagtctgttctcatgctgctatgaagaaacacctgagactggttaatttataaaggaaagaagtttaattaactcacagttccgcatggctggggaggcctcaggagacttacaatcgtggcagaaggcacctcttcacagggtggcaggagagagaatgagacccagtaggggaaatgccagatgcttataaaaccatcagatcttgtgagaactcactcactatcatgggaacagcatgggggaaaccacccccatgattcaattacctcccactgagtccctcccatgacacatggggattgtagggattacagttcaagatgagatttgaatggggacacagctaaatcatatcagtgtggtcgagtccaatctgactttacaccttatatggggcccaggctttgtccctgttgtgctgtgtatatgggtctgttaacaggaaagatctaagtctccagcattgatgaataacttcagagctgcctctgcttttatactcatttactcgcttacctttcttgatttatgtattatgaaattattcttttctactaagactttctacttatttttaactcatccatgagtttttaaaagatgtttaaaaaatgatttttcgcattttagggtactttccactgtgaaccgaggtcaacactaactgactctgcctcaaattccacatcagagttattgctatgtgctcagtgacaagcccaatacttagtatgcaatagccactctaataatacttattaaatgaataaatatatgtatagttgaatgtaaccctggtattatttagatatttctctaaaaacccaaggaaagcttactttgatattgaagacaattaaaatatgttaaatttaaaacattctattaaagctctgaacagaatgcaggcctcaatctgcaactttaggaatttttactgacttcagatgggcagtccacaattcatgtgtttgctcttttgaagaatattctgccatagaaaataatactctaaatgttggtttgatcaccagactaaatggtaaaacctatatcactgataaattatttacatcacagcataaatacatctagagaatgtattctccatttataatattatttctataacctcagtagagaaaggaaattctggggactgcgatatatcagttggattctggcttatgctaattgtctgaaggaaagtacatctgcaaatctagggtttttacattggaaattgcttgctggcctcttctcaatatgttgagaaaacatattgagggcaagaaataaagtgagttctctgacttggtaaacctgatttgaagtgacaatgagatgggggtctgagggaaaagataccaaagcctgaggctgaaaattcaaatttgcaattaagaaaatggttttcattctgggatgcctattgaaaatatttggagagcaataaaaaatatagacagctatacggtattcccataagtgagaaccacgtgtcactattttgcaaaagcttcccaggcaattctatagggcagccacagttgatgcatcaatccggatgccatgagaaaactgaaaccactccaggtatttgaaacaggaaggggtctaatgtagggaatcagaggctgcgacagcactgaacgggctgagagaggaaagaccagaaaaagctgctgctcctgttccagaaatcaggaaatgcgagaatctttggaaactaccactaaagagggcagctgctttgctccaatgagggtggtttagaagaagcctgagacccactggcgaactacaggtcttcttcctccagaagctctcgggcctgcatggtgtttacacacacacaaaaataatggcttctcttcagttctacctgcaggtgtcacagtaacagctcttattattcatggcgtctaacgctaacctttgtggccagggactctacggatgcatagaagggacaagatggtgcaagtctgtcaatagattgagaaatacttggagagcatttaaaaaccagattgagaatcactggtttgggatagatgaacttccaaaattcagagcactgttgtactctgttgttttagtgaactttaaacagcaaaatatttgtaaaagcatttatccagattcaagaagaaggcttgaggtttaacactcccagtgaagagcttttttccaccctgcagatttctgtgagtaccaggaggaagtgggaatatcttccctgaccccccaccatagttccttccgctcatctggaagcgttaaagaattcacaaatcaatggcaaaaataacttttaagaggattctagccaaacaaaggccacacttggcagaggctcagctgaacctagtactcaaatggagaggtttcatgatgggtgtcatgaaaatgtgactatacaaaaggaaaatgtgttgataccaaagttcacatcctttgttctccatatcattgcctctctatatgcaagtgacagcgtgaattttgtaggacgctttttcacatacattttcttttcatataaatcgtaatgattgaccagagacccttgcaaatagcctgggcatggacaaaggaaaataagaactgccccttcttgagatggtggctttccctcttctctctcctgagagcaaccacccacccagctggtacgttttcttctcttccacgcccactgcctcttcctctttccctttccctccagagcttccctgaccctcttctcctcccctttacctccttcctgttaaaaagtgtctggtggtggagccagacagaactgtagtcagagccttgtgggatttctcaggggcagggtaacctcaggtcctgaacctcccagaacgtctacataataatagaatgtttacttcttgccaagacaattctaagtatttttaaatttagtgctgagaatggtaatttgcacatagtttgtaccttacaagtagataccgttattaccattatccccattttatcaatgtaggcttagagaggtcaaacaacttgctcaatttcagatagctaatattcaaatcaagtggtatatatcccactgtactctgagcttccctgattgtaacatttttatgactctagttgtggcattataatttatgaaggtcattgatgaactacagtgtccaaatatcctggccctctgaggaaggtactgaaaaccatactatctttatcactctcatcaacaataagcatttatcaagtgtacactctatgccaagtcttatgatgtgttttataagtacaaaaactttatgaaacgggtaacattataatcaccccaatttacagataaggaaaataaattatggagacattaagtaaattgcccaagatggcccagctagtaaataataaaggcaagattttagagccaacgcttatagtcatatactacactagaaactttagttacttgcctgaacaagaaaggatgacaggacacagaggaagatggaggttgggagcaaagagagaaaataggaatattcagttgacaaggaaataccagctagagaggaaaaacaattacattgcaatgctacgacagggtttttctcgggaggcagatttctgcacaatgtgataaaggactttccagcaactatttttaacaacaccacagactgcctctcaaaacagagtgtgaatattttgaccttggaaattttcagatgctaaagaaatttcctaaattgaagagaacattggagtgtatatgacctctaagctagtatgtgacctctcagatgctttggatatagaagttagctcattgaaaccgtcacagcagcctgacagatgtaatgataaaattttataagtggccatactgaagcatgatgaggacatgtggttgaatccaggtaaatgactaatctagtcattgagctcagctcagaatctggtcttgtgagcatttctagtcttgccagcatttctttcatactgcctcttgacaaattgctggcaaaaaaaaaaaaaaaaaaaaaaaaacgcaaaagctggccaaaagcagcctgcatttgaattaagcagagagttgttcttgaatttattttttgtactaggaagacacatttcttcctctatgctttagaagaagtactggaatggtggtgtcccaataaggtgccatgttcagagagtggtgaaagctaaagctgaccttataagacctgggaaaaatgagtacgcatcctgtctgagagcaataatatcatgctgtacatacagtaaagtcaggggtttcctctgggaagaggcacataactccaagaaactcaagagggaaatcagggtgacatttataggatactgacctcgtacagacagggtcctttcatgcataactattagcttcattatgtaagagccacctagagtgtagaagagcaataaggtatcaaagctcaaatgctttccttaaagcacccatttaaataagtcataggggctaccatttttacaacatttcatagattacaatgtgtgttcaggtttgacatctcactcaagccttctcaacattttacattcaaagcgaactgcgtatgtaaaggcttatgaaggttttttcatatgtaatatctcatttatgtgctaaatgactctgaaatggaggtattattaaactatatttttaattaagccgagtaaaattatatatatatccacaagctatagcacctattttgagtgcatctaagactgttttgtttctgtcattaggcaactaagaaatataggataattttgcatggtgaaggtatattagaaaagcatatgaaaatagtcttattattattgcagaaaaatgagagatcatcgtacacagaaagaaataaaaattattcatgatccacctgcccaaagcagcaatgcttaaatatttggtacagttacttccaataaataaatatatttggattatttggtaaagatcatagtgtgcatacagggttgtcttctttatcacagaaattttctattttatttaatattcttagtaaacatcattttaatggcatagtagattatgtgagtggagcataatttacttaacttattgttaacaaatctcttgcatatagtatatgtattttgtacctattgctggtatccctcttcataattcctagaagagggattaccaccccaaagagcatgattgctattagtgatcttgccacatatggccaaagtgacttttagaaagtagtaccaagctcagctctaatgagcaacatcaccttgccttgccagcattgaagattgtcacaatattttaattcaccaattttatagattaaaagatattgttgttttaattttcactttgcatggtcactttacgttgtccacacaacttattaaagacatggataaaagaaatccctgtaaaaggcagcttaactggatgtttccctccaatggcaaagtgactctcaatgggccaaggtaagtactcaagggtgagggaggcttgggtattgcatacaagagctgggatcacagcagcagggactaaaggatgtctgttgtttgtcaacttgcctctctttcttccactttgagtatttttcattgcatgaacagttgccaaatgcctgccgggttccctgcacgcccgcagtaagcattctctcacagcatggattctctgttcatgaagctctctctgcaaagagtaaaacaagaatgggttgcaagtagagaaactgagagtacgtgatgacctggaggatgccccacaggcaacatttccttttgaggcattgagtttagtcatctcactcttcataatagaaaatggaagtagaactatcttttgttattgtttggattttttttcttttgggtattttttttctgcccttactcttttgttcttagattactaatttaaaaatgttattatggaaaatttgaaatctgtagcacagtagagagcaataaaccccatgtacccattactcagctacatgcaactacatagactccatgcaaggctgccctgagtgatttactctgtctcccctccaaccctgcagctacataattttgaagaaaatcccagaaatcccagatgtaatatcatttatccataaatattttggtatatatctctacaagatggtttttgaaaaacctatcatcttgcccaaaaattctttaaaattgccaaatagccaactactgttcagattttcctgattgcctcatatttttacagttgatttcttgaattgggttccacacaagatctgtatcttgcatttgttgatttgttgttgtactcactttaataagtataaataaatggtacttttagtgggaaatggtatttaaataaatgcccacagtctgagtgccagggacgcttattgcaactctgatggttattatttctggacagagctagaaagtaataggagggtatttttattttacacacaatattttgattgctatttacttatttatataacagtacaacattttttctctcctgagtatcagagttctgtatcttcttagttaaatactcagtgtgattactgtaactgatagtgttttaggttcttttgggtgagaatagggatgacttaccatgtgacctggctttcaaaatcttcctttatactctgcaacatcaatgaatcaaaaagaaaataaagcaagtggagagactgatgttacttaaattaaaatcacagaatcacagagctacgggggtctactgaaatcattctagttgatctcttcattttgtagagagatacactaaggctggaaaggtgacttgctcaaggtgatctaaatcaatggttctcaaaatttaatatgaccaggaatcatctggaggccttcttaaaacccaattgctgagcctcaccccagagactctgtttcaacaggtctgggtggggccctggtgatgctgatgctgccagtgcactgactgatttagtggcactaatccatctacgtgttgcctaaataacagctaacgggagcatcttcttggctacagccctgctaaagtagagatgaactcactttgagctacatgggagtaagtgtggaaaaatcaagtcatggggcaggagcaggtgaattgtgggttgaccaggctgttttctacctgatgtgacagatagagaagactcagctgcctcactactactgggggttgtcaatttttcatcataggttcattcctttgagataactcctccttttaaaaatcaaatccttaagaaagattctccctctccagacgaatttaagccactgatctcaatgtaagcctgttgcaaacactgctaggtatctttatgtgaatctcctaattggaggcaacctttctctgaaatcccacagcctttgcctgtatccctctcttgtccctgagtacttcctactgcatctgtttagacattcttgaacaggcagtgatctagatacctaggttatgccagaggtgcaagttttaaactccagacaaaagagtacactgattcgctcgagtaacggcttccaggtttaatttgttgcagccagagtgctggaggtttagaaaactcagtcctgtctgtatggtaaaaatagatgacagatgccctcaaagtcaggggagataccttcatttcataacaattcaggaatctaagtccaggaagcacctttaggattttaaagttgctagaagctttgtaactctccctgggtatttgagtttctcatctcccgttacttgattaacagggaaatatgaaaatccaaaaggcagatcccagggagacagaatctgctctagagagaagtcccaagggggagagtgggtgggggcatccctgggatactgagaaactggctggcctttggtacacagcaagagagaagcaatcaaattcccacctgtgatccccttgataacagtgactattcacctccatatctcctgggctggcctgaatcggtggtatatggtatagggaggaggacccaagaattaagggacccagggtgtgtatgtctgagggctgggtgggtcaagtaataaagaggatgaaagaaacaaagacaaggagggtaataaagtgatcagtgttgcctactgaatattgcttctgtttggactaatgatgctagactgatatttactcctcacactacctgcccctctgtttctccaggtaatacctcaggtcaagaacaccaggtcatgaatcaaaggccttttgtttttaagcacacctgatacctgaaagatgagaaacagtggctgcccttctggtggcaatgcatgagcagatggggacaataattttaaaataagatacataagatgcctctgaagaacattgtgtttagttagctactgccagcaaaatgccacctaataagtttatcccaagactcaatagcacaaaagagcaatcatttatccttatggacctgtgtattggccgagggtcagccagttggtcaaggctgagtttggtggctctgcagagctcagctgggcctgcttccatgtctggtgtctgctgactctagctgggctgtcctggatgatttcacttgcttcatgtgtcttcatcttcctcttaaaaccaggggctagcccagcatgtttttctcatggtaatgatagaggcataggggaatgtacagaaacaccatctcttaatgccagagccacaagctagcacattgtgacttccactttggtctatgggccaaagcaagtcacctggccaaacacagggtcaagagggccagaagtacattatgctcctacagtggaagaaactgcaaagttatatgtcaggaaatgttcatataggcagtgcatgaagaattgggcaaatagtgtccctaacacaaatatataccatgtgttatcaattaagtgaaatacatgtaagaaaatttagataaaataccattagattctgatgctaattttttattgttattttttattttcttagagatctcattatgttacccaggctggtctcaaactcctgggctcaagcaatccttctaccttggcctctcaaagtgctgcagttacagatgtgagccactgtgcctggcctgatgttaatttataatgctttcctatgaataaactgttaaaacactttagtcaatgtatccaaatctgattggtgttattcagaattattttgcttctctgtgtatagattcttctaattcttttctgtgttcctcatgcttccaaagctatacttgtctgccttgaatggtattactcaattaaaattctcagactctatatctgcaattgttctgccactttaaagatactatgtctttaaagttgctgtgaaaaagcctccagttcattctgcagaatacccatcagttatatatttacgtgactgagacgttatttctctcctgtgtaattttagttgccacatattgagaaccttctaatggaagaatctacactaaatcctttatatctgtttgtcatctcctttaaaccttacaacaatactgcagtattgattgagcaatccccattatgtaaacaaaactgaactcaggaagattaaatacattgcttaaggatgaaatggtaataagatcagaattcacatagtttggtttggctatgaagccaatggtttttctattatttttcacttatctttttttttttcatcatgtcccgtcctcttacccatatacttgagtttttagatttttctctgagatgtagtaaagaatgtttgggtggcaagtgttagtgccatctctttttattctcttgagagcctgtgagtgtggaaacacgtgttattattatcctctgtaaagctgcagggactagtactttgaagtgaagagatttacagggactgggatgcagactctgtatatttttctcttctcttatttcaattactatgtttaatcatggtaatcgaaggtgtgagagtctataattttgctactggaactagccagtgaacttggacctaaagaactatatttctttatacagttctggaagagtttgggaataataatagcatgggtgttcttcacattgcaataacatagaaataagatggcagaggatagttactatgcagccatacggcccactaggttctagagtattgggtttataaaaggatttttgaataacttgggactcttgttactagtggtcgtttacctaacttcttggacaatttaagttaaagaataacccaaaaagaagtcaaactaatttcaatttatctaaataaccttgaagaaagccaattgaaatttcttcccttccattgtcctcactttccaatgaatatgttttactgtaaagatatggtccaaaaacatgtttatttttcttcatgttgttttcatatgccattcgtgtagcaagcactgttacgccatggcagttactttgatgtgtggaaacaggatgtaagctattatgttctttgcaatggcttcccattcatctgtgtctcaagcattaggagtttcaaaaaaccctatgagtcctgatttgggttagttttatcttcatgaaagttagaaaatagcatttcttttctggatattatttgtctttatcctgaattctgcaaaacatgttataacaagaattgttggctattaatatatgttactggttttaaagttttttatttattattaacaagaattgttggctattgatatatgttagtggttttaaagttttttatttattatttatcttatttgattgtgttttagagacagagtctcactctgttgcccaggctggagtgcagtggcatgatcacagcgcactgcagccttgaactccttaggctcaagcacttcacctgcctcagcctcctgagtatctgggactataggtgtgagccaccaaacgtgtctaattcttgtttacaatttatttctgtagagaaaggatcttactatgttgcccaggccagtctggaactcctggccttgggcaatcctcccacctcggcctcccaaagtgctggggaccactgtgcccagtctattttctcctttaaatagtgttttttttcctcctttaaaaaaaaccaaacctttagatgaggaggaaaaggaaaggaaacatgatgtttatggagtgattgttcagcatccagtcttacgctgggtgctttacttagtttatcgcaatgttagttccatattacagatgaagaaacaatggcattttgataatgcaaactgcatagatctctaatttagcttttttggttgtcaggctttgatgggttcaaaatttgataggaaattttgtttgtttcctttcatattaaaacactgttcttctaccagatccctagaagactgtggccagcaggtattagcgtcaggaggtgagtattagtttaaatattgacctctgttatgttaataacatggtggcagcatttgtaggccgccaatgcacacattccactacctaaaacaagagaatttgcctttgacacccttcctgaaacgagtcctgaaattcattctgattaaaccaccataagccttatgtgcagcccaaactagtaattgtgattaggggtgaggcgggggtgaaatgcactactccatttaacatagcccaagtcaagaatcccatccttggagttgagacagagtcaacttttcagaatgacgtggatcttgaaatggaagtggcaggctttgaggaaggcagacagacatgggagtctgggagccaggcaaacccagctgtccacaacatcatttattctttcaaagacgcatctagagagcacgcttgctaagaacggtgggagaaactgacaagaattagacatagttcctgtccaggctgcctataatttattatggagagggaggagctaaattaataactataatcaaaacctgaaatgctgtgacataaaagtggcaactacctattagagtgagaaggagaattactttttggtacaaataatggaaaattttcaaagggggtgaaagatttcttagagctagaaggggtacttaggaattttttttaactctgtgtgatatgatgctgagagaaactgggacacagggagagtaagacttgttagggaataagatagacataaagatgaggagaggtaatgcccagggttttagtagaaaatatagggctccaaagaacaaaaattacccaatttcactgttttacttgggatcagtttttccaataagtgtggtcaaaaaatcagaagtgtgtggacaaaagtataatttcttgttggctgaaaaatggtaacttctatattctttgttgagttagctgtttgctcagggaaccagtgtattgcaaagtatattttctgtcagcttatctgattccttcttaagaatttctatctctgaataaagtttcaactgtatttgtttacttatatctcttttgctttaaaagaagacacaaaatacctgagctttcagctaagttttcaactcaaattctttgtttctaggtattaaggggagggttttcctttacagattggagatggataaagtgcctgccaaggggctgagggtgttgtgagcatttaaaagggctcagctctatgtaagcttcccaggaagataggtgagaggtcctctatctaagagcctcaaatttacaggatggatatgatcaaaagagaatcaagccatgtccaaaccatgggtgcatctgaggacagataggccttgctaattatgtgtgtcttccactaaggtgaaaatttgcttcatttcctaaatacataatagacactatgagggaatgtggttcagaaaatatgcatgagggcttgcgagaagaagaatgaaaagctgttttcaaagctacaaaaggaaagctcagtttctttcttctacatttaaagtaggtggcctaaaactgaaccaataaaagataattgcaaatatatttcttattgaaatctccctttcccccaaaggttaagaggattgaggacatttctgaaaaaggaggagtagatagtcaaaatctaggtggaggttgtgtatttgctgattgatgcatttcagaccataatggagaagaccactttgttcattaacaaacgtttccatatcagtgcctgccttttgtggctcatgctgtccatccctgacattttctgccccctctttctttctctcaccccccttgttgtgtactaaatcctttctgcctttaagtgtcactccaaaaccagcttcctgcatgaagccttctcagattcccccttctcccagtttggcttgttctcccacaacaatgctctgatgcactatcttattttaccttcatgaatttctacaacatgcatctgtctccttcactaaattataagctccttgagggcaggactgctcttcttttactgtgtgtccctccttcgttactgaacaatctttatacatctcttgggcaaacacatatatcttaaatctgattgtttacattgctcatgagtataattgttaaatataattgtgtgataaatgtaccaggaagtggatcccctggtctaattgccttgcgaagtattctttcttctctctggggtgaaataagtcaattatattgaaagttagaattgttaaaaagtttataactagtaagggtgattagaagccctaaattcagcaaatgttcagcaaagtatttggtgtttactaggtatctagtatcatgctagtgatgaactaaatagtcactctcagcaccctcatggggactatagtctagtgaggaaaatggtcaattcatatgcgaattagcaaatagattcacagatagacattgtataagtgctataaagaaattaaacagttccagtgatttgagaggctgatgtgagaggatcacttgaggccagacgttcaaggccacctgggcaacataacaagactccatctgtacaaaaactacaaaaattagcaggcatggtggcgtgtgcctgtaatcctagctactctagctacttgagaggctgtgacaggaggattgcttgatcccaggagttcgaggctacagtgagctatgaaccactgcactccagcctgggaaacaaagtgagactctgtctcgaaggaaggaagaaaggaaggaaggaaggaaggaaggaaggaaggaaagaaagaaggaagggattctagaaaagaaggtttagagaaaatgtgggttagaaagtcatttctgctgatgagcttgatttaagacaaattgagctatcctcatttatggagatgcatgaaaaagccactggttggcaaaggaaacaacatttgccctgagcataaatgagagagaaactgatactagagccctgtctacatccacttaacaattgctcttctgagatcacaagggtgatagagcctatgtagatctccctggctcattgaaccttaaccaagggcttctgttaggctttgaatgcacaccagcgacatagaactgaagatgcagtatcttaagcagggctcacatttgttttattttaggcttccctgataagttgtgtgtgcgtgtatatgtgttgcagggtgggggatagggttggagggcattatggaggcaagaagaataagctttcttgcctgtgcgtgaagagtttcaccagacgatttcagctttctcctgtgacctgggaaagctgtgatgtggagcatggccagtttatacttaaaaatgtccacacagttctggttggttctgccatgccagaatcaaaggttggacccggaaacaaatgcctttggctgcttggtaaccagcactatcacaagacagttgtgttgattgagcctaaggtggaagtctgtgtgagctatgagaggtggtaagatatgactgcaaaagccagggctttgtcaaatcatacactcttgggattagtcatcttgtctgaccatcagactcagtgataagtttttgtatcttgcaagttttcaatttggcaagaagtttcctgataatgcttggatatctgcatctcttcttccttcatccagcattgatggttagtagcttcttctaaccattctaacatggatctcatcttgtatttaataattgacagatgggtcctctcccatcttatatggaggatcaaaatgattctagcaacttagttcctttcctcaaaaatattgacactcacctttgccacacacgtctgcgaattatgagttattgttgtaagggactaaactgtctaatcttagagttcgccttggccatatttagaatgtacagttcataggcagctgagcagaaaaccagaaaaagggggctgagaattaggtgagaaactgaggaaatgagtgaaattagtgattctccacccagtcaggaatttttttttgaaaaacattccttcgactcctgtgagatacagcagggaatgagcttattggaagagatgagggaatgagagtgtgaggaggagcttgaatccttccagagatcccattagaaataaggcaaggatgggggagccagggcagcctttggaaatggggagcagcaggaataatggggaaagcagcccccagagagtgtcagggccagcctggaaccagcctctgaaggggtgaccagtcttggagggttactggtcaaagaggaacatctaaactactgccagggcaacgacatgaaagaaaagggttccagggtgtcgggagattgatggggttcaggaaggcttgggactcagcagggcctgggaggtgaaccaggagttgggcagaaggcaggcagagaaaaggtgtgccatgactcaagcctggcactttcaaaagagggcctgccccaggcactcatcctgggttcacagggcacagggcggcaggcacttagagataccagaccctggtgcccatcaatggctttacatggcccaccttgggctaggtcttcctggagctgagcatgtgaattgagcacaccataataatctctgagtgtagtttccagtttcaacaaaagcagagagttaagtacttaagagttcaaaaaggaaaagaaattaggccggcaccatggctcatgcctgtaatcccagcactttgggaggccgaagcagatggatcacaaggtcaggagatcgagaccatcctggctaacatggtgaaaccccttctctactaaaatacaaaaaaattagccaggggtggtggtgggcacctgtactcccagctactcaggaggctgaggcaggagaatggcgtgaacccggaaggcggagcttgcagtgagctgagattgcgccactgcactccaggctgggcaaaagccagactccgtctcaaaaaaaaaaaaaaaaaagagaaattaagaaaagggttcagaaccctctctgggatacattaaatttggggaattaaatttttagtgcagttttatttttctcttacattgcaatctgatgaactgcttttcaaacatttattggctttagagaacttgagtaggcctgttttaattacttctccaagtcctcttctagtattctaattaactgcttttcaataccctgataattggtcatagagatacaaacaatacagttgaaaaacaaggaccaattgtctaggggaatccacagctccgaaggagagcagggatggagcagtgaagaaatgtcactttttctcttttttcataggaaagggacttctgtgttgctgtgaccctgtgatgtgctgcagaacatttaggcttcagagtcaaacagcctgggtctccaatttcagggctgtcatttgttagttgagtgaacccagaaagttgcttaacttttccgagcttcatttcttcaactaatatttggaataaaagtacccttgtcctggatttcttgggaggattataagtatcatataagaaatttccatcttagtgccaggaactgaagaggcactcaggacctggtgacaaaagttatcaatacattatgctacaatagatgtgcccgttattggtgaaaaggcataaacctagaggtacctggggctgaagacagagtaagggttatcttggacagattggcctggttaatgtctcagtagctttgatttaagaaaggtcttctctgaacggctttccctttggtggtgtggtgttttccatccatagatgttggttacttctacagatgaaatgcccattagaaacatgcccaacgtgtcctaaaattattttccattcttggtcctccctagattttttgttggcgtggcagctgaacttgttggcagattatattgggctccaagacaaaggttgacaatttctccacgtctctgtttgggtgtaaagtggagacacaatttttagaacttctgggagagtcttctctcactgtcagcctagactgtggaggcctgaaagtatggtgtctgtctcagggggcaatgggttacttgaaggatatattttatccacagccttttttgtcttgttcatttcagaattttgcctacaagtatatttcacctacagtgaataaagattaatggttgattgaagtcatctggataacatattggaaaacttcttgacaggaatagtttaaattagaaagcagaaataaacttttgactttaaggaaatatttcatgtctgtcaacataaagcaacttggcactattaatctatatccacaaatactttcatgtcatatgaccacttttttattggacaccaccttctggaaaaatctaaaatatgtaaaacactaaattcacaaaagtgattgtcctagagttatttataacaataagttagaaacataacatcattgaaaatttgattaaatcactttggagacatccacttgatgagatgttatacggtcgtataaaagtgcacggaaacaggtcaggcatgctggcttgcatctgcagtcccagctacttgggaggttgaggcaggaggatgacttgaggccaggagcttgagaccagcctaagcactatagtaaggttccctctcttaaaaaaaaaaaaaagccgggcacagtagctcacccctctaatcccagcactttgggaggccaaggtgggcagatcacttgaggtcaggagttcgagactagcctggccaacatggtgaaaccccgtctctactaaaaatacaaaaattagctgagcatggttgcaggtgcctgtaatcccagctgcttgggaggttgatgcaggaaaattgcttgaacccaggaggtggaggttgcagtgagccaacttatgccactgcactccagcctgggtgacagagccagactccatctcaaaaaaaaaaaaaaaaaagttcagaaactccaaggctaagtactttggtattatacattactagcaaaaaacatggtttgaaaattgaggtgcaatattatcactatctaacaatctaacacagatgcatagaaagatattagcagaaaatacactaatattttaaaaagtggaaaaattctgttctaatttttctttttcctttccttccttccttccttccttccttccttccttccttccttccttccttccttccttctttctttctttcttttttttttttgacagagtctcagtctgttgcccaggttggagtacagtggtatcttgtaccacttggctcattataacctctgcctcctgggttcaagtgattctcttgcctcagcatcctgagtagctgggactacaggagtgtgttaccacacctggctaatttttgtatttttagtacagacgggatttcaccatgttggccatgctcatcttgagctcctaacctcaggtgatccacccacctcggcctcccaaagtgcctggattatagacatgagccaccgtgcctggcctaagagtccagaaatgcctaatttttctttagtgccttttagttgcctctttttttattaatataaaaaataccagaaacactgagaaaataaaaagaaataaaaccctagaagttactaggaagaaaaaaaaaaagtgaatggcacggaagatgagcaagcagatagtgaaatgcctgaagtggacatggtgagggagggaggaaactatgatactgggtgaagcacagagtgaatcttgtgaaatggtgatgtgaaaagcagcctcctttagtgatgtcctattcttgctctatcacattttagtgcttcatgggccataaggaggcttggaggcaaggaagttaccagcattgttggataccacgttttgcctgtctgaaggcctcgtcccttacatgtccgtatagacatgtttctctgtcttttgaggttgggtggattaagtaggccagatggtgtgtcaaaggtggcaacaaggctgtagtagcactggacactcaggaatgccaggaacacagtcccccagatttaacagtttctgagaataaagcacagttcctggacaatgaaagatttctttgaagcaaaatttctggtaaggagatggacattcacaaagatcagaattcatagcacatttcaatatctgcagacctacagatctatgcaaggctctccctgggaatggaaagaactcactgacagttccttattttcgagaacatgggtggcagcaggggtgccctgggtgccttgcagagcagtgtggctcactctacacagacacaaagcctctgagtttcagctcccacttcccttgtaggtaaccagaacttgcatcctcacctttagagagtcagcagcaatggtgaactcctcaagtgaggagagaaaggatagctcaaatccagaagcctgctctttggtgaaaaatgatgtctttgatgagtgaggctgcagatctaactttacttgaaactgcctaaaaaatatatatatacatttttttttgctattaaaaaaaccatagaaaacccaagagagtcctttcaaacttcagaaataggatgtacagaggaggaggactgtgagagagagttcgaatatgaacaaagcagggggcaatttttatatgttacttaggcatataaccttctgcagtgaatttctttagagttgatatttcttttttattgtttcccacactgcttcagatattttcagacagatttttttggttttggttttttagctacactgagctcgtccttaatgtgggagctgccatcccagaatcttttctcaatatattttggatgaactgctgcttgagtttccctgagtgagtgattaaagtgactgttcctatttgttttctgcaaacacaacaaactataattcgttctaaggagagctcaaaggcaggaagccatttgtctgctgacaaccttttctcagaacaacctgtgatgcctcttctagctggggctggacatccatcctggctcccaactggtgtccttgaggtggggcctatggggctggacttaaagcatagttctcttgattagaagctgccgtctgtcctgctgggcctctggagtctgcctttagtagtgctgtgtcacaggaatagtcccagactgagacacagaacctggaatttagccagtgacaagccgtgctagctttcaaaggtcgctgtgtgggcctcggtgtcttccttagttaaatgggtgcactggatgctataatctctaggtttcactctgacactaagaatttgtgattttttcttctgattcctggtccaagggttccttctctcctggagatggagacaccatgaccactctcatggatcttttcttcttggaagaaggggtgaatatagagaatgacaaagaaaaagtgagatgacagtgatcagtgttatgaagaacatggcttgggtagggctggttccttgtattgagtggtcaagaatcaagaaggtgaatctgcagtcccatctgttcaaggtgcagcagaaagaagtgaagccagggatggagcggggagcaaggaggaatgagcggccacatcagagggaccaggcctgcgaacttgagcagggtgaggcatccagggctcctggttcctggcacggcatcctcctagtcctctaaccagggagtttcctgctctgcccttgatatgaatgaatgaaggcagtcaccggcagcattgattctctgtcaataattctccccctcctccctcatccccaaggctcagctcagacgcaatttctttctctctttttttgcacaatggctttactgaaatataattcaccaactataaaagtcattcttttttcaaaggacaactttatggttggtgaaccacaattcagtggtttttagtgtagtcacagagtgatagacaaaatttcttctttttgtaggtggaagaaggaacaaattataaattgtgtgatttcagatgtctggacttttcattcttttattttaaaatatgtctatttaccatgtttgctttgtttttttttttccttcctgcctctgttactgctattactgtgttccatttttccttctcataatttgcaagccatacatgcaactttggttcactaattgattgctcttaagttttcatcaagaagttatattcatttttatttctctacacttaaacagtacctttaacctcctccccaccaaaaaatactgagatattcacatacaatttctctcttttatttccctcactgccaccatgtggaaaccaatgggtgttttaatttggtatgaacatgagcattttaggtttaaaatgtgtttcactgcattttgactgtaggaagtgagatcaaaggacagagagcggggaggagggatcacatcctgtaaggcctttcagaccatttccaaatcttgatttgattctgagaaaggtgagaagccattggaggattgagataagaagaatgacatcttctaatttacattctgaaagattactctggttgctgagttgggaataggggagttaggagtaaaaaatgggagaattcatgggcttgctgtaataatcccattaagagttaatgtggctgaatcccagttgttgcaatttaggcaatgaagagttgaccaactctatgtttattttatgtaatttttcataatttttaaatttagaaataattttacacaaaacatttacaatgttagaagaatgataaagagctccaatataaccttcacccagattccccaattgtaatcttttccacattggtttttctctttttgtatatccatattgtaattttttggattgatttgataataaatagaaagcatgctgcctttatccttatagtatgtggtgtatattatataagaacaggatattctcttatacaaccacatacaatggtcaagatcaggaaaataacattgatacaattctattatttaatctgcagactgtgttaatatttggccaattataccagtaatatcctttatagaaaaaatctggcccatggactctatgtggactaatatgagagacaggggataggagttgctgaaggagtggaggtgaattatgggagaaaaagaggaattagggataattgtaagatttttcacgtatgcaaatagaaaatggagttcgtattactagttaaactgcgaggactttgcaaggaagaagtttttgtgtatgtctggggcacagttcagccttggatatactaagtttgagatgtttattatacatcgaagtggatatgctaatttgttctttgtgatttgaaataacatctttatgtgtctaaatctgagtcttttctagtagtttagctcagtgctgggtgggacctttcaacataaacattttatcttttctatgtgtagaaaatgtcctttaattatttatctgagcatttcattctcttttgctgtctccagatgatgttggaacttctattaatagttttgttcttggggttttttagcttttcttttaaatcttccatctcttgaccttttttgcttctatctgtgggagtattctcaaccttcttacaagctcattgattgtgtggtttggtacattttaattaaaataacaactctgagtcttatttcacaccattctcttctctctgaggacattttaaagttacttttttccactttgccctcttagcaaaccaacccatctgttagttcttttgtctgggaaatttggtatccatctaatgtgtcattagctctcctaaaatatccagtgactgttctttgtctttttactgttgaatgtggatgaagttacctgaagcatgtacttttcttttccaagcccagactcttcaatttttgtttaatttgggggcaagctctcctaggtgggtgtcatcttgctccaatccttataatatttaaacttgaataaccctttgccaactatccaatctgttgccaaaacaagctttcaaaattgaaatattaagatgtcatttagtattctaaaattccctgcatccctcataattttcagaataaaattgaaaatccttagagtggcaacatgccgtaaatatgggaatcctcatgtacagattctcacccacgttctcctaatatgtcaaatgttccaggtacatcaaactattggtaattccccgaatgtgcatccaagcctttgcccagaatcttctctttccctggagtgctttatttcctcctctctacatctagaacttcaatgcacccttcaagatccagtaactgctacatatctgtacccaagcatcttttactttattttgatgccttcatcctcaagtacctcttaaataattactgctctttctgaattcttgcagcatttttcacgtacccataggtgtttctgtaaataattgatgtgcctctttctctcctaccaaacaggagatttaaaagcggtgatgtgttttattcatttcagaatctttgctacctactgtacagtagacagttagagtgatatcacttgtttaataaattaagtgagaaatcccaaagtaggttatacttgtttgtctgttttaaaatggtgcagggaggggttctggtgactaaggtctacacgctaatgagcatttggattatttaatgttatttttcagggttctataaattgtgtaggactctcattttgtaggctggtctctgatgttggctctaccataggtttcttataaaacagccacagaaaccacttccatatctcacttttgacattgatgtagtcctcaggccatggacaatgaccactgagacccaagcaaggttgtgggcaaggctttgggaagggggttgataagatacaagggaatagccaccagccaggcctcaggaagacctgaggagctctcttgtgtgtgggatgagatcagaccagaatcacaagagaatcatgcaggcaggatgggagaatcctggtgcaccaggatagggcagaggcttgtttagagctacaaataccagcaaggcctggcctggtatgtcaggtcagctaatatgtcagttcccacagctcccatagacaatgggatgccagggaaagtttttaaaaagagaagtgaaatcattgatgatgcaatttggacttcattctagttgtttagctgtacatttgggtcctagagaaacaagaagcaagctggaggtatgaaagagaacattccaagaatgacaggtaagtctgagtcacagctcgaggctgaaggaagggggttagagaggaggtgtcccttgaaatagaagctgaggccagcttgcaaagggcttacatgtcatggtaggaactcagagttttttcttttctctaacagtaaccaaagaaggattttaagcagagacatgacagagggcaggggaaaatcagagtttgaggccaggcttcatgatgaccttccaaggtcaatcacagaggtaaagaggggatcctcatgtggaacaaggaggtccacagccagccagagaggcagccctgtcccctgagagagctggctctgggtttgcagtttatttctgggatcctgatgtcagttgttggtctagatccaaatgtggccatatccaaaaaatgtttaatccagtcagggcactttttcaccattatttcacccattcagttaacaactcatgaccactatttaaaaattatatgctagttttgaaagaaattcaaagttaaaaacaagtccacaaatgactaaaataattaaaacagagaataagacaacaaaggtaggactgaaaggcacctgtaaagctttttgagaaaggagctgagaatgtcccgggggcctgaagggcttgaaagaaaatgcagtctgtgtttacacctcaaagatgtgcaagactgtgtgagtgggggtaatattttgggaagagaaagcgcaatgaagatatataggtgaaatatctaagtagcatcaacaaataactgttgttaatgttgtttaaaaaacaattccctggcttcttgtatttggaatggattgtctccgtggaagcagaaactacctctctcttaccttctttcaggttttcctgggatcagctgcactccttagcaaaagtatattggagaatcaactgagaaagtaactgagacatttcaatcatttctaggtgtaaagaaagaccagatcccaggaaaatattacggtcagttcaatgcctaagtataacaccagcatcactggctgggaccctcagaacctactctcctattttcccttcatcttcttctcttctttctttttcttattccttttctttgtttccccccttctttctcttctctcttttcctccctcactttcttgatctctcgctctctttcatgaattcactgaatcattgcagaagtacttgacacataccatgttccaaattctgagctacggcacatgctatatttttctacaaaataaagtgtgaggtggatctctaaataataataacaagtgtatctcaaacagtctatcctgggcaccttgtaagcttcagttgttttctcttcaaagtgcctgtgtcccaaagctcaggacaaatttcaaaacctgaacctgaatattaagaaatctaaacatatatcatctaaagctggcatccaggaaaacagagcttttcgtttgatcagagactgcatatttcttacctgcaagtgtttgttttaaccacacttggcaggttctgtatataacacgcgtcaaagccatcagttgcacttgtttttgtgactgcaggtgctggcttgcttgttccagggtcccagggcccggccatggccatggtgtttgtctctcaggcttgtctgtctcatacctggcaggctcactgcttcacagctcactgtgtctctcagacattctcttggctttcccacagtctcagggactgttctaaatagcaagctaatattctgaagtgaggtattggaagcatttctgagaagcatttattatttttgtatgtgctcaattttttagcaatgaagacatttcctttcaaggttgttaagctttgaactttccattttgtgaaaaggctcgaaatttccttcattctttgtgggcatccaactctaacagacacataaattaatagactaggaaatatttaacggtctaagttcaaacaaatatgtttactttggctgaattgatgttgctattaattgctattgaaataaaccactgtacaaagaaatatgccctggaggataaatgtgacactgctaaaattaaaactcaaatgagaattatctgcagattttaatgtttcaaattcaatttggagaattcagttctttaatgtaatactgataaaatcatgttattgatcctgcatactcatctcttctcagggattagagacaggctgttacgagtatgtagcaatcccccttgtacctgcataggtggggaggtgattgtccagctctgctggtcgggcactggatgtagtcatggctgcaagcaagtcatgcacgtggagaacgaggtgtctctctgaaagaaatgtagagagaaaattttaggtcaactaattaaaaattcccatcaatctctagaatagcatcccatatgcaaaggaatactctgtcgcccaggctggagtgcaatggcaggatctcggctcactgcaagctccgcctcccgggttcacgccattctcctgcctcagcctcccgagtagctgggactacaggcgcccgccacaacgcccggctaatttttctttttttttgtatttttagtagagacggggtttcaccgagttagccaggatggtctcaatctcctgacctcgtgatccgcccgcctcggcctcccgaagtgcggggattacaggcgcaaaggaatacttcttatacagatatataatttttttgtcccattaggaaaaaattgtgccccaatcgctttctgtcctttcttactaaatgtgaatcttgaaatgtttattgcttcatggtgttcctccatttggccccatcctagttcttgctttgcttttagatgctggggagccatcttgggagtagggtgcccattacatgagatgaagtggtcttcaaggggacaataagggagtaagtgccttgtagaaagaagcaaagtaaagaggaagagaggtttctttgtttgttttttttatttttatttatttatttattttatttttttattatactttaagttctagggtacatgtgcacaacgtgaaggaagaactttctaacttctccttttctttctctctctctttttttttttttttttgagatggagtctcactctgtcacccaggctggagtgcagtggcgtgatctcggctcactgcaacctctctttttgttattaggttgttgcaaaagtaattgcggtttttgtcattgctttgaatggcaaaaaccgcaattacttttgcaacaacctattacctaggctagagtcagagccccctcaccttgagagtgatgagttgcgagagtctgcccccagcaggcagattgagagagtgcatggtttagcagaaggataattttagctgtagtccatgggacagaatggagatgttgcaatttgatgcagatcatctgaaagtcttgtgcaatgtcctgattaagtgtggacagagcaccataaaaaaggaatttggaagttggaaacatgctgagttcaggcagacataaaaggcagcatctggaaaacctatcaggactcaatttcaggacaagtgatcataggtaggtgggatcatggaacttgacctcaaggttacactataggaacaataaataggttatgaagataatgagcagataaacagcaccaccaaggagtctcagtaatagatatgtaacaaaggagcagagcaggactctttataagagctagatggtcgtaaggagaggattggcacagcagtggttcatgcagaatctcctgagacgcagataaaacttagttctgattgggagaaggttattacaaagcttgaggtggagatgtagtcacaggaaagtagcaagaatatatgggggagctgagacatgaagaggcatttcctagaagggaaaattaggctttaaagtcaggcagatgggtttgcctgggaaacaatcaagagcgctgagtctgagccagggagctggtggggagtgagccaaagtgtgtcaggtaaggcagagaaccaaaaccagatatcaggtgacaagtcaagaatgagtaacatagagtacatgaataggtctgggcggggctgagaagatatggacttggctctatgtgcttggctagctgaatgttttgcagctatatctacaggtgcttttattatcatacagcctggcaaggaatgttattataaacagcttgggtcctaggttttgggatgggaagaagccccagctcctgggaataactgtgatgtcaccataacacatggtgacttgtcccagcaaatggagcagggacgtggatgaggaaaaccacagataagtattacagccaggcagggtggctcacgcttgtaatcccagcactttgggaggctgaggcgggtggatcacctgaggtcaggagttcaagaagagcctggacaaaatggtgaaactccgtctctactataatacaaaaaataagccaggtgtggtggcaggcacctgtaatcccagctactccggaggctgaggcaggagaatcacttgaagccgggaggcggaggttgcggtgagccgagatcccagcactgcactccagcctgggtgacagagtgaaactccatctcaaaaaaaaaaaaaaaaagaaaaaagaaaagaaaaaaaaagtattgctaggattagcatcactgttagttaccattccagttattgcccacttgctagacccctcagaaaaacagaagtttgcaggaattttgcagccaaaaggtgatgtttaaaatattcctagaagattttttccacttcatacgttggatatttatctcataaattaatcaatattggccgagtatcgtgccccatgcctgtaatcccaacattttgggagatcaaggcaggtggatttcttgagccgaggagtttgagaccagcctgggcaacatggtgaaaccctgtctccacaaaaaatacaaaagttaggccaggcgtggtggtgcacacctgtagtcctagctactgggaaggctgaggtgggaggatcacttgagcacaggagatcaaggctgcagtgaaccatgatgatgccactgcactccagcctgggcaacagaacaagactgtcccaactcattaattactcaattaatcaatattaattattatgttgtatattgttttaattttgcataaattatctaatttgtctcataacgactatatgaggtaggtagggcttatccacattttaggtgagagaaataagcctcagagaggttaagtagtttgttcacagtaacactgcaaacagtagtagaagcaagaattgaagtaacgcattgttctcttagctacatgttatgaatatttaattactcttccacttcatatttagagactatcttctatgtgttggctattgctatggataaaagagtggaaaataataaaaacatgcacagtccttgtccttgtggagcttaggagcttacaatctaggggaaagagggaagataccagcaaccagcacccattaacccaagtgattatttaatcacccttgtagaggtgattcttttatcttcagaagaggagaaaagagaaggtcagatagatctcatgtagtgtaggagttctctgacttatcttctgaaagagatcttaccaagtagatcttacctagtatgggagtcagagaaaacttccctaaagaactgatagtagacttaagacctgaaggattagtagatggatggggaggggagagaagaggtgttggtgctaaggcaagaaagagcttgaggcattgagtgaagataaggtgttatggagtgtggctgctgccagcagggattagatgatgcactttaaaatgtacaaataacagtactataacatatttacattataattgaaatttataaaagttagggaactaatctttgtatgttggggaggaagttacctttctcttgttaattcaattaatttcaagactgtaagaatgtattgcactactgaaacattaaaaattgcgttagcttctgcatcttcatgggatggaaggttgatcaactgattagagctcccaccaggaataatccaagaaatcaaataaagtaaaatacagaagttatttgcttgaagacagtggagcacagctgaggcaattagtgaagaggtcatgactcccaaggagagaaaagctcaaagcaacttctttcacaacagtagcttttccaattcagagctgagaatccaaattcttcaccaatgcatgaagacattttgatgaattctgggacttggggggatgggagactaatatcctaagccttaaaacagctgaaaaatatagcaaagatgtcagcagttttataagaccaggatttgaagtcaggccagattcatcagaaaaagtggtcagagataagactattgactgtagctaaaattacaaagggggctaaggagacccagaagtacactaagccttactagaactgcaaacaaggcttgactcaaaataatgttagtatagtggcagaaaggatgacccctctcaaggaaaagaacattacttggaaccactaccttttttaagaaaaatatacagaatttattagtaaattactagacatatcaaaggaaaagattacataatggaaaaccaagagaaaaaaacagataatagaagtatatctataaatgttcttgacgagccttttgaaataactatgattaaagtatttaagaaattaaaggaaaaggtgaagaaaatgaaatagatgagaaaatttcacaaagtagaatgtgtaagaccgacacagcctagaactgaaagtatttcatatctggtattaagaattctagttggtttagcagcagaatagaaacagccaaagataaaagcactgaacaagaatatatccaggccgggcatgatagctcacacctgtaatcccagcactttgggaggctgaggcgggtggatcacttgaggtcaggagtttgagaccagacggaccaacatggtgaaacccgtctctactaaaaatacaaacattagccgggtgtggagacctgtaatcccagttactcgggaggctgaggcaggataattgcttgaacctgggaggcagaggttgcagtgagccaagatcgtgccattgcactccagcctgggtgacagagcaagactctttaaaaaaaaaagaatatatgcaaatggaaaaagggaagaagagatggatgaaatgtatataaaattcagaaaaaattagagacagaaggaaagcagttaaaatgtctaacataactataattgaactttaagaggagataacagattgggacaaagcaatatttggcggggtaaaactgattatttcccaaaagtgacaaaagacattaacctataaatttaagaaccccaaacagtataaacagaggaaaaaaaaaaaaacacccaggcaaaagtgcaaaaaaatctttcttaaaaagaaagaaagaaagaaaaaagacatgcaaccataatagaagcaatggcaatattgacaactgaagtctcaatgatgaaaggcaagagacaatgtaataacatctttaaagtactgaaaggaaatgccaacctcggcttttatgtcttgcaaatatatcctaaaaataaagatgaaatgaaaacattttcagacacacacatacgaaagctgagagaatttatccctaagaaatttgtactgaaagaaatttaaaatggagttcttcagcagaaggaaagttatacccaatggaaacacagaaattcaagaagacataaaaatcaatggataagaaaactaaatggacaaaaataaatgactagggattgaatgttaatgatacaatacaataatattgtgtggggtttaattagatatgtagaaataaaaagcatgaaaactgagaataagggagtgggtaaatggaattaaaatgctctgaatttataacattttaaacaagagtcaaaatttctatttacaacacacacattttaaatgtaataatcataaagattgcaagaaaaagggaaaagatataaagtacacacactaaagaaaagaagcttgagtgtgtcaaaagttgatcttgaggaagaatcattatttgaaataaagaggaaatttcataatgaatatatcacttttattataattcctgtgtttataatgtctttcttaaaacccatgtagctggatcctgtttctttgatacagtataacaacctttattttttaattggactgtttactctatttacatttaatgtaaaatgtgattgaaattatgtgtaatatatcatgttagtatttgaaatccaggattctattacagcagtcccagaggaaccagataaacatactactgtcttgtcaaatggtctaatccaaggttatacaacttgcggcccatgggccacatacagtccaggatggctttgaatgtagcccaacacaaatttgtaaactgtcttaaaacattgtgagatttatttttaactttttttttttagctcattagttattgttagtgtattttctatatggcccaagaaaattcttcttcttccccagtgtggcccagggaagccaaaagattagacacctctggtctaatctgtctgcacattgacatccctcatttggttcacttttacctccaagttttgcaatagtgcaacagactagcagaaactaaggcacatacaagcactctagatgcaaaaagtctgtacagaaaagcagtccagaaagggttcgggtggatattgcgtgaactaacctatgggattgactataagcctagtaaagggaatgggaaagtaagatatccaaaaagagagaaaagcacctttcaagatatgttggcatacagccatgtgagtagaaccaaatttcttcatggcctcctttccttcttgtattacagtttagaaacttggacttaggagattcacaatgcttctccataatatataataatgagttttcgggagtgtatgtgtgctttggacactttggtcaaatgacttatcctgctaggactcagttttgtcatctaaaattcagtataataatacattacacaattaactgttgtaagggttaaattaaataagacaaagtacaggcaaggatgtagtgtagtcctgaaacatcgaagatgtgtttctcatatctggcaacgatcatggcagtttataataagaaagaggacttgggacaagtgatgtgctacttactttactttcatcaattaggagtcaatcctactaggccaatagccaaaggaaatggtgagcagaacctatagtggcacattcattcttgactcacatgtgaacacaatataatttcatgtctccttgataaaactacttttctacaaggaaaaataaaaggcaagtagagagatttcagcctacggatgaaatacacagtgtaacatgagacagctgttgcagagccaacaaaaaaatcatgttcagttaagtgagtcacaattccttaaaatttttttccatgcccacaaatgcaaaaggctttgtgaggttgggttattattatctttttttttttaagtttcattgaggtataagttatatgcaataaaaataaccaattttaagtgtacaattcaatgagctttgatgaataactacaatggtaaccaacatgatataaaacagaaactaatcctttcccccacaacccagatcttgagctatctgatttgctttttgtcacattagttttgcttcttctagaaaaagatatcatacaatatataatcttggtggctggtaccttttatttagtaatgtttctcaactttttgtgtttgttatggtccctctaatgagtatttttccctaattgtctctccccacttaatgaaattttgataccacagatatatctatatgtctatgtactgtgtatacacctgtgctttatacagagtaagatttttttcacacctcaaaatgttttgcccctcacaaggtgctatcaccccattgagaatacatgatttagtgtaatgtgtttgagattcatcagtattgtgtgtatcagaagttggttcattttattgctgggtaatattccattatacaaagagacattcaataaatgaataagaataattgcatatgtgttgcaaaggtcagggagtgagttctttctcaaatcttagtctccctggtgtcagtagacatacctctaataacacaattgttcaagtcagaaatctgagagtatcaagacacttcttttttcctcatttccccatgtcaaatccattaaagcctgccaatttcatctcttgattattgcttgaatcttgtctcaagggatcagattttgccactgtaacccagaacattccagacatgtaaggctatcaatctttatcgtaggagagatgggaagccgttgaagggatttagataggaaactgacatgactttcttagtgaaattaaaagattactaaatcttttacagcaagcaatgaataagaatatggagaatgaattagaaaggactgagagtaattgtggagcggatctttcaggagtccaggggataaatgccagtggctctgtcacgaatttgcaaggcctttgagagtaggagatgagagagttggaagacatgctatatttcagtggggcccatgggaaggcttagcaaggcctcactcactgctagaagataaaataactgtaatgagaaattcaggtaaaccttcctattgcttgctgctctcttgacttagatggtatttttggtcaaattaatcagtattctaaatgaattaagtatgaatattcttgggtcatttgctaataagtaagaaagaattagagaattataatcatgcccgtaagaaaaaaaaattgtatacttcatgaatccatcgatctttctatccatctcacaactttttaaagggttactgtagtactagtatccaagtactagctccagatggtctgcaatcctcctgaagttttatgtaaattgtcttatctacatacatctctctggggggcaacttgaagattcagattcgatttttattcctattaaagagtaagaatcaatggcttactgtgttttaggtctagggtatgcaaacattcataggaaataatcttcattcttaaagcatgtaaagtttatatcatataagcacataaatggcaaagtcacattgtcagtgctgtaaaagagataggaacaaagctctgaaagcttgtcagttactctggtgctttttctcctccaggtgacttcccaagtatgcctggccacaatacctccaggaattcctcttgcgatcctatagtgacaccccacttaatcagcctctacttcatagtgcttattggcgggctggtgggtgtcatttccattcttttcctcctggtgaaaatgaacacccggtcagtgaccaccatggcggtcattaacttggtggtggtccacagcgtttttctgctgacagtgccatttcgcttgacctacctcatcaagaagacttggatgtttgggctgcccttctgcaaatttgtgagtgccatgctgcacatccacatgtacctcacgttcctattctatgtggtgatcctggtcaccagatacctcatcttcttcaagtgcaaagacaaagtggaattctacagaaaactgcatgctgtggctgccagtgctggcatgtggacgctggtgattgtcattgtggtacccctggttgtctcccggtatggaatccatgaggaatacaatgaggagcactgttttaaatttcacaaagagcttgcttacacatatgtgaaaatcatcaactatatgatagtcatttttgtcatagccgttgctgtgattctgttggtcttccaggtcttcatcattatgttgatggtgcagaagctacgccactctttactatcccaccaggagttctgggctcagctgaaaaacctattttttataggggtcatccttgtttgtttccttccctaccagttctttaggatctattacttgaatgttgtgacgcattccaatgcctgtaacagcaaggttgcattttataacgaaatcttcttgagtgtaacagcaattagctgctatgatttgcttctctttgtctttgggggaagccattggtttaagcaaaagataattggcttatggaattgtgttttgtgccgttagccacaaactacagtattcatatttgcttcctttatattgggaataaaaatgggtataggggaggtaagaatggtatttcattacttgatcaaaaccatgccttgatgtacccaaaacaaaaggactataaaatgcaagagccctcattgtagtccttatgggatccctcccatctctgagtgatggccgtacaaagaccagtgttgttgaatccacctggagttgcaatattacattattttccagtacagaatgtctgtgtggcccatgaaagcaacataggttttaagagttttagagtttcattagctcattctaagttcctctgtttgaagcatggtctcttaggttttggactgaactcagacctttagttcttttcatcccacttcaccttaggtaagtaaattctggccaccacccagctccaaagacacaaactctccttcgctaaccaggttagatgtcccattcatctcatgccctgataaaaactgataaggggagagaatagttaaaaatttttctagggtatcataactctggtaggaagtcatctgtctagaaatcaagagaaaaagaacgtgtggcctcctgttataacaagggtttctagatttgtcctgtgaaaggtcgtttaaggacttggggatcaacttcctcaattatcaccaattgcactgttgctccaaaaatcatttaaaagcttactggacatatctacataatggtgaaactgtaatttagagactatccctgactaatgtgctggtaggcattaaaatgagttcccaagggaagtgattaaaatttttttctcttctgttttttgagagaatttctagatgtcctgggccacagttaattaagatttttaggggggacagaaagttatactgaaatctttagagctcccttccgccgttaaaattatatatatatatatttaaattataccttaagttctggggtacatgtgcagaatgtgcaggtttgttacataggtatacacgtgccatggtggtttgcggcacctgtcaacccatctacattaggtatttctcctaatgctctccctcccctagccccccacccctggacaggccccattgtgtgatgttcccctccctgtgtccatgtgttttcattgttcaactcccacttctaagtgagaacatgcggtgtttggttttctgttcctgtgttagtttgctgagaatgatggtttccaggttaaaattatatatttttaaataaatgaaaactgtgtttttaaaagaggacttttgagaagtatatagaaaaaccattaatttagactctgtgagattaggttgcatgaagaaggttttctgaatatttgaagagtggataaataaatgtcccccaaagcaataaaatcataatcctttaaaatataggaaaaataactaatgggaactaggcttaatactcgggatgaaataatctgtacaacaaactcccatgacacatgtttacctatgtaacaaacctgcacatgtacccctgaacttaaaataaaatttaaagtaataataataaaataatatggattttctttccaaattcggaattactttttgtaaaattgtattaataacttgtggcatgtggcacgttaaactgattttatttcaagaacttctgttactggctaggttgatacataggcttgtgggtttttgctttttgggttttttttgctcctgcccatacttccagtgtcttcagtgttttatcttaaaattttcccaggatctgatccagtttcatatttaatgctgcagaaaacctgaagtgattagtaacatgaatagaataacagaatgaattaagggaactttttttttcatcaaggtatatcttcgggatttaaaagtttttcataatttattatcactgtggatccacaaattcctcagatgaataagaaatacctctgtgaatttctgtgaccactaaaattactgagccacagaaattaattctgaggaagcagaagtagcaacatagttcaaacatgacttgtttccatatattttctgttttatatattcttttaaatatccttttaaacaagtaatatttcttttctttcttgccttttttcccatttattttttacattttttctttctcattttgaaccataaaatttgtaagaccgttactaagacccctgatagttttaagaaaatttataatacctataaatatgtaaaaaaaatttagaaaaatatttaaattaaaagtattcatgagaatttcattaccttgtagattatgtcatactcttttccagattttagatatgttgaggtcaggcaattcaaaagaattaatctctgtattaatctgttataatgttaacataacactatgttattttcatatattataataacaggcttattagaaatgttctcaaaagatagaaatgcaatatttcataatataaaatatctttttcatcagtatttatggaataaatagaaaaattttagttttcctgttctttgtcttgaatcaatacagaaatgaacctcatgtgacattgggagtgacattggcctctagggccatttttggatatcaccattataagagagcactagtattagcatttggtggtgggagccaaggaatagacatcttgccttgcacataattgtctgtacaataaagaagtatcaggtcttgctctctatttgaatactctattagatattaatgaagtgaaacatatactcataacaatcagagcagctatcaggttttacccagttttcgtaaacacgtagtatttttttttgtatagctttaattctctgaattttctggaaatgcagctatcatggattgaagaaagattttactttggtttcctctgagctttaccaagagttgttcagtactttggaaatgacattataagtaacaataccatttatgacattaaaatatgacacaacatacctgtaagcaatatttgtagctattgtattcaggagatattacatacaggtgtcagcatcagactcactcattttgtctctttatgtgattatgcctgagcatttacacactgaattatatactgttatccataacttttcttttcattactcatttatattacagtgagaacattatacgtaaaaataatgtgtatgtttacattattagtgtagaaagcatatacatttcattttgaaatggtaaaattatctgtaagtttccttttagaatggtaaaagtattaccaaatatttgtgataaaaagcaaggtattgggtctgagaaagctgagaaccactgaattaccacaaagggacaaaataagagggaaatttataaattttaacattataaacaggaaaaatatttcagtgtttttgaaatacttacctcatcttcattcaattctaaattacttcttttgtttctacagcaattaaatgcaacttttagaaaaatgtgaagaaaatatacatgtgtattttcttttttaataagaaaaatacactttttctgagcctcaccactctcagattggctcttgatcaatatctaccagatttttaacccagacataataatttttgaggcccagggagaaagatctcttcaggcacccattaaaagggacactatttggctcttgtttattccttaattttcctgtgaaaggatcattgagtcccctgccttcctcctcaacttcatttaaattaaggagaaattgtaggtgaaatgaactttgtgtaaagtgattcaagaggtgttaataaatccctcttgcctccccaaatcctcctcaatgaagctgccatgaaaactcgattgttgggttaagaatcagtttttctgaaggagggtattgggccaatccattctcagtcattggcttttggtgtgaagttagaatttgggatgctgtcatagctttgattggatagattttgcccactttcctctatgagacagacataggccaaagactctcacacctattggtactggtaggaacaaggaagctcttcttgttataggggccaactacagcattctgtagacagttggtactgagagctccatggtaaaggggcacagggatggcagaactgtggggataatgcccagagattgcaacatgccaagggacacccatgggtattggaaaccaggggaatctgaagacccagcaggagctgctggggaaatgagacccaggtctgagaacggctagctgagagcaggaggggcttgtgtgagtcttgctcaggagttctgagcaaacaggactgctcttggaagacagggcaatggaggcagcaaacaaagactgttttgaacaggaggtaagaaagtgctggcgagcatggtttattttatttgcagtttgtcctaatagtttatgtcattagcaatgaattatttctgccctttgttgctgatctgggccatagatctcatggaggacagggtgtggttacaaagatgtaaccactggcaacctgatcagagattttggataaagatctccagctcatccttaagtcaagtaagaaaagaatcccttggaatttagagaagggtctgaagagtttcccttctgttttcaggaaagcatcatcttacatgtcaggagtagacacttgccaaagtctacaccagcctctggcaccctcaggagggtctggaaagacatctaggccccctctccaatgatgttcaattctgtataacacagcacacttcttaccacagcccagctgggtaccccattctctgagttgtcctttgcctctcagaattccattattttcgtagcattgtgcttaacagtgggacacactactgacctgtacacttaagaacggctaagatggttgatttcatgtcatgcatatttatcacaataaacaattttttaaattagaagatatatatatatcttatatatatttagttatatatataacatttatatatatatatatttagaaactttaataggcaagaactgagctgatggagaaagttaaaatattagaaagaaaaaagctagtctgagacatagaaagacttcagtcctcctatcaagggactacctatagggaaagcaaatggaaaacacttcacatctggacatatccttggagaatgctttgaattttaagaacaaagaattagtacaaaaaaagccaggcaagagaaatgtttacctctaaaagaaagaaaaacaattagaaaggtattaagtattttccttcacagcctaatgccagaaaatgggaagcaatgtctattggattttgatttaaaatatcatggctaagaactctctaagcaggcaattactgtgcatgcccctgggtaaacaaaggaacttgagacggattttcctctccatctcggggcttatcatcccaaagccattgcttctccctctccagggtcttccacaggtaggagagcaactccacttggttatcttgaggccaaattatcttttcaggaggcaagttgctggcgaaacctaactttccttttagaataagatccattcagcactcagtctagaaaaatgtttcttccatgattcttacaataggaaggcagctttccctggcctcttgttctcacgttccattcccgcttagagccgctcccatgtcactatttccttagttagactagaaagagagccagatatctgttctgaaataattgtctctctcctcctatcacaaccatcttcaaaattttgctttgcatttgaatttttattgcatatttagtttcacaaccttatttcctaaactttcctaaaattaaatttctgcctcatctccatttttatcacaacctgttaacttattgcacatttaacctctgttctatagaaaacatgtattttgagttttatcaatggtttaaaattgaccagtgcagtctacaatgcctttccgtctcattcagaaaattcttttcagacgtgctctttctacaatttgagcagttcaggttattggccacatgtagttttttccccttattcctgtattcctaagtaagatatcaccaggccttagttttccttatcaactgtgtcagtggcttcttctcagcaactccttattatcaggcgctcttagaggcttccacttaaatgtaaaaattggagattgattaccagttcctggtgctaagtgcccaagggcaagagagaggctgtagggattatggaaaactctactaactttgcagtttcttttgtatagttattaattcccttgtgtaaagtggtcagccctgtgtacccagaatgattctggagtgaagaaactgccctttttttgtgtgtacaaaccccctctacccaatgtcagtgaacctctaagtaatcttcaatccacacacgagaggtgctgattcataataaaattttgtttttccagggaaataagaaatgcaataatgatgcactgagtttttcttaaagtgaaacatatttaatgatatattcagagacatatttttataattcactttatttgtattatatcataatgtactagaactattataagcaccatttataagattataattaagtaatctgcaagatggtggttgtgctaagaaccacacatagacaattttcttgacaatattggtcagtttccagtctttggccttagatgtcttttggccagtcttggtatatcatggacacaaaatgagttctatatctgctgttgttatcagtaaagtcaccccagatgacacattgctccaaaaatatctggcaaagtttttaaaacaataaatttttatatgcaattggaattatttgtaaaaaatcaataagtgaacacacattgaatttctctcgaagtcctgacttttgatgtatttgatgattaaaattaattctaccttttatggatattaaaagaccaataatgttaaacatatcaaagtgaagtttgttccagttggtctgtttgaatgttctttttttttctttttcttttttgacatagagtcttgctctgtcgcctaggctggagtgcaaaggcacgatctcagctcactgcaacctccgcctcccaggttcaagtgattcccctgcctcagcctcctgagtagcgggaattacagatgtgtgccaccacgcctggctaattgttgtatttttagtagaggcagggtttcaccatgttgactaggctggtctcgaactcctgacctcaggtgatccacctgccttgacctcccaaaatgctgggattacaggcgtgaaccacagcgcctggccttgaatgtttttaaaaagacctgacagagtaaaaatgtgtatgccatgaattgtgttgtgagtaaattcacagaagggcatgatgagaataacatccagcctgccaggagagtcatgcagaattacttgaaaatatgagtgttcacatattcacttcagatttattgagctaaatgcaaatgatcaaagcaactctactgcatgatattaataagttttgtctgctctaatgctttaaaaccacaaaacctttaaatacatttaaatataagatactatgctaaaagatcaatgcagataattttttgaagtaaaaatgctccaaaattatgaaactaccaaatcttgagtgttggtatataaatacgtacttattccacagacctcatcctctcttgtccactcaggactttgcctctgctactgtggcctcagactcctgcaccatcattttctctctttctactgaactacccatgtctgcataaatgatacagtattaatgaaacaaaaccactcccatcatctccagtaaatgccatgctattgctttgcctccctttataagttttctacaagaaaactccttgaaggtaacatccacattattttattttattttatttctgaggcgaagttttgcttttgttgcccaggttggagtacaatggcgtcatcttggctcactgcaacctctgtctcctgggttcaagtgattctcctgcctcagcctcctgagtaggtggaattacaggcgccagccaccacccctggctaattcctgtatttttagcagagacgggatttcaccatgttggccaggctggtctcgatctcctgacctcaggtgattcgcccctcttggcctcccaaagctgcattctgtttccagttcttcaccttccattattcccttggcccagttccatagtttcctttatgccccactccaccataccaattttgtcaaggtaattaatggtatcaattatataattcaatggttaagtttgagtcttcaccttattcaatctcaaagtagggtaggatgcagttgagaaatctctttttatggaaatactttcctcatttaattactaaaatgtctcctgctcttgggttttctcctacctcattaggtgttccatttccatttctttgctattcatcctcttcttcccagtttctaaaggttggagtgcacagggcttcatcctcagcaaccttcctgcctttctctgcacacctccctaaaacatcttaccagttttgtggctttgaatgtgatctgtacgctgatcttcaccaatttatatctctcactctgtcctccctcctagattccagctacacttgaagcctctgcttataataatacgcaacttcaatttaatttcaccagagcaaaacactggatttcctcccctcagcagccttccccatctcagaaaatggcatcactttttacccattagctcaaaccaaataccaagaagttatgctcaatgccctttgtgtccatcgggttccaattatgagacagaaactgcttggtgatttaaacagggaaagtttaatcattagctataaaaggagattgaagtgttgagagattagctactaagaggtaaagagatgtctaaagaatacaagagtaggagatgtagccagcagccactatcttcagatcagaggcaaagcatgcaaagaaaaaccaacctgggtaaggaatccgcctccttacccccaccagcccacctcacatacacacacacccagcactgaaatgcagaccttgcaggaaagggtgggtcccctggatgatggagaagttcacaaaggtgctttgctgatggaacttgctgaaaagccactcataggggtattagaaaaagctgtccaaggggagaaactgcatctcaggccatgctgggcatctgcccaaggaaccgaatgcctttggaagctgctctctgaagggcagggatggctgtccacgaggaggccacatgcattgcgtgcattaggcaggagcctgctacgagaaagcaggtaccagagccagggagaaaagcctattcttccccaagtgctgcttcagcgccttgtaatgatgaagattagtttagcatcccacccattggtaagggagaaacgtgctagtttcatggcagggcagtagagggtggatttggagccgaagacaatatatggatggatagcctttcttttgtttacacccacaccacgtatgctgtatcttctaataccgatgactctgctttaaagcgtgtctctcatctgaccacttctcgccatttctactgctactaccttctcaggctagtacaacattctccctctccctgttttcactttcgctgcactgtggtcagttctctgcacattagccatacatcgtgtgaaagtataaattcaatgttatactaatttatagtactgatgttaaatcatgatagtctccactaaaatttttcctgtggcttttgatctcactcagatgaaaatgtaaacgccatgatcagacccttgcctgtctctcagtcaacttctttctgttcctttgtttttgcctcataagctttgaattttctgttatctctgatgggaacatttcctcaaatagctggttcctctgtatcattcataactgctccagtgtcatctctgcaaagaaggtcctgatttctctatttctctatgtaaaattgtagctttttgttccctactttttatactattttatatatatatatataatatatacatatacatatatatatatattttttttttcagagatagagtctcatgctgttgcccaggctggagtgcagtggtgcgatctcggatcactgcaacctccacctcctaggttcaagagattcttctgcctcagcctcctgagtagctgggattacaagggcacaccaccacgcccagctaatttttgtatttttagtggagatggggtttcaccatgttggccaggctagtcttgaactcctgacctcaagtgatcctccccaccttggtctcccaaagtgctgggattataggcatgagccaccacacctggctactttatattctttttggcatttattattaccacaaattatgttaagtattcttaattaacaagaattaattaaatttttgtccactagaatttaagtgtcataaagaaggaaattatttttgcctggctattgtgagctaaggtttaatggcattcaataaacatatgttgaaagaataaaaaagtgggtaaaggaatgaattcctgcttttcaacactgatttgaacccatgatctgccattttttagcatataaagtttgagtcagtttctcaatatctaagaacctcaaattcttcttctctaagatgatagtttaaaacatttaactctcccaagcttactgtgaaaattcaccaggttggatgatatctcctcaaaaaaccataagaaagacttcttgatcaagcagagccatctcttgatggagtctaagtagtttcttaaaaagagcaattagggcaggatatttataggaccacaggccagcctgggagattttaaagagtgtctattaaggtttggattggacagagtttatgaaacagctgtgctttgatggacacagtagggtgagggtggtaaaatgaattaagttagcaagctgttagtcctaatgaataagtgattgggttggcttacagtcttatattctacaagcaagtgtttcaaggagcaagtagctaagtgtgttttgtttgttctcagtattgattaataaagaaacagggagaatatattgtctcagatttggttagcactggggcaggagagtatgttctatggcgttgtttatgggacagaggtattttggttccagatctcaagtgagatggtatttgtgaggtgtggaaacagtgccagcccatatgcacaatgccataaagcagagtagatatctaagtgaattgcccgtcactgagcagcttagcatatacagcctgtattcagataaaagcatcatggtttcgcttctttgaaaagttcttttcattaataaaatggtttttttggtttcttttggatgatttaaaaatgattctttcagagatgataaattatgtgcttggggaaattctgtaattctgatgggtttgtaatgactctttttgactttgcgaattgatccagtagagcataaacttcgggagtgccttaggccttaataggctatgttcttgttttaataattttgacagaattgttgtgggaatcataattagagtctctctctcagtgaatttgattaatttaaaaaattaataacatttctacgtaaacaaaaggtattaggatggtgcaaaagtaacttgcagttttgccattaaaagtaattacttaccacaattactttttcaataacctaaatgtaataaggaagagaggagagcctatccccgagcagatgtgcactttagggaaggagttgatgcttgtcctgtgttgtgaggctttgtgattgaatcagctgctcaggatatcaaagaatcttcaacctgaggaccagttacattagaatggtattgtctgcttggactcctctgttgagaagaattgcaacgattctctgagttcaggtgggaaaaagagctgtggtatgggcataggaaaggtggatgatggcctactcatagcacatttattggtacattgttgtttttgctgctgctattgctgtttcctgtttcattgatgaatcaggagtcttctattaaaaactatatgtactacttttacacatgttcacagtaacataacaacaagcataggtcttatcatccacttattccaaggctaagaataggagtcagggaagttaagtgactagtctgaggacacagggataaaatttggcagagacatggatgtggctatgcccaggtatatgtggctgaaagctggtgctctgtctctatgcaagacaggcagaggaaaacctctggttaccaaaaaaaaaaaaaaaaaaaaaatcacaacaaagctacaggaaaacagaaaccatctagaaaagaagtcaagtctccttctcaatgacagctgaactttgccaaggaattgagataactatgagctaaggctgggtaaagattctgatttaaagcattacagactttctaaagttttacttctttcaggagcaggaacaaaatcccttttccccttttatctacatgatttagaggagtgctctgctaggaggtctatgaatatttatagaggatgataataattaaagacaaaagtttcaagatatacgtagcagaattaaagaacagggttatattttgcgtttctgttagtgtttaagagaaagagatctcttagtgtataagtttttattttgtgaatttacatatcccaaatgacaaatcactgttatacatggccattagagattgcacagtatgtttacttttctcttttaggtgacaaagctatttgaaggatgtgtgtggaaccgaatataacccagttaagcattattactagaaaccaatcagggacatatgtaactttgtcacctcgctgcctaaaacacttcactggttttaacttcagaggcctctgattctcctaaattatttgtaaatgtttgtgtgtacctcgtatgcctgtattttcagggtttagaatccatagatctcactagattttcaaagtcagtatgcaactcaaaagaagtttagaaagtaatgacatgcaggatacagcccacattcctcattatgacctccataacttgatctggcccttgcctgctttttcttttttttaaattgcatttatttaaagtgtacagcatgacgtttgcttacacacatgcatagtgaaatgattgctatagttgagcaaattgacatacccatctacaaacagagttgcctttatttttcttatggagagagaacctaaaatctactctcttagcaaatgttccatatacagtacagatttattacctggagtcctcctgctagtcattagatctctaaacattcatcctacagaatagcaactttgtaccctttgaccaacatctccccatttcaactatctccccatccctatttctatgtatttaactttttaaaattccacatataagtgagattatacaatatttttctttctgtgtctggcttattttacttaatgtctcatccatgttgtcataaatggaagtatctcctttttaaaggtcacataacattctattctgtacacacacacacatatagtgtgtgtgtgtgtgtgtgtgtgtatatatatattagttttaatattaatccataaatccaccattttagtccatgaatccaccaaatgacacttaggttgttcccatagcttggctattatgagtaaggctgccgtgaacatgggagtgcaggtacctctatcatgtgctggtttcgtttcctttggatatatatccaacagaaggattactgggtcatatggcatttctatttttaattttttacggaatctccattctgttttccataatagctgccccaccaatagtgtacaaaggttcccttttttttccacaccctcatcaacacttgctatcttttgtctttttggtaacggccatcctaaggagtgtgaggtcatatgatttggaattgcattttcctggtgattagtaatgttgagcttctttttatatacttgttggtcatttgtatattttcttttaaaagatgtctattcaggtcctttgcccatttttaaaccacttgagtttttttgttgttgttgttagtgagttatgtgcatttattatatatttgtgatattaaccccaatcagatatattgtttagaaatatattcccccagtccttagatagaaataaatggaaatatatcctttgtccatggtttagaagaattaatcattaaaatgttcatccaaagcagtatgtagattcaacgcattcctattcaaaattgcaatgacatttttaacaattctaaaattcaaatggaacacaaaagacccaaaatagccaaagcaatcttgaacaagaagaacaaagctggaggcatcacacttcttgatttcaaattatactgcaaagttatagtgatcaaaagagtatggtgctggcataaaaacaaacatctagaccaatggaacaaaatagtgagtccagaaataagtccaaacatataaggactactcactttcagtaaggaaaccaatgatactcaacagagaaaggatagtctctttaataaatgctattgggagaactgggtatgcacatgcaaaaaaaggaaattgaactcttatcttacgccatacacaaatatcaactcaaaatggattaaagacttcagtgtaagacttgctgtaaaattcctggaaaaaaagatagggaatgagctcctttacatgggctttggcagtgagttttgggttatgacaccaaaagttcaggcaacaaaagcaaaaataaacaagtagggctacatcaaactaaaaaaccttacttacttttctagaaagaaaatcatcacttacaactttcttatgttttagcattatgaagtttctttaaaactcccaaagcacttcacatgttttctcgcctcagtgactttgcacacgccattgtcttgtttctctgctgccaacagtggtctctattgtttgcccagcaaattgctgactgtcctttaaaacccagaacagaattcattccttcaagaagagctgatcattccttcatctgtgcaaccctgcctattatccataggtgttttattttattatgcagtcctaaaaatggtgctgctgaacttttctttctatgaaaaaaatgttctttgtgtattattcaggaaactaagcatatgacaaatacagtgtgtgtgtttatctttacatgtaaagttatcgagaagaatttaaattgagattttagctgtactcacagttgattctgattggctttttttttttttctgaatgtctttactcctgtggactttaaagtagtaaatgtgtatgacttcggtaatattttaaggtttaagaaagcaatctattcactcttggaaaaggtgaatttaatggtgcaattgccacctttggtgaacaattaaaagcagaattgaaagaatgttgaccatgaggtaatctcattcgatctgccaagggatattttttgctgtgagggctgggtgtctagtgacagtaaaccgtagtcacagataaggagagagggtggttttcagttggaaggaggtggtatcacatgactactctctgttggaatgaggagagagaattgagcttcacagagaaggtttagttttgaagtgtaactagattcaatacaatttcttcatttttgtgtttttttcttttcaataatatatttcctaggtgcttaagtgaatattttcagaaatagaacaaataaccgaagttttaaaataaggatattcagataaaagtgaggtaaaagaatatcatctgggccccttgtggaagagtcccctggcattgccacgcatgatgggagccctccaggggaagccccacagccagagccttgtcttctctggccatgcactagtgcagcatttgacatgatttttttttctttttatttttttgagatggagttttgctcttgttgcccaggctgaagtgcaatggtgtgatcttggctaactgcaacctccacttcctgggttcaagcaattctcttgcctcagcttcctgagtagctgggattacaggcatgggacaccacgcccagctaattttgtatttttagtagagatggggtttctccaagttggtcaggctggtctcaaactcctgacctcaggtgatctgtcttggcctcccaaaatgctgggattacagacaagagccacctcacccagccttgacctgatttttaaccagtgctctcagaggtggctgattagctcttaccacagcgacgtcatcacttttgtcaaaaccaaaagataattggtagggacggcagtacttccacagagtgttagtaggacacaaacctggctgcaccctccctaggctctgtggttctagtcatcagtcccttatgtgcacttgttggcaggtacttgatatactctgctcttatgtatttgcttatatgtcttctggatcatgagctccttgaaggcaggggctgttgctgaaacaatctttatttcaaagtctgccatgtggtcatagcagttaaatatttaatctagtgtaaattaatcatttaatttaatttaactttgtggtgccataaaccagacatcatctagtgtcagcatgccttgattaaagctacagagttttggaagaaatagaatttgtgtaactctcagtcttgatgatttgcttttctccaaagtaataagatgtatctgcaagtataacttggagagtggggagctctcagattctcattcttctccttggcattcttttgggcttttgggaagagcagcacttggtcagaccagtcatttttctttcagtgtgaagaaactaatcctcgctggaggctgactttgacagaaaatcactgcgagtgcctggaacgtgggttctgagtaggagtccatgagggctagttactaaggaagaaacagtggagagaggcaagtgtcaggatcaggagggcaaaggttgagatgggcctgctttcctagttcaactgcagtctagcgatgtccaagaacatttggacagtcatctcagacaggagcccagttatattctctgaatttgactaaatttggggacaaaaaaatatttgacaaactacctgttagaaatattttctgtgcccatgtaggcaagggtgacacatgcagcattgagtgagtgaacaggcaggtgcatgtagttctgcacagtcattctcaactattcttccctattctgtgatggatagtactcacacgtggtacactatctctcccagtaaagcacacagaggctggaggctggaggatattccctgtggaatagctgtaattctgcgttgccctctcctcttccagggaacatgttggaacacatggaaaagatgtcataacagatggaacttaaatgcaggctgagaagctcacatttccattgaaagcagttttctcgctaaggctggagatgagcagactttatatttttgtacctgaagttttgtacctactgaaatagacccttttgctctcaatggtccctcttagtgatgttgctgtagatcaagtaccccactcactgttctgaaagaagaatgtgtcatccatgtcagcctagcaggagtctgggacacagaaaccttgctgtgtatggttaggcaaaatgtatctcttatgtattgatttgattctgctttatgttttttcctagaagccaaggacttttctggaagaaagagaaatagaacacaaatatcatctctgaagtttacaataattaactagaatctgtttgatgcattagaagggtggcaaataaaaccagctaccaagaaaggtcaacagggtaccctaggaggaaactcaccatcagggagggatctaaatgagtgatttggatgtaacccagagcctagatattctcagaaaaaggctggatcaagacacaatttgtggctgtaccgtaccctttcctgatgcagttcccattattttactctttcctcctatcttctactgggaagatagctgcatgtatgcaaactcaaagagctgttgtctcagagcccagaactgttgggtgttgcgtcctgtggctgttgctgtaggacacccctggtcgagtgtactattaaagagtcaaacactttcatctgttacagagaaacattgaaggatcaatgctgtagacagcatattacacagggttgctggagtgccagctgtgcaaggatggctgggccttggttaccatggtgattccttgggcaagcagagcccagcttagagctgtgggatcacactggcttactgctcgctgggtcccagcagaacacggggcttgcaccacctgcccagaagtgagcagattagagatcagctgtcgtgggcacagctggttttgtgttctccagacagatggcagcagcagggaaacaccaaggagagctgattattcaggagtataaactacagtagagagtcttagcatgacctggatagaagtccagaataaaatctcactttccaaccatgtgcttggggacattgtcattacagtttgaatactggaggaaatatgactgtgttttcattaatgaactaataagttgattcattttttattgtatatatttatagtgcacaacatgaggtattcatacatgtagtgaatttattattacaggtaagtaaagtataggtacttaacttggagtacctttacttttatagcatgaaatactacccattctttaaaaagaataaaatcatgtcctttgcaggaacatggatataattggaggtcatcatcccaagttaattaaagtagaaacaaaaaaccaaatactgcatgttctcacttataagtcagatctaaacactgggcacttatggaaataaagacgggaacaatagacactggggactgctagaaacgggaagagagggcaagaaggactgaaaagctacctattgggtactatacttactatctgggtgatgggatcatttgtacttctaaccttggcatcatgctatatacccatgtaacaaacctgcacatgtacccctgaatctaaaataaaagctgaagttatttttaaaagtgatgaataaaaggatgagagagaaatatcattaattgcatgtatagatgagataactgatacttagaataatttgtccaatatcatacagcataagcaaaacactgtctttctgattgcatttttgtactatggtacattatctagagacatgcctcattcaaatacataatgcattaaatgttataatttatgtagaatagtgtattactttcatgttacaatttttttcagttaagatgaatctagtaaacataaaattaaagtgatttaattatatgtaaacattttcattttaaatgcttaatataaaattcacccccttaccaaattttcaatatacaatacaatattattaactgtagtctccctgctgtacatcagatctctagacttgttcagcatacatcatagcatttggactctttgacctgcatgtccccatttctttttctttccagcccctgataaccaccattctaactctctgtttctatgtatttgactttcatttggattctacatataagtgagatcatgtagtatttttctttctgtgattttgtttatttcacttagcacagtgtccttcaggttcatccatgtggtagcaagtagcagtgtctcctcctttttataaggccactgaatattccgctgtagatatataccacaatgtctttatctattcatccattgatggatacttaggttgtttccataacttggctattgtgaatgatgctgcaatgaatgtgagagtgcagatatctctaccaggtgctgatttaatttcctttgtggcaaaaccagacgcatataaaacttcaagctcagaatagctctactttgagatagaaattgaggataagaaagggaacttacacagacaattaatttctggccaggaaagacttcagggggccagctaagttcactcacagaggaataaggaaaatatcactttcagcttctagggaaacagtgtcttctgtattatttcagctcttaatttagttgatttttgaatttctcttctctgcttctgacacttagggtttattaggtcagaggacaagttgcagaagaaacatttttgttctccaatttgtgtgtgtgtgtgtgtgtgtgtgtgtgtgatcttatgattaagattgtcaaagggaagaaagttataggttctttaatagcacagggagggcaaaatgtacatagttttgaagaccatatgacctggatgactggaaaaatgagaaggaaataagaaaccaactgttactgagagcctgccatgtttgacactctacatattatttaaaaaaattcatatgacatgaaatcatctgctccttgagaacagtgaccatgtcttgttcaatgcactctgtgctgtgtgaggtacatggtaggtactcaataaatatttgttgagcttatacactcttggtgggaatgtaaattagtttagccactgtggaaagcagtttagagatttctcaaagaaataaaaaacaaactaccattctacccagcaatcccattactgggtatatactcaagggaaatacatccttctacaaacaagacacatacattcatgttcactgcagcactactcacaataacaaagacatggaatcaacctaggtacctatcaacagtaaactggataaagaaaatatggtacgtataccatggaatactacacattctttaaaaagaataaaattatgtctttgcaggaacatgaatgtggctggaggccatcaccctgagtgaattaacacagaaacagaaaaccaaatattgcatgttctcacttataagtgggagctaaacactgagaactcacaggcatgaagatgggaacaatagttactggggactactagagggggaaagggagagaaggactggaaagctgcctattgggtactataatcactatctgggtgttgagataattcgtactcctaaccttggcatcatcctatatacccatgtaagtaacctgcccgcctacccccgaatctaaaacaaaagttgaaattattttaaaagacttgaataaaaggatgagagagtgatatcattaattgcgtgtatagatgagataattgatactcaggataatttgcccaatatcacacagcaaaagctaaacactaagtctttctgattatattttcataatatagtacattattattattcaaataagtaatgcattgttataatttatgtagaattgtgtattggttttatgtgacaatttttttcatgaagacaacctagtaaacataaaactaaatatgatttaattgtatgtaagcattttcatgtaaaaagttctacaattcagaaaataaatctgtccaatcatgtatttttatttgatttggaaaataatatgactggggggcagggccaagatggccgactagaatcagtgtcagtcagagtcttccattgaaaagaaccaaaacagtgtgcgaatcctccactggcaacccagatatccaggttctgtcatcaggactgagtaggaggctggggtgacccacggagaggaaggaagagcagtgtgatgggcggcccacctgagagccataaggggcggaggagacctcaacccccagccaacggaggtggtgagtgagcacactacccagcctgggaaactgtgctttttccatgcaactgagcgacccacagatcagaagatcccactcgtgaacccaagccaccgtggcctagcgtcccaactatggagccatgcagattctcaacagccactcagctagaatctgcctaagcttgcccagttcttgaggagaggggaggccatcgccacagctgcagctgcctgctgtctaagccttctgggctccttggaggaggggcggcaggcaacactgggaatgctagctgcctaacacactatgctcccagggcaggggaagggcggcagccatctctatagctccaggccacgcttttcctctgctggagccaaggaggctggacggttgggtcccaagaggtattcgccacagcctaacaaaccggctgtggcagactacggccaaagtgcctcttcaggcctgaccttgacccattcctcctcactgggtggggcctccctgcaggaattccaacaactccaaccaggggctcagggacagaactctaatctccctgggcctgagcccatgaaggggtggccatagtctccgtggaccagcagacttggtcttttgttcttctagttctgaggaatcggagcagcccagaggagtaggtttccccacagcgaggcacaccccctctaccaagggacagccaaagtgcttcgttaaatgggtcctgcatcccatgccatccaactgagtgagatcctccaacagaggttgtcagacaccttatatgggagcatttctactggcatcacattggtgcccctcgaggtcagagatcccagaggaaggagcaggcatccatctttgctgttctccagtctcctcgagtgacatctccaggcacgggagtgaacctgatgaatagggcctgaagtgaactcccagcaaaccacagcagccctagagaagagggagctgactattaaaaaacaaacaaacaaacaaacagaaagcaacaacaatagcatcaacaaaaaagtccccacaaatcctcatccaaggatcaacagcctcaaagatcaaaactagacaaacttatgaagaagagaaaaaataaaaaaaaacacagaaaacccaaaaggccagagtgcctcttctcttccaaatgatcacaacacctctccagcaagggcacagaactggacggaggatgacatggatgaactgacagaagaaacaatagatgctggcaaggctgtggagaaatagaaatgcttttacactgttggtgggaatgtgaattagttcaaccattgtggaagacagtgtggcaattcttcagggatctagaaccagaaattccgtttgactcagcaatcccattactgggtacataaccaaaggaatataaatcattctactataaagatacatgcacatgtatgtttattgcagcactatttacaatagcaaagacatggaaccaacccaaatgcccatcaatgatagattggttaaataaaatgtggtacatatacactatggaatactatgcagccataaaaacaaatgagatcatgtgctttgcagggacatagatgaagccagaagccatcttgttcagcaaaccagcacaggaacagaaaaccaaacactacatgttctcactcataagtgggagttgaacaatgagaacacatggacacagggaggggaacatcacatatggggacctgtagggggaggaggagagggagatcatcaggacaaatagctaatgcatttggggcttaaagcctagatgacgggttgatagttgcagcaaaccaccatggcacatgtatacccatgtaacaaacctgcatgttctgcacatgtatccagaaacttaaagtaaaataaaaattaaaaacaacaataataatatgattgtaaagatagatcacgtttaaagagggcagctcactgtggtgtactggtaatttttgaacaactggttcccttctccctaaaaaaaacctctgtgtgtgtgtgtatgtatgtgcgtgtgtgtgtatgtatgtgtatatgcatatatattatatacacaatattatttattataaattccatacagccagttagttcccacagaatgcttttattaatttttaccaaactcttatctatagccaacctttgtttgcaactgatgaataagttagttgacacatttgtttatctcatgtaagacaaaagtcaaacaatgaagactcacgtctcggaaattcactgttttgtccatggtgtgagcaagttccctgttgaattgtgtaatagtggttgaatactagaaaactgtatttttcatttcagtgctggtcagtgtaataactacagacacacaacacacttctaagtttaatctgctttatcaacattttctctaccacttccataagtctagacagtcaataaaaaataaattgagccctgatttgtagtatttgccaattcccaccaggccaatttcaagctatccgagtgatgtcaccaaacacagatttgggaagaaatgtgcagtgacacagcattatgtagaactcgcaacttgcaactaagacataagtaacttcaaaagtataaataaataaaacacagtaattgataagttctagtaagtgatgagttctacacattattacttgaatttttaataatggctagttggtagagaatgtaaatcagtttagtttctacagcagtgacatcagattccaatgaaggggtgagaaaagaaagtgaaaaacagaagaaaggggaaagaaatatttgagcatgtgatgtgggctaggtactttccttacatgagctcctttagagtcctttctccaactttcgaatgaacaaaatgagtcccagcaaagcacctcctcctttgaccacaggacgctgcctcagaaggagagccaccagttcctgttgctcctggctgcttttctttgtgttccgtttcctctatttaactcaaattactgagaagtagtctgcttatgttttagttataagcctctgatggaaagctggggcagccacccactagggaagatagatggccagaccctctctcttcatctctctggcagccagaacttaggtgacccagcagggcctaatcagacatacatgcccagcacttgaacatgggagccgtggatggtggagaatttattccgactagtgtgaccaactgtcctgctttgctgaagacagagggggttctcaggagcccagactatcagtttaaaaccagcaaagagttttgagcataccagcgcaagtgggtcacctgctgctggagtctgggggtggcagtttcagcctcagtgtgcagggtcaacagtgactgcaggggaatctgcagcatctgcagtgcggcgttgaccaccctaagatcaagttctgagtcttgatttgggctgtggttctggctgccctccgttcatgcctattttcagaaactagttctgcatcttcccaattattctgtgaaccaactaataaccttgcaaaacctccttttctgtttaatgtcagccaaggcaaagtttctgctgcttgcagggaatagccctggactgacaccatgcttctctcagctttccttactgttgttccatctcccagcaatggctggctctggagttcattgttctgtgctccgcataggtgaagtctccagggaaaagtgcttctttctaaggcactgtcagacttacggaagtgatttatttaatagataaaccagcactgatgacttctaaccagttaaagctgattgttttttccagtcaggaattctggtaaaaccatatacctctatccatagtgttagtccctaattgccaggcatgggctgtagagtttaagtgggactagagaccaacacacgtacgataaacaatagaggtaggaaatatacctcaaatttcctggctattgattgattcataaaactattttataatgatccaaaggattaagcaacaaataaagtcattaaaatagtgtacttaaaagttgcactttgcaaaatgggtatgttatctaggtactcgtacactatttttgtactgctggtcctgtaccagaaacatttttttttccattgttacttgctttttaaactttgcttagccacttaaagaaaatctgcttgcacaatttgcctcaaatccactcccattgtgagctgattttttaatttttccaattaaaaaaatcacaatttatgccccctcccccccaaaactccttaaatcatagtgagacaaaccttccatgaggccagactatgcccttctcattcaatagggttagtattcaggaccaaaagagctaaccatctaagtttaaatacaatagaaatataatgccagccatgtgagaaaatttaaattccctagtaactacattttttaaaaagtaaaaagaaataggtgaaattcgtatatcattttgtttaacataatatgttaaaaatataatcgcttcaacttgtaatccatataaggatattaacaatatatcttacatttcttttctttaatagtgagacttcaaaattcagtgtgtagtttaccttcaagcacatctcaactaggacgaccacatttcaagggttcagccccatttgacttggggctgctgccttaagcagtgcaggtccaagatataagcccaagcaagacaagggttgtctccgcatcctccttcatgtgagatgtggcaaggcttgaaacctctctagctctgatgccttacagtaagattagtggctgtgttagattattgatgtttcatttgaacactgacaattttatgatcctatgctttctctcagcaactagtcttctggattttttcatttatcatccagccatcaggacttttacctaaattctagatacaatggctgattgttctgcaataacattttttattgttcctaaaaaagcttgttttgaatattcaaacataagttgtttgatattgagattttttaaaatgtaccttgccaaagaaaagggaatgcaggaatacagaagccaactaagatactcttactgctagtatttattctcttgccacagctttaaaagtgcaaaccagataataaaattatgaaacataaatggaaccaagcaagaagtctgtttgtttgtttgtatttttagtaaagatggggttttgacatgtggccaggctagtcttggactcctggcctcaagtgatccgccctcctcggcctcccaaagtgttcggattacacgcatgaaccactgtgcctggcctatatgtttttaagttacattattcacagaaatcgttaggcatgaatgtccttgtgggcatatagaaaaacatgatttcatgtcatttcaaaaacagaacccagactacttttgtgcagcatttcttaagacactttcccttgaagaaggaaatatgttagaggtgcgatatcttaagataagccttgagaaaaataaaatgaaaagaagtaggaagaaggaatttatgttttttttttaaaaagtgaggaaacattcaagttatgaaatattgctaagtgcatcacaacaagggttgcaatgacacagagaagatctgcagaatcctgcacaggaggctgtgtgctgggaatgtacactgttttactgtttttcagaggaggatgaatggaaggaggacttacagtcttctcagttgtatttggagcttagttctttgaccatgactttactgccataatttgataatgggcagaccataaagaatccatgcagtaaactctgcacggatgtgttcttggcacttagccattgtatctaaaatttaggtaaaagtcctgatgactggataataaatgaaaaaatccagaagactagttgctgagagaaagcataggatcataaaatcatcagtgttcaaatgaaacatcaataatctaacacaactactaattttactataaggcatcagagctagagaggtttcaagccttgccacatgagtcaaagggtaaaggcactatgtgttgtctttaaagagatatgccaattcttgccttgctcactgcaccacaatacttttctgtactgggaggagtaggctcagggaaaagaggctcttctctagccacagtgtgaactataatgcttctaagatggactgaggaatcaacaaatattcattctgtcaaatgagatgtaaaggcagatctgcacgagggcttcaggaaatgtttttctccctgataaaaagaggcaccaggaagatatagtttctttgtcttcctctccagaaggttgtgtgatggcctgaaaattgaagcaacattcatctttttgtagtcatgaaaagaaggccatgagaccacagggaaaccaagctagagttctgccatcagtgagtgctcaagaataacctggtctggagccatccaccccaaatctcttgtaatgtgggatacaaaatctctcattttatccaagactcttgtattgggattcttcaacttgaaggcatcacttggtaataaatactactgaggctactctagatgtgatgtatccctaccttctaggcttctctatggttggatctgcctctaaaccctgcctctagggttatatctcacagaccatagtcatgcaggaagtgtggtagggctttggccaacatgtatgaggtgaacacatctggctagcccgagttaatcgttttctgctcatcagcctgttgcctgatccacacaactatgattctgcttctatttcttctctagaacactagcttcctttttaggtgggcctcaggtaaaatctggccctgttgcgtgctaccttgacacctggaatgacaaggcctcctttccattgctttagaagtggtcatctgatcaattgtattaggacaacctagcggctttcaaaagtgtggatgcccggtctcctcccagctccccacagtccatcaggaagggtcatgtcagcaagcctcccagatgactcagaagtgggttaaagctgaaagttccacataccttctgactgttctctcaccgggcccatgcatgaatgaacataaaaccaggttcattgcctctacctgcctgggtttagaatacatccaccacctggatctcctcttgcttccttgtcctcaccaggtcgaacctgcctgagtctgtcatttcatctgagcctgcccttggatggccccactgccccaatggggcaagccccttggtggtgtccattccctcagtcccatcctttctgtcttcatctttctctccagtacctgtaattaagctcaactcaattatgtcatctcccagatgtccactgataccgtgtccccatgaatgacctctatgagttaatcaaaggaaactcagattttaaaaaattgcttaaaataaaagtataagccatcaactaatgttcggtgcatgagctgggtcagcactgctcaactacttgaagaaatcaagatgcctttgatgtccttgtttattttgctttttgttcctctaaaaaaaatctcttaagagaagaaaaaattatattttgcctattttaaaaataacagaattaagataatctatggtttgcccgaagtcacgcagtactcatttgagccaaaatctcattgtccaactggtcccaagagtcctttcaagtaacttcgtcagctgtcctttgccagcatgtaatgcagtgatgcaatgctctggtagtaatttggaacaatccaggaagcaatattctcagtgttcaaggcccggcactgcccgggggaaattaaaccttatctaccccagcacatgatgcatgccattctccttgagagggcttttctgctgctgcaacgggaaaatgcaatcagtttcacccatcactgagttctacagacttttgtgtttttttttaatttactaataatagggcaattaatgtaattttaagaagttttctttcctttaaaaagaggctggcctgtgctcctaattaaaactgcttttcacactctgaacaaggcttcagatttcgattggcaaaatcccatagcgcttggcctagagggtttatttttaagggtctggtgagattttgagtaaaaaatgattagtgaaattgctcctcatcctaactagagcctgcaaaacagcgaagagttctgtagtcactggtgtattcatgacaaagtaattatttttctacttagccagaaggaaatgggaggtttctttgaaggcttgagatctgcttcttagaatgggagaccgaaatctttaacagctaatggtatttgtttgagttctttgaactgtcagagcataaattaggtcaccacaggtcccatttcgactggagcattcaaaaccagtatatcctcatggccattttgagagttatcatgtaaacaagcaaaaatcttccatcttcagaaacccttgtttgatgctatattccaccaactcctgccctcttactctgtccttctcttcaaggtcaatgaacagtttttaagccttagcttctttttcctcccagcagcatttgaccctgttgatcatgcctttcttgaaatccccttgttcttttgattccttaacaattattctcactggttctcttcagtcccattgcccccagttccaaatccaagtgcttatccagccaatttttgctcttctccaaatgtaagctgtcagcccacagctaaaagagagatgaggtgagatcacagggattaggagttgtttgataaattgtgttttctttagtagatatattcaatagaactctctctgattgagcacttgaaatgtggccaacgtgattgaagaagtaaattgttaaatgtaatttaatttaaattaattgaaagagccacatgtgacaaatggctattttattggacagtgttttgtgaagtcttgccacataaaatgtggtccatgggccagtggcttctgcatcacctgggtgctggttataaatgcctactctcaggctcctccctggacctacagactcagaatctgcatcttagcaagatcaccagatgattcgtaagcacaataatatttgagaaatagtgctttagaagtttaacttttaaaccactagagtgacagacatgtgtacaacttctggatattattataccctgaagaaagtgctttctgtgaattcttacagagtcctccttgtcacattaatcagatatattgttgattatatcttgattgacattcctctggatgtcaaaattctaagataattgtttctgtaaacagttgagtttaatctactgatctgagctacatgtcattctttagtccagagtatatcatttgttagaaaaaatgccagctcccttcctgtgctctggggaaataaatagtttctttctttcataaagacatagaataaagaagatgaaaaaaattaaacctcattgtacagtaacctgtaaagaggtcacttgcttcttctatactaaaatcagactggtactctaaggcatgagtgaagatttgcacaaaacatttaaggatctaagactaaaaagaagatcagagaaaaagtctacattggacaaaatgttttttcattcattttatttactttttaattttgaatttttatgggtatgttggtgcatatttttatgaggtgcataagatattctgatacaggcatacaatgtgtaataatcacatcaaagtaattggggtattcatcacctcaagcatttaccctttctttgtgttgtaaacattccaattatgcttttacttattttaaaatgtacaataaattactgtagactgtatgtgtgtactagatcttattccatctatctaactatatttttgcacccattaacaattgaccattcccactctgccccctgccacttccccactaccctttccagcctctagtaaccatcattctactctctatcttcattggttcaattgttttaaattttagctcccacaaatgagggaggacatgtgaaatttgtctttatttgcctagcttatttcacttaacataattatctccagttacatccatattgatgaaaataacaggatctcattcttttttatggctgaatagtactccattgtgtatatgtaccacattttctttatcccagatttctttgagttgtatcccaaaagcacaagtatcaaagcaataatggacaacagggatcacatcaagttaaaaaaaaatgcacagcaaaggaaacaacaaagtgaagagacaaagaatgggaaaaaatatttgcaaactgtctgtctgacaagtgattaatagatacaatgtataaaggagctcaagcaactcaatagaaaaaaatttgttaatgaacacttagattgattccaaatcttggatattgtgaatagtaccacaataaacatgggaatgcagatatctctttgatatactgattttcttattttgggtaaatgcttatctgtgggattgctggatcatatgctagttttatttttagtttttttaaggaacctccgtactgttctccagggtggctatgataattcacattttcaccaacaatgtatcagggttcccattactccaccaccgcaccagcattcattattgattgtcttttggataaaagccattttaactggggtgagatgatatccaattgtagttttgatttgcattttctctaataatcagtgatgttgagtaccttttcatatatctgtttgccatttgtatgtcttcttctgataaatgccattttaaattagattattatattttttcctatttttttaacttgatgtgctccctcttgaccattatttgatactcatgcttttgggatattactcaaaaaatctgtgcccaaaccaacgccctggagagttttcccaatattttcctttagtagtttcatagtttgaggtcttagatttaagtctttaatcaattttgatttgttttttgtatgtgccaagagatagtggtctagtttcattattctgaatatgaatatcctattttcccagtaccatttattgaaaagactgtgctttccccaatgcatattcttggcacctttcttgaaaataagttcactgtagatgtatggatttatttattgattctctattctattccattggtctatgtgccgattttaatgctagtactgtgctgttttggttactatttctctgtaatataatttgaaatcaggtatgtgattcctccagttttgttctttttgctcaggatggcttcggctatttggggtattttgtagttccatataaattttaggtttttttttcctacttctgtgaagaatatcattagtatttatttatttatttttatttttttgagacagagtcttgctctgtcacccaggctggagtgcagtagcatgataatcagctcactgcaacctctgcctcccaggttcaagcgattctcctgactcagcctcctgagcagctgggattacaggtgtgtgccaccatgcccggctaatttttgtatttcttagcagagactgagtttcaccatgttggtcaggctggtcttgaactcctgacctcatgatctgcccatcttggcctcccaaagtgctgggattacaagcgtgagccaccacacctggccaatatcatcagtattttgataaggattgcattgaatttgtagattgctttgggtattatggacattttaaaatactaattctttcaatccatgaacatggaatattttttcatctttttgtgtcctcgttaatttcttgcatcaactttttacagttgatatggtttggctatgtcctcacccaaatatcttgaattgtagttcccataatccccacagggacttggtgggaggtaattgaatcatggaggcagttatctccatgctgttctcctgaaagtgagtgaattctcagaagatctgatagttttataaggggattttccccttttgcttgggacttcttgctgccaccatgtgaagaaggatgtgtttgcttcccctcccaccgtgattgtaagtttcctgaggcctccccagccatgctgagctgtgagtcaattaaacctctttccttcataaattcccagtctcaggtatatctttattagcagcatgagaacagactaatataataaattggtactgcagagagtggggtgctcctataaagatacccaaaaatgtggaagtgactttggaactgggtagattggaacagtttggagggctcagaagaagacaggaaaatgtgggaaagtttggaaattcctagagacttggagggctcaagagacagggagatgtgggaaaggttggaacttcctagagacttattgaatggctttgaccaaaacgctggtagtgatatggccaatgaagcccaggctgaggtggtttcagatggagataaggaacttgttggaaactggagtaaaggtcgctctttctatgcaaaaagactggcagcattttgctcctcacttagagatctgtggaacttttgaacttgagagagatgatttaggatacttggaaaagaaatttctgaacagaaaagcattcaagaggaggcagagcataaaagtttggaaaatttgcagcctgacaatgcaatagaaaagaaaagccaatattctgcagagaaattcaagccagctgcagaaatgtgcataagtaatgaggagccaaatgctaatcatcaagacaatgggggaaatgtctccagggcatgtcagagacctttttggcaacccctctcatcacgggcctggaggtctaggaggaaaaaatggttttgcaggctaggcccaggacccccctgctgtgtgcagcctagggaattggtgccctgcatcccagctgccccagccatggctaaaagcggccatggtacagctcaggccgtggcttcatagggtgcaagccccaagccttggcagtttccacatgctgttgagcctgcaggtgcacagaagtcaataattgagatttgggaacctccacctagatttcagaggatgtatggaaatgcctgtgtatctaggcagaagtctgctgcaggggcagagacctcatggagaacctcttctagggaagtgcagaagggaattgtagggttggagaccctacacaaagtccccactgggactctgcctagaggagctgtgagaagagggccactgtcctccagaccccagaattgtagattcactgacagcttgcaccatgcaactggaagagccacagatacttaatgctagcctgtgaaagcagcaaggaaggaggctgtatcctgcaaagccacaggggtggagctgcccaagaccatgggagcccacctcttgcatcagcatgacctggatgtgagacatggagtcaagatcattttggaactttaaggtttaatgactgcccttttggatttcagacttgcatggggtctgtagccccttcattttggccaatttctgccatttggaatgggagtatgtacctccattttatctaggaagcaactaacttgcttttgattttacaggctcatgggcagaggggacttaccttgtttcagataagactttggacttgcacttttgagttaatgctggaatgagttaagattttgggggactgtttggaaggcatgattgtgttttgaaatgtgaagacatgagatttgggaggggacaggagtggaatgatatggtttagctgtgttctcacccaaatctcatgttgaattatagtttccataatcgccacatgttgtgggagggacctgatgggaggtatttgaatcatgggagtggttacttccatgctgtcctcctgaaagtgagttctcacaagatctgatagttttataaggggcttttccccttttgcttggctcttctccttgctgccaccatgtgaagaaggacatgtttgcttccccttccaccatgattgtaagtttcctgaggtctcttccagccatgttgaattgttcccattaaatcttttttcctttataaattactgagtatcagtaatagttataataaaataaatttcattatagagacctattacttatttggttaagtttatacctatgtattttactttacttgcagctattgcaaatgggattatattcttaatttctttttcagattgtttgatgttggcatatagaaatggtactgatttttgtatgttgactttgtgccctgaaacgttactgaatttgtttatcagttctaatagtttttctggtggagtctttaggtttctccaaatataagatcgtgttacctgcaaacaaggataatttgacttcttcctttccaatttagatccactttatttctttctcccatatctttgctctagttgagacttccagtactttacttaatgacagtggtgaaagtgggcatccttgtcttgtttcagatctcgaggaaagacttagttgttcctcatgctgtatgatactagatgtggatttgtcatacatgactttttttgttgaagtagtttcttctttatccagttttttgagagatttttatcatgaaggggtgttgaattatatcaaatgttttttcagcatcaattgtaatggttatgtgatttttgtcctttattcttttgatatgatgtatcacattgattgatttgcatacattaaaccatccttgcatgtctggaataaatcccacttgattataatgcatctttttaatgttcagatgaattcagtttgctagtattttgttgagaatttttgcataaattttcatcagagatactggcctatctctctctctctctctctctctctctctctctctctctctctctctctctcattttttgatgtgtttttgtctggttttggcattagggtaataatggcttcatagaatgagtttggatgtattccctcctcctctatttttcagaatagtttgagtaggattggtattagttcttctttaaatgtttggtaaaattctgcagggaagccatgaagtcccagagttttctttgctaggagatttaatttcattacttgttggtgttctattctgaatttggatttcttcattggtcaatcttggtagattgtatgtatctagaaatttatcaatttcttttggtttttccaatttattggcatatagttattcagaatagtctctaatgacttttgaatttctgtggtatcagttttaatatctcctttttcatctctgattttatttatttgggtcttctctcttttttttcttagtctggctaaagatttgttgattttgcttatctttaaaaaaacaacttttcatttcattgagcttttgtgttgtagtatttcttttcttctaataattttgggcttagtttgctcttgtttttctagttgtttaaaatacatcattaggttgtttactgtttattaggttgtttattgattattagcttgcttattgaaaagtttctacttgtctgaggtaggtgcatgttgctataaacttttcttttagtatcgcttttgttgcactcctattggttttggtatattgtggtttcattttaatttgcttcaagaaatttttaaatttccttttttttttttgagatggagtttcgttcttgttgcccaggctggagtgcaatggtgcaatctcgacacaccacaacctccgcctcctgggttcaagcaattctcctgcctcagtctcctgagtagctgggattacagacatgtgccaccacgcactgctaattttgtatttttattagagacagggtttctccatgttggtcaggctggtctcgaattcccgacctcaggtgatgcgcctgcctcagcctcccaaagggctgagattacaggcatgagccactgtgcctggcctaaatttacttcttaatttattaattgaagcattggtcattcagagcatattgtttaattaccatgagtttgtatagattcccaagttcttcatattattgattgtagttatattccattattctcagagaagttactcgatatgatttcaatttttttaatatttaaagacttgttttgtggtctaacatatggtctatccttgagtgtaatctatgtgctgagaagaatgtgtattctgcatccattggatgaaaggttctataaatatctattatatccatttggtctatagtgcagattaagtccaatgtttctttgttgatttgctgtctcaatgatctgtctgtccaatgctgaaagtggagagtgttgaagtctccagctattattgtattgcaatctatctctctatataggtctaataatatatgctttatatatctgggtattccaacagtgggtgcatatatatttacccaatatcctcttggtgaattgacccctttatcattatataacaatctttgtcttttttataagttttgtcttgaaatctattttatcttatgtaagtatagctacttctgtttttatttttatttgcatagagtatttttctagccttttattttcagtctatgtgcttctttacaggtgaagtatcttgtagatcattggatcttgttttttttttttcaatcctttcagccactctatgtcttctgattatataatttagtctatttatattcaatgtttttaattgataagtaaggatttagtatagccactttgctatttgttttctggttgtttcttggtcttgtcttccttcctttctttctgtcttctcttttctgaaagtgattttctctgatggtatgttttaatttcttgcttttcattttttatgtctgttacaggttttttgatttgaggttccatgaggcttgcacataacgtcttataaatcattatttcagctgataaaactttaactgactacaaaaacaaacaaagagaaaaactaatgaacactctatgctttaacttcatccacaccactttataactttttactgcttttctattgatatcttattatactatctctgcattaaaaagtcattgtagttattatttttgataggtgtgacttttagtcttcctactcaagatatgaataatttacacaccacagttacagtgatataatatcctgtatttgtgtactcattattaccagtgagttttgtaccttcaggtgatttcttattgcctgttaacatcctttcccttcacattaaagaactgtccttagcatttcttgtaagacatgtctggtgttgatgaaatccctcagctttcgtttgtctgggaaagtctttatttctccttcatttatgtagggtatttttgttggatgtactattctaggctaaaagttttttcccttcagcactttaaatatgtgacgccactctcttctggcctctaagctttccaatgagaaatctgctgccaggtgtattggagctcctttatatgttgtttgtttctttcttttgctgattttatgaatctttctttatctttgacctttgggagcttgattattaaatgtctttaggtattcttatttgggttaaatatgcttggtggcctataccattcttatacttaaacatgaatatatttgtatattttggaaaggttctctattattatccatttgaataaacattctaccctgatctctttctctctgcttccttattaaggccaataactcttagatatgcccttctgaggctattttctaggcttgtaggcatgcttcactctttttttcttttgtttaatctgtgtgttttcaaatcgcctatccttaagcacactaattccttcttctgcttgatcaattctgctgttgagacacagtaatgcattctgcagtttgtcaattgattttttaattccagaatttctgcttgatttaaaaaaattatttcaatctctttactaaagttatctgataggactctgaattccttctctgtgttatgttgaaattcattgagcttcctcaaaacaactgttttgaattctgtctgaaaggtcacatatttcggttactctgggatcggtcactggtaatttatgtagcttgtttgatgtagtcacatttacttagatgattttgaggcttgtggacattcactgatatctgggcattgaagagctagatatttattctaatcttcacactctgggcttatttgtacctgtctttcttgagaaggctttccaagtattcaaagggaattgagtgttgtgatttaagtctttggtcactcactgcagccacatctgcattaggagacaccccaagcccagtaacaatgtgacccttgcagacttgtaaaagcatcattttggtggtcttgggtaagatctgggtgaattccctgaattcccaagcattgtctctggttcactttccatacttttcccccaaacaaatggagtctccctgtctgtgatgagctgcctggagttggggaaggggtgatggaaccactcctgtggcctccattgctgggtcacacctgaagccaacacagtacggtctcacccaaggcctgtggagactgttgcctagctatcactgatgtttattcaaggcccatgggctctttagtcagcaagtggtatatccttccaggcctgtgtcttttccttcaggtcaacaggttcccttctggcccaggattgacctagaaatgttatctggggaatagggcctgaaatcaggaatttaaggagtctacttggtgctttattttactatggctgaactcatacccaagttgcaagacaaagtccttttactcttccctctcctttcctcaagcaagagtctctccctgtgtctgccactgccctggcccatgctgactactgcctagctactgctgatgtttatgcaaggcccaagggctctttagccagcaggttgtggtgaatcctgccaggactgagtccttcctttcaggacagcagattcctttctggcccagggagctagggcctggaacaggggcttcaggactctgcttggtgctttattttactgtggctaagttgatattcaagctacaaaacaaagtcttctttgttcttccctcaagtggaagaagtctcagagctgtgtgctgtgatgcctggagttgggggaagggtgatgaaagcaatctcttggccctgacatctcagctggtgtctcactaggtcacatgcactccaagtccactggagtgcccaggaattgcacttcttgtgacctagactatctttctttcaaatttatttaggaccctgagcactttaacctgcagtggtgaagctaactgaagctcaggttcaggccactaagatgagcgattctcctctggaatgctccctccatgggcaaaagctggattctgcctggtgttgctctccattgttacagggaagcactgatttccaatgcaaagccccacaattactcacttttcctcctgcaagcacacaaattatctctccatgctccacatggtgctgtggaatgatgggaaaggtgtgtttcaagactgtctttcttaccctcttccattcccctttccttgatctgatgttaaaaccacatactgtgattgctcacctgaattttgcttcttaagaaggtgatttcttgtgtggataattgttcaatttgatattcctttggcaggatgataaattgagggctttatttagtcatcttgctcctccctctctcattcttgattgaatgtacccatgctatgggatgcttccaaagtgttaagatatacaatgccctcaactgtgaactgggatcagaaaacaattgacttttatttttcactcatctataactaaatctgtcatttccatctattataaatatagacaaaaaaggagaattgtattagagaaaccagtgtctctgtcaccagtaggaatcacagatcatttaacattacactgcaactgtggcaaattctcagaataccatttatgcaaatcatgacttcaatattacagtgaccattaaacctgtcactagatactgtatttactatactaataaagaaacacatatattaatattaaaataaagatatacagtgccctaaaaaggctgtctttggaaatggagaaacctccagctgtaggggatttgagagatccctttgggtaccagttctggttaagaaaggaggatggactgagaatctcagagccagggcatttcaatactttctactcaggctgcctctctgggttctgttccttccctgcaaaataatgtatatggatttgatagagcctttttttaggtcagttctcctcacattcaacactgatcccagaaaagttttgaaaatgaagttaagaatgattaaatagctatctacaaaagaagggttattccacgactattctcagaaaatcatgtatagttagaccatcattgaaaatattgaattacttgaacaaatatgtgcaaggcattattctgggcattgggaaataacaataaacaatatagttagggccatgtggaatatattgttagaaaagtgttagctaaatcagcaactgctaattctcaaacctgtttaccctccctgtttacactgatcaagactataaaatgccaggtgggggtgccttgtttgattttaaagtatagtgactaagtccactaagatattggaggcagaatatctcagcagaaggcggacaaggaacccatgccaagtaatagggcaataaaaacatctggtggaaagtcatatgcaaagaattcaaatagaataatgtgatagtgcttgagcagtttcctaacactgtggcagtcaaagcagccttccccaagtaggtgccattaatactgagaatggaatgaccagggactgccccacatgtggaagtgagaaaagcactccaggcagagaaacccacaggtggaaagatcacaatgcacaaagagctgggtgggctccaggagcaaaataaaatccaagggatggagcgtggcatggtaggaattatggtcaagcatataaaaggaggatgtcgtaggccagcataaatctctctctgtattcattagagatcccttctagtggctaatctcaactctcttgctgcacttaaaatcatttatcattttgttagatgtagagagcactcttatagggcagggtatgcatttataaatatttgaagactaatatccacagctttcaaccatccaagacttttgtgtgccaactatgatttcattatttgagactatatctagactagaaaataaatgccagataataattttttttttaacatgcttgttttcttggtcctatggatgctcagaaatgctgccttggatcaccttcctctgggggaggagtgagagagacagaatgtcctttgtgggccttcatctctcatctgcaaagtggaagacagggatgggataacctatctggacacttctcatttgaaatctcatgtctcaatggaagaaaggtctattgtaccattgctgggaaatctccgttttgtggtttctcctcaggctacctctctgggttctgtttcttccctgtaaaatactttagcaacagaacccagagagtcagcctgagtggaaagcactgaaatgccctggctctgagattctcagtttatcctcctttcttaaccagctctgccacccaacgtgaccatctcaaatccactacagctggagggttctccaaattccaaagatggcctttttagggcactgtgtatcttaacactttggaagcatcccagagcatggatacattcaatcaagagtgagacagagtgagacatgcacatacgcagagaaggaaagatgaataaagagagatactttatgaatgtaggtgcctagtgtgaagagcctacacactactcctagtttctaggttggctaagactctgggattttttagatcaaacagggcaccaagcctggcatctcaagtttttggctaatgacttttgagtgtaaacaggtttggaaattggcagttgcagattttgttaccactttcctaaaaatacttcagagtggcaatttaaggactctagagaagaaaagtgacctccacccattctttcaggagcagagattgcccagcaatggccatttcaaatggcacttccatggaaaaggagaagtgagcaagttggtggcatctccagcagcatttgctttggacttgcctcagccgaggacagattgactttgtcttctgaaaatgaaattaggctaatcatttatgttaatgttttaatttaacagtttagagggggaaaataattatgtttaaagaattttaattctctaggatttaaaaataaacttctacttaaaggttaagttccaactcaaaaataagattccagatagcaaaaagaaggtggaaaatgaagccatagatagttaatgtgtctgccagagactatctcaaattccttgccatgtgtacatcatggggcagtggaaataaagacttggaacacaaaccctggttttcatctttatcttctccctaagtagccctgtggccttgtggtaaattcctaaactccgaattggggtggcttcatctcttaaataagagaattatattattctggagtaaattatttctgagctctcgtattaaggaattgttagttttctttaaaatcttggcactacccaagaaaaaagtgctgaattctgagtatagtaagaaaatatatgaaacacctgcattcttctagctgtgttgcaaatgcaatatgtacagattttagtactttgaaatcgtaatatcatcaatgtgaacaattaaagtttgtgttggtcatagttccaaattgtagctgatttttatttttatactccactcttggtcacatctaacttatttcttagtttgtcctttgttagacaagcaatccctaaatatagcacggtttctatgggaacatacattctcctgaagattccaggaacacgttttatctgaaaaataaggaactgtcagataatacgtccaaattcaggactataacccaggttttatatttttgaattaatttcatttaagtagagttgtttaaaattagttgaaaaattggtttcatgtgaaattttccagctgagttgaattggtacatatttgattttgataataagaattaaaatcttatcttttattgagagctttttttgaaataattaagcatatggctccataacatttggattctgttgttttacatctctgtggccacaagcactgttggatgattgtggagcagatggcacaggtggggacaatacttactcttttccaaagcaaatgagaactttatcagttgttacctaaacgtaggccataacgcacttgcattatgcatttttgtccttttgaattcctgtagctgagcaataatatgatttggtgctgagttttcctgtaactgctagttccttccatctttagggtgtagtcacccaatacttcctcaaaagtatgccttgatgtcttagcacagctacagatgactgtgaagttagggcagaaagtgagaaggttgacatatgaaaattaaaaacttttgaggaaaacaaccctcattgttgaagttacatcaccagaggattggacttcaaagaaaaccatatgtccaaatggcagttgatgagagaagggacctttgaaaatggaaaattatagttataaatattggacgcttactgctgagaatacaaaagtctcacaggaagtcatgccacaggtcgttttcattctgaatgtgaaacatttggggcaatacataaaagtacaatgagaaacagcattgaaaaataccttttaagtgtttcattttaataagaaatatttctgaaaataagacattgagagtgaaaatgaagcatttacttatgagaatattctcgaatgtgtttcaccactaactgtagagataaacattcctttgtggctgggatggctcatctgggctcttcattttcactgttcctccttgtgagccttcagtctaaagctattctctcgcttcctcatttttcacatggttttaaagactgttgaggttagcgaagtcttggttccagtaaactgctctcattgcctgccctgatcatgattagcaaatgactatggtaaattatatccttataaaagataatattaggagtaatattcccctgaaatactatgaaaaatatcacacggtgtacatccactgtgatattaggagtaaattccccctaggatattatgaataatatcacagggtataatatcacacccactgtgatattaggagcaatatccccataagatattccaaataatgtcacaggatgtacacaacaggtgtacatccactatgatattaggagtaatatccccataagatattacaaataatgtcacatggtgtacaaaccgagtgtacacccactggaatattaggagtaatattcccctaatatattacgaataatgacacagggtgtacaacattggtgatattaggagtaatatctcactaagatattacaaataatatcacaaggtgtacacccactgtgatattaggagtaataagcaactaatacattacaaataatatcacagggcatacacacaagttgtacacaaactgtattattaggaataatatccccctaagatattatgaataataacacagggtgtacacccactttaatattaggagtaacatccttctaagatattatgaatgatttcacagagtgtgcacccactgtgatattaggagtaatatctccctaagatattatgaataatattacagggtgtacacaccgtgaggtattcgtagtaatgtccccctaagatattacgaataatatgacagggtgtacatccactgtgatattaggaagaacattccccaaagatattaagaataatataacagggtgtacctccactgtgatattataaaaaatatcttcctaagatattatgaataatatcaccagatatacacgctggtgtacatttactgtgatattaggagtaatagccttctaagatattatgaataataccaacgggtgtacacaccaggtgtacacccactgtgatattaggagtaatgtcccttaagatattaggaataatatcaaaaggtatacacacactgtgatattaggaggaatatccccctaagatattacaaataatatcacctggtgtaaacccactgtaatattaggaggaatacccttctaagatattacgaataacatcaccaggtgtacaccaactgtgatattaggaggaatatactcccaaaatattagaaataatatcacagggtgtacacccgctgtgataccaggaatatccccctaaggtattacgaataatatcactgagtgtacagccactgtgatattagaaggaatatcccccgaagatattatgaataatatcacaggatgtatacccactgtgatattaggaagaatatcctccaaagatattaggaataatatcatagagtgtacaccctctgtgatgttaggaaaaatatccccctaagatattacaaataatatcacagggtgtacacccattgtgatattaggaggaatattttcctaagatattatgaataatattacagggtgtaaacccattgtgatattaggaggaatatctccctaagatattaagaataatatcacaggctgtatagtcgttgtgatattaggaggaatattcctgtaagatattatgagtaatatcacaaggtgtacacacattgtgatattaggaaaatattcccctaagataataagaataatatcacagagtgtacacccactgttatattagaaggaatatcctcctaagatattacaaataatacacagagtgtacactcactgtgatattaggaggaatatccttctaacatattatgaataatatcacagggtgtacacccactctaatattaggaggaatatcctcctatgatattacgaataatatcacagtgtgtacaaccgctgtgatattagtagaaatatccctttcagatattacttataatttcacagattgtacacacactgtgatattagaagaaatatctcccaaaatattacaaataatactgcagcatgtacaccgcaggtgtacacacactgtgatattaggagtaatttccccctaagatattagaaataatatcactgggtgtacacccactgtgatattaggtgtattatccatctgagatattatgaataatatcaccggctgtacacccagtatgatattaggagtaatatccttctgagatattaagaataatatcaccgtgtgtatacacgcttctatattaaaagtaaaatccccctgatatattacaaatactatcactgggtgtacacccactgtgatattaggagcactatcctcctgatattataaattacttttaataccactgtacacccactgtggtattaggagtaatatccctgtaagatattacgaataatatgagcaggtgtacattcactgcgatatcaggagaaatagcctcctgatatactacgaataatatcaccaggtatacatccactgtgatattaggaaaaatatccccctaagataatacgaatagtatcacagggtgtacacccacagtgatattaggaggaatatccccctaagatattacgaataatatcacagggtgtatgtacattcacagtgatattaggaggaatatcttcctaagatattccgaataatatctcagggggtacgctcactgtaatattaggagaaatattccctgaagatgttatgaataataacacaaggtttacacccactgtggtattataaggaatatccatctaagatattacaaataatatcaccaggtgtaaacaccaggtgtacacccactgtgatataaccgggggtacacccactgtgatgttaagagtaatatcccctgagatattactcctaatatcaccgggagtatacacccactttgatattagaagtaatatttttcaaatatattactcctaatatcactgggtgtacgcatcgggtgaatattcactgtgatattaggagtaatgccactctaagatattgtgaataatatcactggttgtacacactgggtgggtacaaatatctttctaagatactactcctaatatcagggtgtaccagttgtacacccactgtgatattaaaagtaatatttccctaagatattatgaatatcatcactgagtgtacacccactgtgatattaggattaatagccccctaaggcattacaaataatatcaccgggtgtacacactggtcgtacacctactgagatattaggagtaataccccctaagatattacaaataatatcataggttgtccacacactgtgatattaggaggaatattcctctaagatattttgaaaaccatcattgggttcccccctccaataatattaggaggaatacctctctaagatattacaaataatatcaccaggtgtacacccactgtgatattaggaggaatattgccctaagatattacaaataatattgcatggtgtacactcactgtgatattgggaaaaatatcccactaatacattacgaataatatcacagggtgtacacccattgtgatattaagaggaatcccccctaagatattacaaataatatcacagggtttacacctattgtgatataagaaatgccttcctaagatattactaataatatcacagggtgtacacagcgaataatatcgctgcgatattaggaggaatatccccctaagatattacaaataatatcacaggttgtacacccactgtcatattagaagagatatctccctaagatattatgaatatcacaggatgtacacccactatgatattaggaaaaatatccccctaagacattatgaataatatcagtgtgtacacccaatgtgatattagggggaatatccctgaaagatattatgaataatttcacagggtatatacccactgtgatattaggagaaatatccccctaagatattacaaataatatcaaagggtgcacaccactgtgatattagcaggaatacccccctaatatattataaataatattacaggatatacacccactgtgatactagaaggaatatcctcctaatataatatgaataataatacagggtgtacacctattgtaatgacaggcagaatatccccctaaagtattacgtataatatcacagggtgtacacccactgtgatattaggataaatatctcccaaagatattacaaataatacgacagggtgtatacccactatgatattaggagaaatttccccgtaagacattatgaataatatcacagggtgtacagccactgtgatatgaggaggaatatccccctaagatattccttataatatcacatggtgtacacccactgtgatattataaagaatattattttaagatattatgaataatattacagggtgtacactcactgtgatatcaggaggggaatccctgaagatattacagggtgtacacccactgtgatgttaggaagaatatccccataagatattatgaataatatcaccaggtgtatatccactgtgatattagaagtaatatccccctgagatattaccaataatatcactggtgtacacccacagtgaaattaggagtaatatccccctgaaatattgtgaataatatcacgtgtgtacacccactgtgacattaggagtaatatccccctaaggtattatgaatagtatcaccgggtgtacacccactgtgatattaggagtaatatcctcctaagatactatgaataatatcaccgggtgtacacccatggtgatattaggagtcatagccttctgagatatgactcctgataacactgtgtgtacatccactgtgataccaaaagtaatagccccctgagatattactcctaatatcaccaggtgtacacccactgtgatattagcagtaatattcctctaagatattacaaataatatcagtgggtgtatacccactgtgatatgaagaggaacatcctcctaagatattacgaagaatatcaaatggtgtaaaccccgggtgtacacccactgtgatattgggaggaatatccccctaagatattaggaataatgtggacacactgggtgtacaacgactgtgagaggaggaagaatatccttctaagatattatgaataatatcatagggtctacaccccgggtgtacacgcactgtgatgttaggatgaatatccttctaagatactataaataatatcacagggtgtacacaacgcatgtacacccactgtgatactaggatgactacacccctaagatattacgaataatatcactaagtgtacacacctggtgtacacccactattatattaggtggaatatccccctaagatattatgaataacatcacagggtgtccacatactgtggtattaggagtaatatccccctaagagattacgaataatatcacagggtctactctcactgtgatatttccagtaatatttccctgagatattgcaaataatatcacagggtgtacacccactgtgatattaggagtcaacccccccaacatattatgaataatatcatagtgtgtacattcactatgatattagcagtaatatccccctaaggtattacaaataatatgacagggtgtatacccactgtgatattaggagtaatatcccccgaagatattatgaataatatcacagggtgtacacccagagtgatattagaagtaatatcccccaagttattatgaataatatcacagtgtgtacacagcaggtgtacacccactatgatattaggggtaatattcccctacgatgatattgcaaataatattacaggttatatacccactgtgctattaagcacattgtaacaggaaaagaacaagtaaatagtttgtatagccatttgtttctgagtataatacagatccaaaaatgtctttacttggttttaataagcaagtaccatcccagaaattaagggtttttgaaagataatgttacgagtggttgtgcagtcataggatagggtcttgagggatatgaaaagtgattgtgtaacttatcccctccttctgaatttgtccttatgaatttaaatatttgtaggtttctgagaggcaatttaagcagaatgggcttttgcacgttgtgtttgtgaaatatctttatgtccattatagaaggacacatgacgttgacacttcaataacctataatatgtcagagagtctgttaggttctttgcagatgtgatctaacttcctacctacaaaaatcttacaaaataggcattatcattctcatttttatagctgaagaaacagctacagagttaaatatctgtctcatgattcaccaggtagtaaggtgtggcactacctgtctgtttccaaacatcacactgccttaggagatatgttcatataaaccatggaagtgataaataatttaggtttttcattctcttgaaattattttaaaagatcctgtatgcttagacttaaggatgaccaatattttaaaactaaatcagtatcatatttattgcttgttaagtcatataaacctactctattttacccaaaagcttataagcattacattttatatatatatatacttctaaaaatgcatattttaacacataaaacttagatcactatgtcagttgtaattatgtttttaagttgccataaaatcttattgagggtagtaaatatgccaagtccaatataatctatcacaaacaaaaagattacttattctaggaagattctgtagtagcagaggaaaagctctaagatatttagactttcactgtggaataacttttcactctgatagaatcaaactccaatctggccaggtaggcaggagatacatgaagaaaatgacacaggtcttcccagagagaatattttgagctgttggtgcctgggtttctcatactgtcagaaaaaagtctggaaaagttattgtttgtttttaaacagttagatatttactaaatagctattgatgcaaccataattttatggatcgtaactatgtttctgcccctacttacagtagagaggaagaggcaaataatgtcatcttgtggttgttgttttgccataagaaccataacatttatatggcttttttttttttttttttttgagatggagtctcactctgacacccaagctggagtgcagtggcgtgatctcggctcactgtaacctctgcctccggggttcgagcaatccttctgcctcagcctcccgagtagctggggctacaggagcgcgccaccacgcccagctaattttttttttttttttttttttttttttttttttagtagagacagggtttcaccatattggcaaggctggtctcgaactcctgacctcgtgatccaccagcctcggcctcccaaagtgctgggattacaggtgtgagccaccacaccctgccaatttacttaatttttgaatagccctttaagtcaggcagtacaacctttctcgcttcacagctgaagctctgagaagccaagtaactcacggcaggcccacagtaactaaatgacagagttggcacttatttgcagggtggcagatcgacaatgctctgtccttctgctgcgtgatcactgccccttaaactctcacttaaataaaaactaaaaagaactatcttcaatccccaacatttcaccaaaatgtaacacatcagtgcaagaagagattcaggtctaaaaagaaaggactgtaggaaatatatatattatatgctactttctgctcaatagatcccacagaaaatattctaaaatgttgtctgatatactgtcttacaataaatacacatgattagtgtctttttctctacgttttccccagttggatcgcatgacaataggagaacgacctttatatatctgacctaagtgtggactggatgtatactgatcctgcatttacttaaaattttgttatttttttcatgatattttgcattaatttttattttaaaaatgttgcttcaaaatattatttattttgtttcctgtgttttttggcccttccctaaattttacccctgaagctaatatgtctcatactagccctgaccctgatatgtgtgcttaaacttgtctgtagaatacctaggtgcacagctctgaattttatattcaaacaaacttttgttgttaatttatttcaccaacttctgtctcttaaatatgtttggtaattgggtggaatctctgacaatttttttttggtatataggtttggtttttaaataattatctggggttgccaaattcaataatattaatacacagttgtttagcttcaatatgtttatcataattttgtaaaacttttcacttaggggtttgtccaagctctgcatggcaaaacatgtagatgatcaatacatccaccctgtcagactcctcaaacatagacttagatcactgtgacatgcattgtaggataatcctcatgacactctacagtgtggttgtacttagtggcactgcaggaatggttatgatgttacgtatgatcttcaaaacaaatagccaatcaatgatcggtacaatcatcttcaatatcatagtgctgcactccatcctcctggtcagccttccgttccacctcagctattatgtcttagtcatctgggagcttggatttctttacctgccgagtggttagcatcatatatgggcatatgtactttacttttgttttctgtgtggccattgtcatactctgattactcatttatgttaagaaactccaaatgcaacagttacaaaactaccatgtagtagttttaagcattattatttggatggtgggttgcctcatttttgtcaattttttttttttttttacagtatggcatagatccaagttactcagaacaacgatgctttgaattctgcaaagatcttaaccacagagaattcattatcatgaactactctgtgattgtcactacggatgacaatggttgtgatcctcttcctgatacagacagctgtcatcattcaactgataaaagctctttgacctgacatgtggacccatcaagagtatagaccccaaatcaagagtttcttcttccttctagtaatagttgtctgttttgtaccccaccatgcattctgggtacactttattcaaaataattcagagagaaaagcttctaacttagttctttataatgaaatttatgttgctttaacgactgtctgttgcctggatatgctgtgtttcttaagtggggttatacattaagcattcctatgtctcttccttcacagtattttcccacctttgtgataaaatgctttaactgaatgagtgttactgtgatttcaaaatttttcatcttaatcatcatcagaattgttttttttcccaaaaaggtaatgaggattgattgctcccctctctttagagaaccattaccagttctatatttaccatacaatatgttcaatctcttagctctatataagctgactgcatcattttttccagacttaactaccttcatgcagtacttaacttgagctaagcacaacaattggtttccctgtactctccagggaaatttgctcacagatttcacagaacaagataaatgtcagtgtactcaaattacattgtgagcaaaagttgtgacatttgctctctctttgagttctgaccctagaacattctttccctccatctccacctatcaattttttaagatccagagaacctggaaataggaacagtataaactgggctctagagaatacttaagttgacatagctgcttcttgaaaactactgattgtcagtaaagcttcagttactgtctttggtatttggaggaaaacattagctcggataggaagtcaacagagagaaaactctttcaggaatgactaggcataataacttgccattattattgttactataattattaattatatttgaaaatgctatagtagacccactttataattttgctaccacataacaggataaatggcagtgcactcaaattatatttaatcaattttcttagggcacatggtgtgttttaagtcagtcttctcaagatagacagtattcattattgtcagtactcaacttactaattcattaggtttcacaagttcgtttttaatatggtaggcagcctctaagaggagctccaacgattcctgcctcctaatatttcctgtataatgaccatgtggaatctcctccccttttactgacttcttattaatagaacaaggcagagtgatggaatgtcatttccaaggttaggttacaaaaaagctgtggcttccatctcgagcactctttctgtctttcttggattgcttcactctggaggaaaccaggtcataaggcagccctatggagaagcccatgtggcaaataattgaggccttctactagccatgcgagtgagcttagaagtggatcttctgagacctaccaatagctgtggagcaagctcagaagcagatcctctcccacctctcccatttgaaccttgagatgttggcagcctggctgggaattgattggtgcttcatgatagaccctaagccagaaccactccgctaagctgctgctagattcctgacttgaaacttgttgttttaagtcctcatgtcttggagtaacgtattatgcagcaatagataacgaatatagtaagttatttacacctatagaatgctgccacataagacactagtgtctgacatttacaacctgcttcttagtctctgcttattccagttgctgatgataaaaatatatccttgcctgttgtttgagtcaataagaactgtgcctggtactgtattagaagttttacttctatgcctgaaaagtaggggtatgagcatataatgtacatggagatacactgggctcatttagagtaaagattgcaagggggtcagttgaagagtgggtaagaattgctctgttagtcatgttgaaatctggaccattggttctccatatgtggccctggaccatcactaccagcagcagtagcacctatgaccttgttagaagtgaaaattctaagaaggaaaaatcagtggagctccacctgagacccactgattcagaaattctgggtgtgggttagaggttcaacaagccctccaggtgattttgatgcaggctaaaatctgagaaccactgcactggattaagttgataaattgaaaatgggcacaaattctttgaaactgctccaattgagaggtggaatttatatctcctataatttactatgggtggaatttgttattgcttcaaccaatagaacacaaggaaagtggtgctgtgccaattctcagctgcaggttttaagaaactagcaacctccgcttcctgtctcttgaagcatgggttcttggagcctgaactccatgaaagaagtctgacttgcatgctgcagaacatctagagatgcctgagattacatggagatacatggagatgtgcccagatatagccagacttccagtgaaggcaccaggcacgtaaacgaagaagctgtcttgggccctccagaacaacctatctgccatgggaataccactatctgacctcagcccacacaacatggcgcagaagaattgcccactcaatactgcctaaattcctgatccacacaattatgagagaaatcgttgctttaaaccactagattctaggattatttgttacataaaaatagataattgccacatgtattatttaaaattttctacttaccatattaaaaattttaaaaggaagaggcaaaatccacaataataataatataatttgtttaacccattatatctagctagctatcaatcatctacttttctttctatttatctattctagctttctttcttttatggattctgactttggtgctgtctttaaaaagtagtcaccaaacccagggtaatgtagattttttcctatgttatcttctggtagttttaaacttttgtgttttacatttacgtatgtgatccattttgaattagcttttgcgaagggtgtgaaatctgaatctagattcatattttttgcatgtggatgtccaattgtttcagcaacatttgttgaaaaggctagcatttcttcattgcattgcattttcttctttgtcaaagatcaattgactctatttatgtgggtctatttctggcctctctttttcattgatctgtttgcctatacttttgccagtaccacacaaacttaattactatagctttgtaatatgtcttaaagtcaggcactcttcatcctccaattttgtgcttctccttcattgtgctggctattctgggtcttttgcctttccacataaatcttagaataactttgttgatatccacaaaataacttgctggaattttaattgggattgtgttgatcctataaatcaagttaggaagaactgatgtcctgacaatattgagtctgcctctccgtaaacacagaatatctcttcatttactgggctcctctttgatttctttcatcagctttcctcatgtagatcttgcacatattttgttagatttacacaaaagtgtatcattttggggggcacaaatgtaaatgttattgcgtttttaatttaaaattccacctttcattactggtatatagaaaacagattgacttttgtataatacccatgcatcctgcagccttgctgtgcttattagttttaggaggttttattatctggtttgttctttctgactttctacatagatgactgtcatttgtgaacaaagatggtttttatttctccttgcccgtcagtatgctttaaaaaaaaacttcgtttatttggttagctaggacttccagtatgatactgaaaagaagtggtaagaagaccatccttgccgtgttcacaatcttagtgggaaagtttctcatttcttatcgttacgtgtaatgttagctgtcagttttttgataaatattgtaggggaggcaaaattttacctctacccttgtaaagtcccagttaagcctgagaattaaattgacttaagagagtaatgggagagaagcatacaaattgaatttaaattttacatgatatggagtcctcataaggaaatgatgatccaaagaagtggcgagtttgtatgcttttatattaggttgaacaaagagaggtagtcatggaaaagtaactaaattatatggggaggctaatggaaggtagaaaaggtagaattattttaacaggatttgtttgcccagaattctctggatatgattctctattgaaggatgtttcttttctcctgctatagagggggcatcttccctatgagtttttctcttctgttttcaggaagaaaaggggaagattagaatgccttcttgcaaatgatgttttttaagtgcctttagtctgaagtaatactatgtcaaagtggcatattttgaggtggcgtgttatgtcacccttcaatattccttatctagtgtcctctattcctagtttactgacagctttattgtgaaagcatcttgaaatttataatgatttttatgtatccattgatatcatcatgtgatttttcttctttagattgctgatgtgatgaattacattaattaatttttgaatgtcgaaccagttgcccaccagggataaatctcactatgggtgtgatatataattcttgttattcattgctggatttgatttgttaatattctgctgaggacttttgcgtctatgatcataagagatattggtctgtagttctgttttcttgcagtgcctttgtctggtttgactattatggtgatgttgacctcatacaatgagttaggaagtattccctctgtttctatattctggaagagattgtagaggattggtataatttcttccttaaatgtatggtaaaatttaacagtgaacccatctgggcctggtgctctctgttttgaaatattattaattattgattcaatttctttaatagatatagtcctatttagattgcctctttcttcttgctttgtcagattgtgtctttcaaggacttggtccctttcgtctaccttatcaaatttgtgttcatgcagttgattataatatttcttgattatccttttattgtctatgggatctccagtgatgtctcctctttcacttctgatatgaagaatttttttttttgattgacctagctagaatcttacctattttctaggtcttttcagagaacgagcattgggtttcattgattttttcctgttaatttcctatcttcaactgtgttgatttatgttgtaattttcattatttctttttttctgattaccttgaatttaatttgctcttccttttctagtttcctaagatagaagcttagatgattgatattagatctcccttcttttctaatatatgcattcaatgctataaatttccctttaagaactgcttctcctgcacccctcaaacatttataagttgtgttttcatttcaatttagttcaaaaatttttaaatttcttttgaaatttctcttttgactcatgtgttatttaattttgtttgatttccatgtagtttaggattttccaattatctttctgttattgatttctagtttaatttcactgtgatatacaccagatattacatgacatttctattatctttgatctcttaaaatgtgctttatggccaagaatgtggtctattttggttaatatttcacatgagcttgagaagaaagtatattcggctgttgttgtagagagttacagatgtccagatgattgatgttgctgttgagtaaaactatgtccttgctgattttgtgcctgctggatctgttcatttctgataggaggtactgaaatcttcctccataatggtagattaacctatttctccttccagcataattagtttttgcctcatgtatttttactctgttaggcacatacatgttaaggattgttctgtctttttgggtaattgatttctttattattaagtaatgtccttctttacccttcctaactttccttgttttgaagtccattgtgcctgaaattaatacagtgattcctgctttgttttcattagtgttagtatggcatatttctccttttcccttcccttcccttcgcttccctttcctttccatcccttccctttctttctctctctctctctttttttttttttttttggcaagtttttgctctgttacccaagctggagtgatcatggctcactgcagcctcaacctcctgggctcaagtgattctcctgcctcagccttttaagtagctgggactacaggcacatcccaccacatgcaggttttttttgtttttttttttttttaatggagacaaggtctcactatgttgcccaggctggtctcgaactcctgaactcaagcagtccccctgtcttggcctccaaaagtgctgggattactggtgtgagccaccacacctggcccatccatctacttttaatctatgtgtcattatatttaaagtgggtttcttgtagacaacatgtagttgtgtcatttttttttcatccactctgccaatctctgtctttcaactggttattttataccattgacattgaaagtgattattgatatagttgaattaatatttaccatatttagtgttttctatttgttgtttttggttctttgttcttattttgtctttcactctttctctgccttttgtggttttaattgaacactttatatgtttccatattctctcctctcttagcatatcagttatgccttttttcacttattttagtggttgccttagagtttgcaatatacatgtataactatttcaaggcaacttccaaaaacactgtactatttcacagctagtgcaggtaccttataataacaaaataattcaaactcctcccttctatcccttgtatcactgctgtcattcattttacttgtatgtaagcatatataagcacagatagacatatatgcataagatatacacataagtatacataattgaatgcatagttgctattattattttaaacaaactgtgctgtggagtgaatgaagacactgattgttttgcttgtacctccagcacactgaagccaccatattcaaaggagtccagtctgtcttcctggtgagcccctgacctctctgctcttcatcccctggcttggacctgcagcacagccatcctacttccacctgaatgttctcattggcagcagctccatgtctttctggggtggagttccccgaggcaactgacagccccctataactgccactgcagtggatgcccacccttgctgccaccagactgggcaaggaacaaagagcccgagtgctttattcacacctccatgccacagctgctctatggagaagaggccagactgattttacagcaagcctccaatcctccagctcttcaccgggaagggccgcctggcttgaggcccacaatgcagctgccccacccccagctgatcattttgattggtagcagctctgtgcttctctggggtgaatccttcaaagacaagtgaaaggccctctgccattgccactgtcaaggtccccacccctgccacccccaagctagggagagaacaaaaagcttgagttcacaaaggggctacagtgcacagcctgggagtgccaagctgagatatatggccaacacttgagtgggagaggggcccacactctcagagcactgagagagagcatagctgcaattgaggaaatacagaggaaccatgtggctgggtaagagcctatctaccagccattacggttaagtgccatctactggatggaagcccaaactttaacaccaaaaatacattgctaacatacctccccataaaattaaggacaagaattcagccacaaataaagaccctgcacaaagcatcagccctctgaaaacatccagaaacaaattcaactgactgtactcaaattacaccacagttaaaggcacatcagcccacacagatgagcaaaaacgcagggaactctaaaagccagagtgttttcttattcccaaatgaccacactagctcctcaatgatgtaggagttaaaaagaaattacttaggcagacagtgaggtaagaaagtctttagtaaggttttccttttaatgaaaagcagcccccaaatcattttcttttctaacaaagagcaacctgtaaaatcgagctgcagacatagaaaggcaagctagaagtttgcacggggaagtgatggcagctatgccagtaggaaaggagctacctggggactaggcatgttcaaaatgtcagctccttctttccttttctttgccaaaccatatgtacagtaaggcgaagacaacatggcgctgacagggcaaatatcccatttgcataataagattagggtggggaagccagcttcctcacatgctatgtaaatgtcaccctagtctaatcaatctttgggtcctatgtaaatcagacaccgcctcctcaagcttttttataaaatcctgagcactccactgtgggccagaagtcccatttgggcacccctctctaaagcaggagagagaagtgttctcctttttctttcttttgcctgttaaacctccgcccctaaacctacctcttgcatatgcatacttgatttccttggcatgagatgatgaaccttggttatttaccccagacaatgatgccgcttcaccagtgatggttctcaaccagaatgaaatggctaaaatgacagacatagaattaagaatctggatagcattgaagatcattgagattcaggagaaaattgaaactcaatccaaggaatctaagaaatccagtaaagtgattcaagaggtgaaaggcaaaataggtattttaagaaagaacaaaactgatctgatagggctgagaaactcactaaaagaatttcatgacacaatcagaagtattaacagtggaatagaccaagctgagaaatgaatctcagagctcaaagcacagttcttcaaattattttaatttcaaactattttagtcagacaaaaataaaacaacaaagaatttttaaaatgaacaaaacctttgaggaatgtgggactgtgtatagagaccaaacctacaacacattggcacccctgaaagagagagagagagagaccaagcaacatagaaaacaaatttgaggatattatccacaaaaatgtctccaacctcactagataagtcaacattcaaattcaggaaattcagagaacctctgtgagctactttacaagacaaacatccccaagacacatagtcatcagattcttcaaggtcaatgcaaaagaaattatgttaaggcagctagaaagaaggggcaggttaactataaagggaaccccacaacattaacaatagacctttcagcagaaaccctacaagtcagaagagattgggggcctatattcagcattcttaaagaaaagaaattccaagcaagaatttcatatccagccaaactaagcttcataagtgaacgagaaataaaatctttttcagataagcaaatgctaagggaattagttaccactagacccgccttacaagagttgcttaagggagtgctaaatatggaagtgaaagaccactaatggccaccacaaaaacatacttaagtacatagactatttacactgtaaagcaactacacaatcaagtctacctaacaaccaagaacatgatgacaggatcaaatcagcacacatcaatattaaccttgaatgtaaacaggctaaacacctcacttcaaaggcagactggcaaattggataaagaaacaggactcatagatagctcttattattttgagatacgtcccatcaatacctaatttattgagagtttttagcatgaggggttgttgaatattgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtttaaaattctctttttcagttctgtctctgcccggctttggtatcaggatgatgctggcctcataaaatgagttagggaggattccctctttttctattgattggaatagtttcagaaggaaggtaccagttcctccttgtacctctggtagaattcggctgtgaatccatctggtcctggactctttttcgttggtaagctattgattattgccacaatttcagctcctgttattggcctattcagagattcaacttcttcctggtttagtcttgggagagtgtatttgtctaggaatttatccatttcttctagattttccagtttatttgcatggaggtgtttgtagtattctctgatggtagtttgtatttctgtgggattggtggtgatatcccctttatcattttttactgcgtctatttgattcttctctctttttttctttattagtcttgctagcggtctatcaattttgttgatcctttcaaaaaaacagctcctggattcattaattttttgaagggttttttgcatctatttccttcagttctgctctgattttagttatttcttgccttctgcaagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcattatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttccaatatcatactgaatgggcaaaaactggaagcattccctttgaaaactggcacaagacagggatgccctctctcaccactactattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttacacaccaataacgacaaacagagagccaaatcatgagtgaacacccattcacaattgcttcaaagagaataaaatacctaggaatccaacttacaagggacatgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaaactaccaatgactttcttcacagaattggaaaaaactactttaaagttcatatggaaccaaaaaagagcctgcattgccaagtcaatcctaagccaaaagatcaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaatcataaaaaccctagaaaaaacctaggcattactattcaggacataggcatgggcaaggacttcatgtctaaaacaccaaaagcaatggcaacaaaagccaaaattgacaaatgggatctaattaaactaaagagcttctgcacagcaaaagaaactacaatcagagtgaacaggcaacctacaaaatgggagaaaattttcgcaacctacttatctgacaaagggctaatatccagaatctacaatgaactcaaacaaatttataagaaaaaaacaaacaaccccatcaaaaagtgggcgaaggacatgaacagacacttcttaaaagaagatatttatgcagccaaaaaacacatgaaaaaatgctcaccgtcactggccatcagagaaatgcaaatcaaaaccacaatgagagatcatctcacaccagttagaatggcaatcattaaaaagtcaggaaacaacaggtgctggagaggatgtggagaaataggaacacttttacactgttggtgggactgtaaactagttcaaccactgtggaagtcagtgtggcaattcctcagggatctagaactggaaataccatttgacccagccatcccattactgggtatatacccaaaggactataaatcatgctgctataaagacacatgcacacgtatgtttattgcggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcattctcagtaaactatcgcaagaacaaaaaactgaacaccgcatattctcactcataggtgggaattgaacaatgagaacacatggacacaggaaggggaacatcacactctggggactgttgtggggtggggagaggggggagggatagcattgggagatatacctaatgctagatgacgagttagtgggtgcagcgcaccagcatgtcacatgtgtacatacgtaactaacctgcacattgtgcacatgtaccctaaaacttaaagtataataataaaaaaaagtaaaaaaaaaaagaatattaaaaaaagagttgattagctattaaaatgtacaatgtaaaaatttaaaacagcatgaattattcttcaaaattctatttccttatataatatgacatgaaatacaaagtttttaataatttattttgaggactaagaagtattaaaagatctattagtctgttgaaataaaacatgttaaatggtatacaatttatttatgtggaaaaaagcctatttttaagtagctgactaaacctgaaaatgattgaaaatataatgtttaatataccattaatggaaattaaattactgggagaggaaaaaaaaagaaacaggactcaactatatgctgacttcaagaaacccatctcgcatgcaagtacacacataagctcaaagtaaatagatggagaaagatgtatcaaacaaatggaaaacaaaaaagagcaggggttcctatttttatctccaagaaaacagactttaaaccagcaatgatcaaaaagaccaaaggagggcattgcataataataaagggtttcattgagcaagaagacttaactatccaaaatacatatgcacccaacattgtggcacccagattcatgaaacaagatcttaaaggacttacaaagacacttagattaccatacaataatagtgggaaacttcaacactccacgacagtattcaacagataatcaaggcagaatattaaaaaagatacttgagacctaaacttgacacttggctaaatggacctaaaatcctcttatagaacacttcacccaagaataaaatatacattcctctcctatgcacatggcacatactccaaaactgatcacacacttggccacaaagcaattatcaacaaattaaaaaacaactcataccaaccacacactcagaacacaacacaatccatcctggctaatgcggtgaaatcccgtctctactaaaaatacaaaaaagttagccagtcgtggtggcgggtgcctatagtcccagctgctggggaggctgaggcaggagaatggcgtgaacccgggaggcagaggttgcagtgagctgagatcatgccactgcactctagcctgggtgacagagcaagactccgtcttaaaagaaaaaaaaaaaaaagaacacgacacagtaaaaactaaaatccacatcaagaacatctcttaaaaccatacaattacatggaaattaaacaattggttcttgagtaatttggggtaaacaatgaaattatagcagaaatcaataaattctttgaaataaatgaaaacaaagataccacacaccagaatctctgggaaacagcaaaatcattgttaagaggaaagtctacagcactaaatggccacatcaaatttagaaaaactttaataaacaacttaatgtcacccctagaggaactggaaaaataagagcaacccaaccccaaagctagcagaagaaaagaaataactaaaatcaaagctgaactgaatgaaatagaggtaagagaaaaccatacaaaagatcaacaaaatcaaacattgtttttttggaaaaagtaaataagacttgtagaccactagccagactagtaaagaaaagaagagagaagatccaaataaacacaacaagaaatgacaaaggggacataaccactgagtccacagaaatacaaaaaaccctcagggactattacaaatacctgtatgcacacaaacttgaaaacagagaacaaatggatagattcctggaaagaacctctcaagattgaaccaggaagaaattgaaactctgagcagaccaataatgagttcagaaattaaatcagtaataaaaatcctaccaagcagaaaaagccctggaccagagagtttcacagccaaattctaccagacatataaagaagagctggtaccactcccactgaaactattccaaaaaattgaggagaagggactcctcccttactcattctatgaggccagcatcattctgatatcaaaacctggcagagacacaacagaaaaagaaaatttcagggcaatatctctgataaacatagacacacaaatcctcaacgaaatgctagcaaaccaaatccagcagcatatcaaaatgctaatccaccatgatcaagtaagctttattcctaggaggcaagaatgcttcaacatatgcaaatcaataaatgtgattcatcacataagcagaaccaaaaacaaaaaccacaagataatctcaatagatgcagaaaaggcttttggtaaaattcaacatcctttcatgtaaaaaccctcaataaactagacatcaaaggaacatacctcaaaatagtaagagctgtctatgacaaacccacagccaacatcatactgaatgggcaaaagctagaatcatttcccttgaaaactggaacaagacaaggatgcccactctcaccactcctattcaacacagtactggaacttctatccagagcagtcaggcaagagaaaaacataaaaggcagacaaataggaagagagaaagtcaaactatctctcttcacagatgatatattctatacctagaaaatcccatagtctctgcccaaaggctcctagttctataaacaacttcagcaaaattttaggatacaaaatcaatgtacaaaaatcagtcacatttctatatgttaataatgtcccaagctgagagccaaattaagaacacaatcccattcacaataggcactaaaagaataacatacctaggaatacagctaactagggaagtcaaagatttctacaataagaatgacacaacactgctgaaagatatcagagataatatgaacaaatggaagactattctgtgctcatggataggaataatcaatattgtaaaaatgcccataatgcccaaagcaatttataggttcaatgttattcctattaaactatcaacattcttcacaaaatttaaaaaatactattctaaaattcaattgaaaccaaaaaagagccagaataagcacagcaatcctaagcaaaaagaataaagctggaggcatcacattacctgaccccaaactatactacaaggctacagtaactgaagcagcatggtattggtacaaacacagtcacatacaccaatagaagagtttagagaacccagaaattaagccacacatgtaaccatctgatcttcaacaaagctgacaataacaagtaatgtgaaaatgattcccttttcaataagtgatactgggattattggctggctatatggagaagattgaaactggaccttttccctttaccatattaaaaaaatcaactcaaaatgtgaccagtcacagtggctcacgcctgtaatcccagcgctttaggaggctgaggtgggtggatcatggggtcaggagatcgagaccatcctggctaacacagtgaaaccccatgtctactaaaaatacaaaaaattagctgggcatggtggcgggaacctgtagtcccagctactcgggaggctgaggcaggagaatggtgtgaatctgggaggcggagtttgcagtgagccgagatcgcaccactgcactccagcctgggcaacagagcaagactctgtctcaaaaaaaaaaccaaaaaaacaaatcaactcaaaatgtattaggcttaaatgtaaaggctaaaactatagaaaccctagaagaaaacctaggaaataccattatggacataggccctggcaaagatttcatcacatagactccaaaacaattgcaacaaaaacaaaaactgacactgggacctaattaaagagcttctgcacagcaaaagaaactatcaacagagtaaatagacaacctatagaatgggagaaaatattgcaaactgcaagtcacatccaacggaggactaataccagaatcttaataaatcttaagcaaatcaacaagcaaaaaacaaacaaacccgttaaaaaatagacaaaggacatgaacagacacttctgaaaaggaagacatacacatggccagcaagcatatacaaatgctcactatcactaattattagagaaatgcaaatcaaaaccacaatgagatgctgtacacaagtcagaatggctattattaaaatgtcaaaaataacagatgctggtaaagatgcagagaaaaaggaacgcttatacattcctggtgggaatgcaaattagttcagccactgtgggaagcaatttggagatttctcaaataacttaaaatggaactaccattcaacccagcaatacctttattgggtttatacccaaagaaatatgaattgctctaccataaagatacatgcatgcacatgttcatcacagcactattcacaataacaaagacatggaatcacataaatgcccatcaagagtggactggataaagaaaatgcggtacatatacaccatggaatactactcagacataaaaaaagaagaaaatcatgttctttgtagcaacatggatggagctgaaggccattatcctaagtgaactaatgcaggaacacaaaaccaaatacttcatattctcacttataagtgggaactaaatagtgagtacacatggataccacaaagaaacaaacagtagacaccagggcctatttgagggtagagagtgaggtttgaaatattacctattgaatactatgctgattacctgggtgacaaaattatctgtataccaaacccctgcaacatgcaatttacccatgtagcaaacctgcacgtgtgccctcgaacctaaaataaaagttggaaagaaaaataaatgaataaaataaaatcaagggttttattttaaaaaagaatagtaacaataaaagttatttcatcctcttattccttctatttattgattgattgatttttatttttatttatttatttatttttgagacagagtcttgctttgttgcccaggctggagtgcagtggtgcaatctcggctcactgcagcctctgcatcctgggttcaagctcctgcctcagcctcccgagaatggctattattaaaatgtcaaaaaataacagatgctggtaaggatgcagagaaaaggggacaccaccatgccccactcattttttttttttttttttggtatacttagtagagacaggtttcaccaggttggccaggctggtctcgaactccgggcctcaagtgatccacctgtctcagccttccaaagtgctggggttacaggtgtgagtcactgcacctggccagatgtgttttctttctttatgtagatccaagtttctgagctatgtcacttttcttctctctaaagaactcctcttaacattttttgcaaggcaggcatactagcaacaaattttcggagtttttgtttgcctgagaaaaatctttatttcttcttcatttttgaagggtagctttgcagattacagaattttaggttggtggggatttcagacatcaatttgggaaaattctcagttaatattgtttcaaatatttcttctattcttttttctcttctggtattctccctcctcatatattactacttttgtagttgttccacagtactgagatattctgctacatttttatgaatttttttctattggcctttcaattttggagatttcttggagacattgtgaagctcagagattgtttcctcagctatgtccagcctaccaataagcccatcaaaggcattcttcatttctgttagtgtttttggtttgcattccttttggggactttcttaggatttccatctgtctgcttacattgcccatctgttcttgcctgctgtctactttctccattacagctcttagcatatgaatagttgtttaaatgctgggtctgatcatttcaatatccttgctatatctgggtctggttgggatgtttgctctgcctcttcaaactgtgtattttgccagttagtatgtcttgtaatttttcttgctatctaggtagacatgatgtgctgggtaaaagaaatggccataaataggcctttagtaatgtagtggttaaggtgttgggggaggaaatacattcttagtcttatgattaggtgtcagtctcgtagtgagcctgtgcctccggactatgaactttacacatgattctcaggttttatttttttctctcctttggtgagacaggatgaagataacttatgagcttactctatctagctagagtgagctggagttgggtatttccattccccaaggttagttaggcttgataccatcccagcaggttaggctcttcagtttctcctgagaacagtttttgttaagaacagaatgctgtggtatatttaaaaatgtccgttttaccctccccctgctaaaaatgtgaggtttttctctgaaatttactgttggaaccccaaaggaatttttgtctcatatttactgtgaaaatctcctgtggagatttctatgaatttctgcttgagaaaagttgtaatgccttgtgcctctttgtctgtctctccaatttggggagcagcagtttgtgctatgacttcacttctcttagagatctaagaagaattgttaatttttttcattttgctcagatttttacttgttgtcaggttggagaggcaacacccaatctccttgcatgtggaaacagctcatatattttattttgagctattttctgtaccatgttgtgttgtgtttgcctctttattgatattaaaacttctctacagcattcttacacaacagccttggtgttttgtatggttaaaataaggagatgatcaaagtatgattttattcatcacaatcatacagtttattgccacataaaaatgctctgctttttccaccacactcaaagagagggagaataaggagaataaacctcacagagaacacacttaatagacaaggtacattaagcacatagtgagtgaattccaattttgtttagagttcaattattaaagtctagctgctcaattaggatggaagcaggcatctgtgaatgtaaagtctaatggaggtttgaggcttatgttaaagcaaactaaatatggcctgagaaggactctgtaattctatatttgagtccttgtggatgaacttgtaacctagcttaattggcagacaaaattgaaaatctaacttaagggtatgcgcctgtaacaatagctgagtcttggccaaccccaggggtcatacttaaaccactcataggctgctaagtgttcaaactgtgttcaaataaggcaaacgccaacctgcaaccaatccagctgtttctgtgcctcacttctgatttctgtatgtcacttccctttttttggactataaatttgttctgaccatgaggcatccctggagtgtctctgattctgctgtgattctgaaggctgcccaattcatgaatcattcattgctcaattaaacgcctttaaatttaattctgctgaagcttttcttttaacacttaacctttctacaagaggttcttgaaagagacgtttgatgaacacaatgatatgtaagctccttcagtgctttcaaatagtgctggtgttggtgggcaaagctgtagagagtagctcaaaggctggcagaaagtaccctgccacactctaagctcttaatgtctgtcaaagtcttgggtttatatgtgttttggagtagttgaggccaataactcgcatatgtggtctgataaggtgttataacattcttctggggagagagattacactccatgctcttaccacagcaaaacatgccacccacatagaaaattatatgtttggaattttctatgtgaaaattaacctaagtagcctaacacttaggttattggtgctttgggtgaatgaatacaataaagtggaatagagagacaacaggagccataggacacaaaatgagaattctgctgactcttggaaatgagagcataaagtgtccaggaaattctaaattttggagaatttttggaaatatttgagaagtcagtgaatcaccacaggctgtacagttttctgcaatggtttgaatcattttatttggttgtgaaataagagtgacctcagaatgctagagtacttgtacatcaccaggttccacactaaatacatgatgacaatgatgataacaacggtgatgacaacactcaaggaggaaaaatactggcttggtatgctgtaaaaatttactctgtagcttttcttattcaccttagctggaatgcattgtaaggattcagttgcctgtatctgggcctcactgcaacttcttagagattttccttcatagtttgtttccgttgaaggctctcttactgctttttcttctattccccttactctccctattcaggctaaagcttattaagtgctggcactttatcagctacatttaaagcccggattcagggcagcaaccactgaaagcgtaccctgagacaaaggatgtaggtacacaccgaatgagctcctcaagtttctcaagtccaaagaatagttggcactgcatactggtaacttatcagtacacttcagagtgagttaaaaacaggaattattttagactctggataattacttattgttagctcttgtgcatatgcaggcttccttagctcagttaacccttccttcttttcccaaggcctccatcaccactctcatacactatctggggctccatcctatttttgcattaattcctttggtatttcccttttaatattttcattccaagcctttagcaaacaataaaattaaaaacaaaatgagcatcaagatacagtaggaaaattgccaacagatacttggcaaacatatttgtagagacatctatcgttgcccttgttacataataatttgtctctatggaattctctgtcagatatgccactgcccatttcaccaaatatttgagagcaaaaaatcagtgtcatctgattgtgtatgtttacctataaatcaaaactttctttaagcaaagaatgagagcttgaatctgtgaaatctaatattctgtcctcaagtatcatttatctgtttatgagactctgcctaggatggaagctgctaacataacagagaatagccaatgatctcacaacctgggcagatgtgagattgtgcaaacacctctcaatctagatgatgataaacattgatacttcagagtgaacgttatcaaattggagagcagaacagatctcagacattatctggatcaaatacagatcttttgattcactgatttactattctctgatattttccgccttcaccaggtatgttttcactttatagcaaataaatctttaataaaattgtgtgcataaaagttcactatcagatgctccattcacaaggaactacaaggaggataaactctttatctactttattaataccaaatctataatcttcaggcttagaaaggggatgccagctggatcaaaaactcccagcctttatttagtcaagggcccattaggaaacagatgatcctcacaaatcaaaataattcaaggataagaggctagttacaaaagtgtggagacagcatagagaaaccacaaacaatagtgaagtaccacactactactaacagcagtgctatcaatattcctaggcctgaatggcaaagggagtgagtgtttatcaaaggtggaaagagggaataatgtggagagagctgctttgaaagacgctctgatcttaggttcagaaacgcaaccatctcaaggcaacaccacagagcatcaaccggtggaatacttatcacaatcttattcttctccatccctcaaatcttttgttgttggggctgaattcaccagaagccagaaggcaagagagcctgttgatgtagttcacatagatcagcttctctgggtggagcagggtagacaactatggagaaaagtgttgacaaagcccctttaaaaaaagagtttcttattaaaacaactgcctccaaaaccaaagcaaaaagcagaggtaaaacttgtcagccatagtaagaaaataaaaggcaataaaatataagctggcatatctcaaagaataaacaaaacagaaatttagaaatcaaggccatgctgaaaacttcataatacagaattgaaattgctgaaaacataacaaaggactcagaaatcggaattattaaaagcaaaaataattatatgaaaattttttaaaacaaaaagaattaacaagaaaatgataattgttgaacacagaaaaggagattcaacatatgtattgttatcctctaagaagttattatttcagatacaacataaggattatagttagtaaaattgtattgtattagagatttttgttaaataagtaaattttagctgttcttgtcactatcaaaaagtaactatgtgagatgaagtaaatacatgttactcttcttcagtatagtaacaattttagtatatgtatgtattctataacatcatgttgtaaacctcaaactttaaaatttattttataaataatgacgaaaaccaaaaataaaaggaatctgggttgacagttctttcatttcagtacagtaaacatgttccactatcttctcacttaaattgtttctgatgagcaatcttttggcagctttaacgttgatcttctgtatataatatctcttgctttcttgtaactacttttaagattttacctttatctctggttttgagaaatttgattatgatataaattggtgtagttttcttcatatttcttgtgttcggggttttttgagctttttggatctgtggttttatacctttcatcacatttggaaaaattaagccaccatttcttcaaataatttttctgatgtttaccctcttttttgaggactccagttacatatatactgtgcttatggaatttttttccccagtttactgatatgcttttattttcttttttcttttttttaactttgaattatatattctctttttttattttttattttttttaaattttattattattatactttaagtttcttttaagttgtggttatatatatatatatatacacacacacacacaacataactcagtagtcttggaaccagattgagtttcatgccaaacaggtgtttctcaaggaggaagcaagacagcccacagaaacccttgtagccagccagagctccaacaagcccttgagagaccctgagactcccagatcttcaggttctatgtgcaatagatggaagccaaatggcaagatactagggagattgtccctcaccattctgcaggagaacaactcgtctggcaccctgacaccatgacaggtaaagcaagagaagggtaagcagtcttcactaagtgaaaatgttagtgaactaaaggaaggagccattcttggaactgggcaacttctgaaaagtggaagacagcatgggagcaaggccaggacaatgacaaggaaaatcagcactttcccttggtggagtgctaagccctgcatgaccccagcaatgcagtcacctagggcctggtggatctgtgttctctcaacccttctttcccagggatattgaggaagggcttgttttcttagactcctcctcaactaccaaactgggactaagagctttattggggaaaaaaaatagaattttaaaaacattgttaaagaatttttttttaaattctttgtttagctttttgagggactgctgaactgatttttacagaggctgcaccattttacattctcactagcaatgtatgagagttccagcttctccacatccttgtcaacacttgtgattttctatgttaggttttttgttcgtatgtttttaagccattcttgttaagtgtgaaacggtatctcattctggttttgatttacatttccccagtgactagtgatgttaaacatctttttatgaacttattggccatttgtatatcttttgagaaatgtcttatttatgtcttttgtccatttttaaattgagttttctgtctttttgtttagttttagttgtccattatttattttgaatattaaactcttattagatatatgatttgtaaatttttttcccattccgtagttgccttttactatcctaataatgtcttttggtgcacaaaattaagatcttttattttctttgtcagtctagctaaaggtttgccaatttgaaaatttcttttctaagaacaagctttttgtttcattgcttctttttattatttttcaattctctacttcatttatgttcactataatctttattatttcctttcttctactagtgttggttttagtttgctcttctttttctagttcctcaagatgtaaactcaggttgttaattttagatcttttttcttttcaattgtgtttacagctataaatttccccctgaacactctcttccctgcaatgatgcactcttgatttttaaaagttaatttttcactgtgtgtttgatttttggggagtatctttgttttgtcttcaactatgctaattttttatttctgtgatgtctaagctgccagtagtctcatcctgtgtttttcatatcagccagaatatttatctgtattattttgatatgaatcatttttatgtgtttgatatctcttctctactttttgaacatatagaacatgattatgattactgttttaatatccttatctgttaattctagaatctggcagctttattgattttctgatttttctcctcattttgggtcatatttacccgcttcttcacatgtctgacaatttttaattggggatgtccttcattgtaaatttcatctgattggatgttgagtatttttatgtttttataaatatgagtgtgctttcttctggaatgcagtttgatcatttcaggtgttgcttttaagatgagttaggtgaatccagatcagtgctcaatctcaggctatgcatttcccactatgtaggcaagatcttcttgagtaccgtattcagtgttccataaattatattcttcaatgtacctggtggtaacatctaccattctcagagctatgtaaacactggacactgcccctactaattctttcatattcttctttctccagactgatcagtattcagcggaacacttgagctcagggaggaggatagggactctgtaaatgcctgtggttctctctgttttgctgtctcctttcttctttctgttaccctgctctgcaaattctagctgcttgaattttcagtttggcctcctcagatcccagggatggcttctcattctgccagtttcccccttaggttgcaaagtagaaactttcacaaggcagtaagttgatcacagggctcatctcatttgtctttcatctgtcattgatcactgtcattctttgcttgatgcccaatgtattgaaaactattgttatagggatttgccagtttttaactttttcggggagtagggcaaatctggtctgtcttactacgtcttggccagaaccacaggaatttcatatgtaacaacaagccataggtattcatgaccttctttcatattctgtgggctgagcaatttgtctcagatgatataatgttaagatgacctaaatacagatgctgtaatcaaattttgtttttctgatttagcaatcaatcaatgagtcatttgtctgaacagacatcagtatctaacatcttaaaacattttagtcatgtaattcttcccccttccccatccccatatctgtcccttggcattccttcttctgcatctccattctattctaacttaatagtgatagaaattagtttgtgaaaatacattttctcaaagttcaggtagagtaaaattttatacggatatagtaatgaaaatatattaaagttatatctctgcatgacagtaaataataattattgaatgctcaccataagttagagatttttctaagccttttacatatttaaaatcattgaatcctcacagaaaccatttgataagttagtttataatctccagcaaagatattggggttcagggaggttaagaaacttacccaaggtcacaaagaccaccactacccaatattgctgtatggagattttacccccaaaaaagtgtatatgtttatgtgtggggagctaattagctaggaaaagccctaatgtaatatgctttatttattttcaaattactgattgcatagaacaatgttggcccaaacctaatgctattgtgaaaatggacttttgtcttattcattgtttccttggtaatcatcatatgtgtggatcataataatcctggtttaactgtcaatagtggtagtgagtcttcttccatcttgtcattctaaaagtcctgaattcatgatctacccttcagatctgatcttccttttacgtttctcattaactttgttaaagaaacattattctttgacacttattaaagatggtaaagaaggttctactaagaaaggggattatggtgatgagtgtaggaaccacgtcaataggagaagagagattgggtctgaattcaactccaaggaaaagtggagatttatagccaaggagcagagtgggagtcaatggatgaaaaattactaggaagaaatatcaagggttagggggattcttgctagacagactcaacagaattcttgttgaagacaactcaaggtgataagaatggagagtggttggatactaagggtgggaaattttcactaaactgacttagcaggattcttgctcagactggattctataagaatagagagggaagctgaagcttgggcccagttgagcagagggctcagaagagcctgattaaaatttggtcaaaggagagagagtctttgtcaatatgaaaggcatcattccctcacccaaacctgaaacttaggagatttctgtggttctccccctccctcacccctccacagagtaagtccgcaagtccccttgatgctaaaccccaaatatctctcgagtcagtctcttttgctccttactcacagtctctgccttagtttaggcccttggccgagctcctctgggttgcaccaacaggcccatatctccttatctcttgtttcacttcccacccacatttactacaattgccacagtgatgccacagtggtttttctagacttgaaaccttttcctgtcattcatctatcataagtcttcccacttaaaactttgagaagcttcatactgtttttgtataaggcccaaatttattatcaggcttattgcactccctatgctgcagccaagcttgcctttccaggcttgtcatgccctcacatgaattcctcacatcaggtaaagcatcaaatccacaggcacctccatacatctggctctcccatccctgtgactacacttacttcctgctgcaccttgaagtcccttcccccaaaatccctttatctccatcttcctccctctatgctccatgctcagctccaccttattgtgttctagtcttacctctagtcctttatggacagtggcgggagtgattaattactcctatgcatctgttgcaagaactcatatgccaggatttcaggatgctccttttctatctccagactgattatgagactcctcttaaccaactcccctgtcatcttacctgtgcctctattgcagtgactgtcatttggcaagctatgacatagtaccagacagggaaatcataaagagagaaaactaaattatacttctctctgtgtcctcatgctctagaataatgccttgctgttcaataaatatttgccagggaataaatgaatgaagaaataagctgagcaatttcctaacatttttccctttagaaaacagaaaaaaaggttgaaatctgaactcatacctgaaccaatcccagttgaccattttctactagtgacattagtgttgccattgaaatagtataaacataaaatgaaagtttgataaagtcacctctgataaaaatacataatatataacatgtataacatcacagaatatatattatatacatgtgtattataagagctgtcttttttatcttatatatgtatatacatatcttacatatacatgtatgtgtgtatatacatgtgtgtgtatatctatctatagatacacacatgcacacatatatacgataagaaaggagcttaacaggcagtgatatgtagatttctctccaatgaagcctgaaattattttgcgtgaacaactacaaatgagatgtgttacttttactgcggactgtttacatgagcataaactggatgctttaatcctttgttattttttcttgcatttcatacaaatttttaaatagttgtgattacagattgactggataaagtcacggccaatggatatggatttttaaaatggtaacatttttgcaccacagggatcctcaaagatgcttgtaatagaaataatttgcataaagacgctagaaaagttattgaaaatataagctatttaaatacataaaatggagaaaaacaatatatggaaaggctgtattttttctttcggtcatgctagaggaagcgcccctcctctcatctgacgtattttcttcacctgcacctcccatcttctatttcttcaacttctactctcctgactgttaaaaatcagcatttaaatatagtattatagtcaaacttcttcctccttgtttaaaaaagaaaaacgagccctccagcactcacattttttgggcaactgtctcttctctgtttccatttcttcacccttacgcttctggaaatagttgctgattctgtctccacctcctgtctttatagtctctcaagggactttcccagaccacgctactgaagacactcttatgatcaccactggcatctttgttgctcagtccacgtgagtgacattttatttggccagatcttgttttatttggccactctgtaacacttggcaatagtattgctgcctcagcagcatctcattctttgatttttatgacatcacttcttggttcttctcctgcctttttggctgttcctcctcattttccttcatcagctttactttcatgacctgttcctgaaagttgatgttcctagcgtatcctcctggaccctcactttctcaaactacacaaatttcttggccatctcctctgcttctattcccctaatgtgctgattatcaacacatctatatctccagcccaggtatttcctaagtatctttcatatccagtagtctccaatgtgttgtgtacgccttgcctggggtgtgcaatataaacctatgaggctacacaaagaaaaatacatgtatatttttgttgattttcttatctgaaatatgagaaaagatagtgctaatttattaatggttatcatatgcatcatcagtagtgtcctcaatggcttttcgtcctcctgtttccagttcgcacggacacactttgtctctggtttttcaaccaccacacatatgcaaaggtaccaggaagctcaaggtttgttgagtgtctcctacaaggagctggtcacataggaacatcccagctattggtcagccttgaccattaagctccctctccctccttatccctgggctccagcaaaaccaggtggtataggtctaaatccagttattattcctgagcaatgctgataaactggtatgtccactccaaaacaactcgcaaaccaatggttacagaatattatttactggttatctcatggcaaagttcatttttattttgtaaaaataaaatgttttaaatttgaggacacgtggctgtctaaattttgctatctaagaggtatatttgaaaaaattatcatcattatctattcccccaagattaaagtgatgttttgaaacagtgaaaaaattactgctttttgaaataactcatggtgaggaggtggaaatgtatgaaaaccaatatttgaaatttttctataattaacatggcttaatagtgaaaatgagcatgacttataaacccgctcacaattacacccttaaaataccttagcatcacaaattttctattgtgttaaaaaatttccccaaaagttacatttttaagtcatttgtcaaatgcaaacccctcccatttatttggtagaaaaagcaatttagattttttaggatgttgaaaagttacagagtaattgtaacaaaagtcttttcataatttttggaagatactgaaagataaatatcttttgttttaaatggcattttcttgtgagaaagtattttcagcattgaaataaatttaaaacttagaagcaggcatttgaatcactccatcacacaatattaaatcaagatttcaaaaacaatgaaatcatatttcaattacatttctcactaaatattaataacattaatatttgtttaagcatttaaatattaataacattaatatttggagaaagccatgaagttctgaactagtacgtaataaataagacgcaacaagtaaaaaatagcatatatttatatatttaatcagatcataatctgagttaacgtttttgttgttttttaacttttttttttttttttttttttggtagaatcagggtctcactatttttcccaggctggtcttaaactcctggctcctgggctcaagtgacccacccacctcagcctacccaaagtgctgggattacaagcgtgtgctaccacactcgacccatttttggttttgtttaagcattataacatgcagaagtgatgagtaataggaaaaatatttaatctattaagacataaagatatctaatttgatgtgcaggtttaaatagttttactggtgtaaatgtgttgtcaggtacctcctaatcctcttgtggatccatatactttcttctgtttttccttcagtcttgcagcagaccacccatctcactttgattcccccagtttttctgtttttccatcctgtcctctctccttcaacccattctccagtcccagtcagagtagggtttctaaaatgtaaaaatgagcagtcactttgctcagtagaaggctgcggtggttttgcttgccctcaggctgtatacccagttcttcatacctctcccaggctcctccagatctgcctcctgctgaccttgtacccagctgcagcgacaccgagctcctcacagcttcccaaagtgggctggcccctctcacgacagggtcatcgcacaggctccctctgtgggggaacacaacgggagtcatttcaacaccactttcttcaggaagcctattctgatccttggtactccaagcagctgttgtcaatgcctaccccaggtgataccatgccatactgattttattttcctggatacttaatcacaggtaaagtcactgaggccacacaaccctgaggagaaaatgcttgagcaggcaggattttgatgatattttgtggatgatactccattctcaaactgcctacattcacacttcttttcaccgagagaaaattaagccactatgcttttaaaccattcttacttgggttttgtgtaacatgcagcaacatggaattattacggatacaattggttctgacttgtatggatacacttatagaaaaacgtgtgaggatatattgaacagcaaagtactgatttttttcttattttgatttgtctctgatgaacacatatttctttatgtaaatgtattagaaggaattaataagaatatgttgaggaacaaataaattgccaaatcccagtggcgtagcacactgatggttgatttgtccgtcacacaaaggcccatgcaggttaactagggctagctcgagccagtgactcaaagatccaggctccttctgtcttgtgattattaagggtagtaaagaaaagagaatgtggcggtggcagaccccctgctagaaactgaaggtgccatttctagtcacaggccactggctagactacatcacatgaccttgcctgtcaggaactagcattgcagacttaccagcatgaccgagaaggaaatgagagcatatgtagggaagcacgcattgtctctaccaaaatgaaaatggaagtttaaaaatgcaagtactcatgggaaaggtaacacactgcacatcttagccactgtcttccctgactgcaatggcagagggtagaaggggagggaagaggtgcgcatatatggaggcgcatgtagattctttacaatttgtctcaggtgaggaagggttaatgtgtgtgctcagatgtgccagtgagtaaagaaaagagtatgttttcaagcttcgcaccaaatgtgaaagtcacttgtttcttttttcccttttaattctaaatctgagaaaaagcagtgctccgctttgaatttcaaatgtcttcaacattgaagtctgttaatcaggctattttcttatcagctctgagtctcaaatgctgcatctataagaagagaagtcctttccagttctaagagcagtgactgtgtgtggcttcaggaatgataattacacattccaaaatgcatcctggattaatttcttaattcacatctaccagagatgtgagtacccaatgcttaaagaactatggttccatgactaacaagaagtgattcactgagcccaacaagcaatctaatctaattgcctctaagtgttgtttagtaggggtaactttggctattttaatgaaatgtgaatttttagaaattatagacaacaaaacaaatgtgtgttcagcaattcctgcctacaggagttcacactcacttaaggaaggcaaggcacgtgcagttgaaacaactagcgaaaaaacaattctaaataaactagcgttgtataccgatataattaagtgctaaagtgtgcagttcaatcagataatataagatttggaaaagaaaggtgataaagtatgcccccagacaaaatggactccctgtggctaactgaggagctcaaagttaaaacagaactaggtgtccatagctgggtgacagaatggtcacatgttctgcgctctcagaaagatgttgtaaaagtatcaaaggacctcccattctacaatcaagctgaaccagctcctgttctgttgttgggctacaagataaactgctgcaaaaagcacagcacctgcccacacctcccagtgccgcaagccccaggccccattggccatttgaaagaaacatctgacagggactgctggtttggggcttgggaagcaaccagagatcacctcccctagccaattaaggctcagctgtttgggccaatcagaactcagctctgtcagccagtcaaaaccaaacaagactcaaccctttgtttgcataaatagacctggttgggaacctgggtggggacttttcctataaaaccccaggcatgccatcccttcattctctggaatggaccttcattttacacagcggcctgcatgtctgcctgatttgcaaacagttctctggaataaaatctctttcctccagattctttttcagagagcttttgttcacaaaggggataaaaagattaagctaagatgaaaatcagaaaaaaaaaaatagaatcactgcaataataaggctcattatttccaagatttttatgtatcctggtctgagtatgtccgtccttaaagcatatgaactgaaaagaataggaattggatttatgggttttgatccatttaaaatatcagtattacaaagttttctagtgaagttaaacgaatgcccgcaagtaatttttttacagaaacccagttgagaagggctgcaagaattaagagtattttgaaaatataccagagtaagcaaaaattgcaacatatgatggttaaaaaaaaaagctcagtagtatatcatattaaagatttatatattaaatataacagaatttagaaattatttatgtgtatgggacactgtttttatcattttttcacgtagagttgtcaccatcattcattgtgaagaacagtatatttaatattcataggaacatagtataaacattcttctatgtaatattaaattcacaacaaatggagtatttcttgggttacatgggaaaaaaaatagcagaatcttgctgagcctccccagacagattctatcaccaggacagctctttaagttcccagatgcgggtgcctcccttccttggcagaatgcctggtggacttggcagctgccttctcagcccttatcacagctgaggcttcctggggagtcacgcttctcctcttccacccactgtgggcgtggggtgccaccccacggcttctcctggtagctctgatgctgccactgcagtgaccctggcaccatctggtccctggatgtacttgctgacactgccatcatcatcacctgcacctctgccccaagacaaggttgaggatatttttcccagaccagtttccccagttggggatgtttgtcctaggcctagatgccattctagaatcaggaacttaatcaaatcatagatcttcacttgaagaaagcataatgtcgatggccatgaaccagcaatttttcttcctttctctcatctccctactcctttttagggctattctgcccagcctcatttccccgttctggatggcagatccatcttctagaaataactttcaagatggaactataatccaggtctttggttgtaatcgaggtcttctgggagttccgttttgggatccagacttatatcaaatcctacatttgcttctggggaaagttaaaattttgatatacaagagaattaaaaaaatactgtgccatcagagattaaaatgctaatggaaagtaattcaggagagaagaaaaattgattatgctaataaaaataatatcaatttggttgaaaatgcaaaatacagtttaggtcctcaggggccatggtagagagtgtggtaggattaatgagagaaggagtggggtagtccctgctttgtgcggggtctagtcttgaggggttattcttgctgttcatggttgatgtgtgacgacacctccatacttgtgttggaatcctagggatttctgggcatcggctcccacttctaaagacagggactctcctgtgtcggagcttttggggttctgctgagaaagggggaggctgagtagcacgaactatcatgattgattagtaacgtctgctacaaaagtgggagggtgggggacggctcatatggcaaatatttatcaccttaccccataacatgctttctggctgtattgtcaggctgctaggaaatgctttccactcggaactgagacctaaaactggaaactaggctgcaggaccacctgggtacgtgtgaattacagaggttcatgcatttccaaatgggggtgtcattttagaactggggcgtaagatgatgagcaacagaaaagacaacgccgagcccccgggtatgagctcagaactctttacatgtttgatgctccaaatggtctagggcaggggggcttcagagccttggcagcagaacgtggtcgcgtagatgtttatctgattttctgttgcgctgctgctcaaccgccactacggaagtgcacactgccaccttatggacgtcttgagaagttacacttacacgttattaattatattaaataaaattcaaatgtaataaataatgtcaggggtagtttttataaacatttgcaatgaaaattcatatgaggacttcagacagaatatattcaaatgaagagttgatttcgatttcactgatgaaattaaataacaggattaagatgaaattctcagctattttagcattttagtgtttttctgctactgagttgtgggaattccttatatgtttcggcttgtcataaatatggttgacaaatattttatctgattttatacgttttttcactctattgattatttccttggttgtacagaaactttttaattttatgtagtcccacttgtctattttttacttttgttgactgtgcttttggtgttgtattcaagaaatcactgccaagatcattatcatgaagctttctccctatgatttcttctagaagttttatagttggggtattacatttatttatttatttaaagacaagatattgttctgtcactcagctgcagtgcagtggcacaatcaaagctcactgcagccccaacctcctgggctcaagtgatcctcccatctcagcctcccaagtaactgcaggtaactacaagtgtgcactaccacaccaggctattttttgtggagacagggtttctctgtgtttcctgggctgatttcgaactcttgaactcaagtgatccttccaccttgccctcctaaagtgctgggattacaggtgtgagcctccaaccctggccaggtcttacatgtaagtcattaatctattttgagttgaatgttgtgtgtggtgtaatatacacatgtgaatatccagttttcctaacatttgttgaagaaactactgtgtattcttagcatctttgtcaaagatcaattaatcatatgtgtgtgtgtttatttctgcactctccattctattccattgatttatgtgtttatctttaagccaatacaatacagttttaattgcagtagctttgtaatatattttgaaatcaggaactatgatgcctccagctttctttttttttctagagattgttttggttcttctggatcttttatagtttaatatgaatcttaggattgtttttactatgtccgtaaaaaatgccattgggattttgatagaaattgcatttaaactgcagatcactttgaagaatatgattatttcaacaatattaagtcttccaatccatgaacatgggattttgtgaatattcttgtatggttttagcctaattagaatgtttctaatgttttgattttacatacaatgttagctgtaagtttcagacggaattatttctcaactcttagtttgttcagagctttctaaaattattattaatgaaagttaatcatttttggcatagacttggtttttaactttgattaagtccagttattacttttaaaattttatgatgactctttgtgttctaagaaatatttgattaccatcccaagattgtaaaaatattctatacttttggaaaagctttatagttgtaaacttttatgtgtaagtctgtgatccatctgaactacattgcatattttatgaaggtgaaggttcattattttccatatggagtttaaatttttccagcatcatttatttgaaagaatttcctttccctgttgaactaccttgatgtctttggagaaaataaattgacagtatgtgtgggactctttctgaactctgtatttttttcattgatctatacatggcattaccacaccattttaattgctgtagtttaatagtaaagtgcacgttttctaccttttttctttctgactcttctgggtacttgacatttccaaatcaattttagaatcagattgtcaagtgcaacaaaaaatggttgggatttttattatgattgcattgaatctatagaataatttcgattaaaagtgacatcttgggccgggtgcagtggctcgcacctgtaatcccagcacttcgggaggccaaggtgggcagatcacaaggtcaagagttcaagaccagcctggccaacatagtgaaaccccaccactgctaaaaatacaaaaaaaaaaaaaaaaatagccgggcatggtggcaggtgcctgtagtcccagctacatggaaggctgaggcaggagattcgtttgaacctgggaggtggaggttgcagtgagccaagatcgcattgcaccactgcactgcagcctgggtgacacagcgagactctgtctcaaataaaccaaaaaaagtgacatcttaacaattagtcttctaattaatgaatatgatacacttttttggtttctttaatttttttcagcaatactttgttgttttcagcaataagatatatttctctttttaaatttatgacatatttttatcttctttgatggtattgtaaattttaaagttaattttattttccaaaccttcgatgctagtttatggtatacaatcaattttttatatttaccttgtattttgcaactttgcttaatcatctattagttctagtaggttgatttttccccaagattccttaggatacaaaatcgtgcctttgcctgtatgtatatatttttttcaatctttatacctattatttatattccccttgtattgcactagctagcacttcaatataacatttagtagaattgggggaagcagacattcttgacttgttaaaggtattatgggaaagtttttaataattgaccattacatataatgttagccagaggtgttttatagatacactatatcaaattggagcagtttgctaagagattctgtgtgtgtgtttatcacgaatgaatataaagcttatcacattattttcttcatttatttatatcatgatatagtttttctcttgtattatgctaatatggtgaataaatgcttcattttcaagcttgcattgatagataaacctcatttggtcatgacacgtgatctttttcatgtattattagaatcagtctgttaatatgttacatatatttacatctatgttcatgaggtatattggtcgataagggttatgctggcctggaagcagacacatgtcaggatatattcctctttctctattttgtaaaatagttcatatagtattaaattatttttcttatttgggcataaaatttcctttatacaaatattttaattatatactcagtttaagtaacagatacatggtaattcagtttcttgttaccctttgctaaattgtatttttcaagtaatttttatttaatctaagttttaaaagcttatggcataaagttgttgtaatattccatcattgtgtaacttcattgctatgaggtctttagtgatatgccctctttcatttacaatactgaaaatttgtatatagcctatttttcttatgtagtctagctttgggtttgtctttttctatctttattaaaaaaaccttgtatgtttgtcagcttccatttttttgttttctatttaattaattttctaacttttgttagtttcttctctcaattcactttgaaaaataagtcatttatttcagctcataagttgtaacttacatccttattctgaacatgttgtattctctaatataagcatttatagtttcccactaagaactgcattagcaacatccaacaaactttgatatggtatgttttaattatcattcaatttaaaatattttctaggctgggcttggtggctcatccctgtaattccagcactttaggaggctgagggggtggatcgttttgagctcaggagtttgagaccagcctgggcaccatggcaaaatcgtgtctctacaaaaaaatacaaaattagctgggtgttagtggctcacgcctgtaattccagctacatgggaagctaaggcacaagaatagcttgaacctgggaggcagaggttgcagtgagcagagagaacaccactgcactccagcctaggcaacagaatgggatcctgtctcaaaaataaataaataaataaatacataaataaaatatgttctaatttcccttttgatttcttgtttaactcatggattatttggtagtatattgttaactttcaggtatttcagactttaccattattgtattgttcttaatttctaacttatttctattgtgatcagagacaatatagtgaaatatgtaaatatttgaagtttattgtgattttattatctggcttatgattcattaaatattcaatgtgcatttcaaaagaaagtatattctgcagttattcagtaagtgtcaatttagtccagatgattgacagggttgttcagatcttccgtaatcttactgattttatatatttatatcaattattgagatgtaatgagttatctgtttttcatttaattcaggaaatttttgtttcatatattttgaatctctgttcttaaatatacacacatttaaaatacttatgtctccctaataaacccttttatcatcaggaaatatttgtctgtgaaaatattccttgtactgaaatctactttgtctgacattaacatggtcatgtcggcattcttactttttacattatattttttccatttttgactttcaactcatatatatctttaattgaaaaagcatgtccttttgccagatgctatatatcatgggtattctaattttgcattttgagtatagaaatgtatgtcaattgcctactagaataataaaatagaaatgtttaaaataacacaacagaactcaaaattgttacaaggctggctttattatctacaatgtccagttttattactaaaatttaccagatatgtaaaaagatggaaaagtatgacctatactcaaaaaagggcaatcaatagaaattgactgaatgggcccaaatgttataattagtagacacagatttcaaagcagttgttaaaaatatgttgaataaattcaaaaaagttcaataattaaataaaatataatgttaattaatagactagacagaaaatcccaacagacaaatgcaaactatgcaaaatgtaaattctaaaggtggaaagtacaataactgaaataaaaaagattcactagatgagctcaacaaataataaatgacaaaaaatgtataaacttgaaaataaatcaacatatgttatctgcacccaaagaatgaattaagagaataaaactaaacagagttacagagacctgtggggcaacatcacactctcacatatgtgtaattggaatacgagattgagaatagagaaagaaggcaagaaaatgttagaaggaatatgatcaaaaacttgaaattcgatggaaaatattaacgtaggagtctgagaaactcacaaaacacacgcagaataaatgcaaagaaaaccaccactaagcatatcatagtcattttgttgaaagccaaattaaggagaaaatcttgataggcagagaataatgacatattgcatactgcagaacaatgataatgttaaatactgatgtctcatcagaaactatggaagccatcatactttagaaagatacattcaaagcactgaagagagggaataaaaaacatgtcaagcaagaactctgtatccataaaacatttttaaaaatgaaggaaaaattaatacattttcagataaacagaactgagagcgtttgtcactagaagacttacattacaagtaatcctatagtgttctgcagactgaagagcgatgaaacgagatggcaattctgatgcctagaagaaatgaagacaaccaaaaatgatggtaagtatgtgagttagtaagttaagaactcttctctctctctctctctctccctcccctcaccacatatgtgtgtatctgtattttctaaaaaacatgacattttaacaaaaattatagcactttattgatgagtttacaagatatataaatataatgcctaaaatgataataacattaaggatgggggagagatgactagaaatatactgttgcaagttttctatatttcacctaaaaaaaaatcaatactaattccaagtaggtaaggctaagttataggtgtatattttacgctctaaagcaataagttaaaaataatttcaaaacatatagttagaaaactaaaaaaggcattaaagtggaatgcttaaaaatgttcaattaaaataaggcatctaaggaacaaatgacaaaaacaaataagacaaatagaaaaatgggacacctcagtacaaccatatcagtaattacattaaatgtatatggactagatactccaataaaaaggcagcaatcaagatttttcaaactgtgtaaaaaagtaagaaccatcaatatgccatccacaaaataatgcactttaaatataaaaacacaaataaattgaaaataaaaggatggaaaacagtaaacataataaagtggagtagccatactaatatcagccaacatgaaattcaagacaaagatactagagacggagggacattttgtaatgataaagagacagttcaaaagaagacataacaactgcaaacatatgagcctaataaatgaacttcaaaatatatacaggaaactgacagaactaaaggaagtcatgcacaattcccacagtcataattggagactctatcagactttctttttgccatgtagattttccaaatgttaatattctttttatttatcaggttttataaaggaataaaacattacaaatacagctgacgtcccgcctttctatcacattctcctccctctttctttgggcattggtaagctaataataattcaggatgtaaatctctggagtgtgtgttcttggagtgcagcactatatcttattaatcttgaatttttagctaatagcagtgcctgactctagaagagacaaatgaattttcaaacaattaaataataaatgaatgaaagggattgtttttataataataataatttttatctttgccatatgtaataggggctctgtaaatgtttgatgagtttgggaattaataaaatagctttgatttcttactgagaataattgcccctaggtgtttttttttttatactttaagttctagggtacatgtgcacaacgtgcaggtttgttacatagttatacatgtgccaagttggtttgctgcacccattaactcgtcatttacattaggtatttctcctaatgctatccctcccacactctcccaccccaggacaggccctagtgtttgatgttccccaccttgtgtccaagtgttctcattgttcaattcccacctgtgagtgagaacatgcgatagttcttgagacagtttgctcagaatgatggtttccagcttcttccatgtccctgcaaaggacatgaactcatccttttttatggatgcatagtattccatggtgtatatgtgccacatttgcttaatccagtctatcattgatggacatttggtttggttccaagtctttgctattgtgaatagtgctgcaataaacatatgagtgcatgtctctttatagtagcatgatttacaatcctttgggtatatacccagtaatgggatcgctgggtcaaatggtatttctagttctagaaccttgaggaatcgccacactagttcaatggttgaactagtttacgctcccaccaacagtgtaaaagcgtacctatttctccacatcctctccagcatctgttgtttcctgactttttaatgatcgtcattctaactggtgtgagatggtatctcattgtggtctatcagactttttaagtaattgttagaacaactacaccaaaaaaaaggtccttaagaatctgaatgacaaagtcagtggctttaactcaaatgacatttgtagaacactgcctccaactactccataatacacattgtttttttgtttttttttttttttgaggtggagtttcgctctgtcaccaagctggagtgcagtggcacaatctcagctcactgcaccctctacctcccggattcaagcaattctcctgcctcagcctcccaagtagctgggattacaggcacgcaccaccatgcccagctaatttttgtatttttagtagagacggggtttcaccatgttggccaggatggtctggatctcttgacctcatgatccgcgcaccttggcctcccaaagcgttgggattacaggcgtgcgccacagcacccagcctattttcaaatgcatatgtaaggcttaacaggctagactataagctgggccattaaacaaatcttagcagatttcaaaagcctggaatcttacagaatatgttctctgaccacaacagaattaaggaaatcagcaatgataaaacacctagaaaagtcctatctggaaatcagacaactaatatgtaaataaccaacccataagtaaaagaaaaaaaaaagtaaattagaaaatatttataaatgaatggtgattttaaaaacacaacatgtcgaaatttataggatgcaattaataagtcagttcttcaaactttataccttaaacattttatgttagtgaagaaccctttaattttgaagattatgttaactaatttttattactttgttcataagcctcatgttgcttttgttgttgttgctgttattagcgttttcattgaaatatatatcttcactcatataaatatctgtcatatgcctaataacaaggtgccaggttttcttggttttactcacctacacatagttggtgattgaatgcactttgaaaactagatctagtgaaatggcagacatctggtgctgctcttcttgtcagaagtcagatcgtctcctcttctctaatattctgaacgcatataccatactcatcctacatttccattccttcttttcctatcgctgtccccgtgtaagccatcatttaaaattattatccagcagagtcgtggaaccaccttatgctagttaatgagaacaaattgttaggtttcaggaattatgtgagatgatcattaatcacaaccattacaaaaaatatataaagtaacaaattatttatatttaaaatataagtaataaatttctcaaacttattacttccttatcactttatcacattttactattttctgtgctcttaaaattacttatatatattgtatctttaggtaaaaacaccaaccatataatgaagtgttagtgcatatcttttgtgtcccatggcatcatgctggtaacttgaaagtgaacatggtggggatatttacaccatggaaatctgcaaatgctacaaattagcactttattgatttgttgatcattaatgcagattaaaagttaaagtgtgttgcatctgtagttgttacattctaaaaagcacccaatatttgagaaataatcttccagtatttgcaaactattaccatattcagcaagaagtcgtttatgtcattgatgaatcggtgaaattctaacttatatcttcattgtttcactttgtccaactcattaatgtatattgaaatgttgaccaacattcttactggacctacacacattcattgatgacatgaataatttctttgctgaatcatatagtaaacaagcatttattcatcttctgaacaaattgcaactgtgaattagctatggaaacatgagtttggcaaaaattaaacaaaaacacttttgtaaaaatcaattgactatatgggatttgcagtaaagagtactgtatattttataatatatattaaaaatgtgaaacatcattttaacagttaaattcgtaatactttgttgtatacatttttttccaagagaactggttattaacatttaccagcataccaccgattatgactctcaggatgtcacaagttaatttttccattttctcacccttgcttttcttatttagaaagaactgtgatcttccataaatacagcaaaaaaggtagtaaaaggtagaaaatagtacataaattgcattatgaatcagtgcctggactgcagagggatggctactgttttggtttattgcaactcgctgagtctctgagccagaaagcagacagggaggtccaaagcctctttctgattagtttcaggctggcagatttgctcggatatagaaactgcacaaaatgtttatctcaatccaaacccatcaatcttgcagttcccaacaggttgcagttgtaataggttcacccattctgttttattattatgagtttttattattctcagtgccttaatttcatatacaatgggaaaagagaatatgtaatttagtattattatgcaggtgacttttaaaattggaattcagaatccgtgattttgatctagtggagataggagaaattttttaaaagttatataaagttctcctggatagatgactagcttacttctatctctagctgaagtgataaaattaaagtaagtccctataccatttattttctttatagtctacttaattacctggaccagatttcttctttttttaagcattgtgtctttattttattaaactttaaaaatatttttcaacttttattttagaaatgaggggtacacgtgcagatttattgcatgagaatattgcatgatgctgaggttttgggtacaaatcccatcactcaggtaatgagcatagtacttggtaagtagtttttcaacccacgtctccctcgttgtctcccacttatagtaatctgcaggtctattgttccaatatttatgtccatgtgtgctcagtgtttagcttccacttacaaggaacaacatgcagtatttggttttctgttcccacattaattcatttaagactataacctctaattgcatccatgttgctgcaaaggatatgatttcattctttttaatggctgcgtagtattccatggtgtatatgtttatatacacattttctttatccagtgtaccattgatgagcacctggattgattccatgtctttgctattgtgaatagctcagtgatgaacatatgaatgcattgtctttttggtagagtaatttactttcctttgggtgtatatccaataagattgctgggtcaaattgtagctctctccattttaaattctttgagaaatcaccagacagatttcttggattcaaaaattaagaattttgtttatcttcattaaagagtacataaatgtgtcaagaatatctgctatttccaaatgcactagcttgctatctaattttaaagtgtttatgcaaaaatggtgatgctaggtgccagagaggatttcaagaggaagagagcaaagcgaaaacaattctacaatccagttcttattttctgggtcttcatatatatttagaagtcatgagaacacacaaatgaaacaattaggcactaataaacttgtgccccaaggaaagcaaattgagcactatacatagtgctgtgtgagggtaagaaaaggcaggtcaatataagagagtacctttaatgaatgttgaaagataaagtcaaatatatttaaggagcaaaacaaactattaggtcccttcaaaagtaacatctctcataggctttttggcagttatagcttacactctcctataataaaatatacattgtcttgtaaccaacattttcagagaatttgcccttaaagtcaattctgggcagacccaagtcaaaggctcttcaggtttatgttttaaagcctcaacattcaaagtttttgcaattagtagtaatgatgtaaaaaaacaaaaaaacaaaaaaaactaattacaccttccttccatgtattggccactggtaaatgtttgttctaatttgagaatacattgaaacttcttgcatcaaagtgttatatgaagaatttgcctgaaatatttgcatgagcatttcaccatgtgaactattgtgttgaatcaaagaagaatcaaaagtcagtttactaacagtctgactctggtgaaatagcaattataggaaatacataaaacttctttgaaaatagcagatggttttagacccttgaggaatcgccacactgtcttccacaatggttgaaataattacactcccaccaaccgtgtaaaagcgttcctatttctccacatcctctccagcatctgttgtttcctgactatttttaatgatcgccattctaactagtgtgagatggtatctcattgtggtttcgatttgcatttctctaatgaccagtgatgaaaaacttttgttcatgtgtttgttggcctcacaaatatcttcttttgagaagtgtctgttcatatcctttgcccacttttggatggggctgtttgtttttttcttgtaaatttgtttaagttccttgtagattctggatattagccctttgtcagatagatggattgcaagaattttcccccattctctaggttgcctgtttactctgatgatagtttctttggctgtgcagaggctctttaattagatcccatttgtcaattttggcttttgttaccatttgacccagcaatcccagtactgggtatatatccaaaggattataaatcattctattataaagacacatgcacatgtatgtttattggagcactattcacaatagcaaagacttggaaccaacccaaatgcccatcaacgatagattggataaagaaaatgtggcacatatataccatggaatactatgtagccataaaaaacgacgagttcatgttttttgcagggacatggatgaagctggaaaccatcattctcagcaaactaacacaagaacagaaaaccaaacaccgcatgttctcactcataagtggaagttaaacaatgagaacacgtgggcatagggagggaaacatcacacactggggcctgtcagggggtggggggctaggggagggatagcattaggggaaatacctaatgtagatgacaggttgatgggtgcagcaaaccaccatggtatgtgtatatctatgtaacaaacctgcactttctgcacatgtatcacagaacttaaagtataataaaaaaaaaaaaaggaaagaaaattgcagatggtgaagtgaaggagtactacatgtcctgtcttgataggatatgatcctggtcaaaaatccttctgtaggtagccgtgctcatctattaggtccactccagggatgaggatccctacaaaaaggttcattgtgtccctctctactctacagttgctttctgtatctcagcctgtggattaatcagaaactattgtgaaaaattatttccagatgctgcaagtgggagggaggaaggaaagtaaagagaaaaagaacgaaagagaaagaaagaaaaagaagaggaagaagaagaagaggaagaagaagaggaagaagaagaagaagaagaagaagaagaagaagaaggagacggaggagacggaggagacggaggagacggaggaggaggaggagaaggaggggaagaggaaggagaagaggaaggagaagaggaaggagaaggagaagaagaagaagacgaaggagacgaaggacacggaggagacggaggagacagaggagacagaggaggaggaggagaaggaggggaagaggaaggagaagaggaaggagaagaggaaggagaagtggaaggagaagaggaaggagaaggaggaggaggagaagaagaggaagaggaagaggaagaagaagaaagaagaagaagaaagaagaagaagaaggagaaagaagaaggagaaggagaaggagatggaggagacggaggaggaggagaaggaggggaagaggaaggagaagaggaaggagaaggagaaggagaagaagaagaagaagaaggagatgaaggagatggaggagacggaggagacggaggaggaggaggagaaggaggggaaggggaaggagaagaggaaggagaagtggaaggagaagaggaaggagaagaggaaggagaaggagaaggaggaggagaagaagaggaagaggaagaagaagaagaaagaaggagaagaagaagaagaggaagaagaagaagaaagaagaggaagaagaagaaagaagaggaagaggaagaggaagaagaggaagaggaagaagaagaggaagaagaagaagaggaagaggaggaagaagaggaggaggaggaggaggaagaggaggaagaggaggaggaggaggaagagggagaggaagaagaggaagaggaagaggaagaagaagagaaagaagaagaagaaaaagaagaaggaagaagaagaaagaagaagaagaaaagaagaagaaaagaagaagaagaagaaaagaagaagaaaagaagaaggaagacgaagaagaagaggaagaggaagagagaagaaagaagaagaagaagaagaagaagagaagaagaagaagaagaagaagaagaagaagaagaagaagaagaaggaagaagaagaagaagaagaagaagaagaagaagaagaacaagaagaagaagaagaagaagaagaagaagaagaagaagaagaagaagaagaagaagaagaagaagaacaagaagaacaagaagaaccaaaccagggtagatgaagacaaagttaaaaagaaagaaaaggctggtgctggcagagagccttctgctccgatttgaggtgtatgcattttatgctgtaaagcgtggccagtcacaggaggattcaaaggcgaggagagatatgatcaaatctgcacttgggaaagcgcaccttggtgcgcatctggggatagaggaacgtagggatgggaggatgggggatgggagtttggggatgaggcagctgaagaacagagtcttgtgatggtggaaccaggacttcgttgttccttcattgtgtgggcagaagaggtggaggattttaggcgccacctggtcttgtccccactgcccaggtatagctgctgtctggagcaggggcctcgagacgccgctcaagtctcacgggcagatgggttggacaaaacattgccccccttcttcttcccagacaggcagggaatccctcttcttccttttgctgaatcagctggagaagaaagcccagcaggaggcctgctagcctcagcctcgggccctaccagggtcctaggtactggaatggaacttcgccgaggtcaccgctcaaacggccacaacgagggagccgatttagatcctctgggcctgttccttccttttctttaaacgtcccagtctagcttagaggaggacctgttttgtgtaaggcttgccggagcaaccagcacctttcctggaatacagtcttgtttgtggcttttcctttgttgtacgctagcgtgcactatcgcccgcacgctgactgacccctgttctacaccgcccctgataccactgaatagggagtttgagaagtttatgtcgtgccccagaaaacactagtggccttgttctcaagattaaatatccttagagcagccagatctgaagagggaccccagaaagatccacgggcatgttcatttgtttgcaattgataatataggaaacactttctaatatttcaggaaaacaaaacctttaaaaaaaccagacgacgtgtaactcctaacattcttaccttgcttcaggactgttgggaggataagatagtgtggcagctataagcatttagcatagagcctagcatacaatagtccttccatgacattagcttctctctccccagcaaagatgacactgcataatccaatgtacagtggggaaatttttcactagtacattaagatgttatttgcagttagaaagaatgaatactgtaatcccagcactctgggaggctgaggtgggaggatcacgggtcaggaggttgagaccatcctggttaacacggtgaaattctgtatctactaaaaatacaaaaaaaattagcccgccgtggtggcgggtgcctgtagtcacaggtactctggaggctgaggcaggagaatcgcttgaacccaggagacggaggttgcagtgagcccagattgtgccactgcactccagtctggcaacagagtgagactatgtctcaaaaaaaaaaaaaaaaaaaaagaacaatgaataagacctagtatttgctagcacaaacaggtgactgcagtcaaaaaatctaaattgtacattttaaaataactaaaagagtataattggattgtttgtaacacaaaggataaatgcttgaggtgatggataccccatttaccctgatgtgattattatgcatggcatgcctgtatcaaaatatctcagatttaaatacacaaatatttaagtacataaatacagagatacataaatatatacacctactatgtacccacaaaaattaaaaattgttttaaaagatgttatttgcatgcataaagaaaatgttatttaaatttcctacttaaaaatttttctttctttttcctatgatagtagataaatggcaagcaaaaaacgagaagtccagttacaggtgggtctgacatatcaacaattctttatctggtgcactagtgcttgaataccttttacagtgccttccactttgcagacagtcatcaataatcaaagcctgtgggatgagatgttgcagaacaaaggcttaacaggtataaggactccccggctgtctggccacctggggtttgacccggagctcctcctggcaccctgtccctctagagtccccactttgaccaagaaatcctgcagtgcctttgccctggccatggctccagattgggataactgctatcctagattggtagactttgttatttcataaatatcatcatcttctagtgattgatgtttaccaagcctggtgtggaccttgcagagcaatgcaacctttattcagaaaattgaaaaatgaactgaacgaagacgaaattctgcattttgctgtcgtaagaattttgttttcattaaaccactgttttcacattatattaagtttttaagtatcctctaatactttaagtattgtcttaatttaaacaacctgtcagttcttcaaaatagatagtctttacttggcagttttactatatatttaattctactagatctgagaatgaatatgatttttatcccattcttataacgtcgaggctatttaccatgactgtgaaagtcagaaaagtgtaataatggacacatctattgttctgtttcctttcacctgaccacatgttcagtgtgtgtcctttagaataagggctacaaaagctgtttactgggtatcattgagtagtgccctggcattaacccagttaccatattttccagtggcaatgatttttcctcatttatttgctacctacttgcaataagggattaaaatattatagccaaacacattttactgaattgtactgttttttcaatctattcacataaaatgatcaactaattagaatttcgttgtccaacatggtagctactaggcataagtgactatggagctcttgcaatgtagctggtccaactgaggagctcaatttttaattttaatgaatttaaatctggattttcaaactgatactccattgagttattgtaaaacttttaaaatctgggataacttgagtatgtgaatctactacttaactgtaaatgttattaaagctaattaaggattaattatttctgattaacatttagcatatgaattaagacatactcaagtgtaagagacacattagattttaaaaatttaatatggaaaaagaaagtgaaatatgccatcaataattttatacattgattacatgttgaaatgataatattttggatgtatcgggttaagtaaaatttattatcacattattttcacctttttttgtttttaaatgtccctactggagaatttatatgtgtggcttatataatatatttatattatatagaaaagctcccaaaccaactagacttaagatacaggagcagataacagatgataacagatctttactccttatctctgaaatacatagttcctaatgcagacatgcaaccacaacccactcatgttctcccagttacaggtctttcatggcccctttcaacccaaacattggaatgggtttgcctactgaccttgtatttcactatccatccccttctttaaatgcattttccataggacttattttccttagttcaagatgatgaataagcagtttaaagcctagacactcacctcttattatttttctattcaagagagtaagtggctgtctacagtagttaaatcctgttgtcctggtgaaggaattgactttttttttttgtcttctgaaataaggactttgtaaggttttcattcctttaattttttaaaaaatgtctttatatagatgttatttttagagcagttttaggctcatagcaaaatttaccaggaagtaaagagttctcatatatcccctatccccacactctcatagccttttccaccatcaaaatcccacatcagagtggtacattgttacaacggattagcctacactggcacatcattatttaccaaaagccgtagtttacattaaagttcattctcggtgttgtacattttagggagtttaacaaatgtgtaatgacatgtacttactatattatggcatcatatagtatagtttcattcccagcaaaatcctctgtaatctgttcatctctccctacctcataacctctggcaaccaccaatcttttgactacctccatagttttcccttttccagaatgtcatatagttagaatcacatagtgtggagccttttcagattggcttcttttacttagtgatatgcgccatgtcttttaatgatttgatagctcatttctttttagtgtcaaataatacttcattatctggatataccagggtttatttatccattcacctgctgaagaacatcttggttgcttccaacttttagcagttaggaaaaggctgctataagcatccatgcttaggtttttgtatgaacatactacactttcaactcatttgggtaaataccaaggagtaagattgctggatcatgtggtaatgatatgttttattttgtaagaaaccaccaaatcttcctaagcagctgtaccattttgcattcttaccaacaatgaatgagagtttctgttggtccacattctcaccagcatctgttctctggattttggtcatcctaataagtgtgtagtggaatcactttgtagttttagtttgcgtttcccaagattatgtgaggtggagcatctttatatatacttatttgccatctgtatatcttctttgaggaggtgtctgctaaggattttggcttatttttttaattgggttgtttgttctcttattgttgagtttcaagtattctgtgtattttgaataacagtcttttatcaggtattacttttgcaaatagtttatcccagtctgtggctggttttttcattctcttgtcattgtagtttttttaaagacgagattctgtaacaacctgtttcactctggagaatcacaaccaccagaaaggagctaggaaattattctagacttgattcttcacagagaagaaaaatcaagttagaagaccagagaatagagcctaaaggagattgccacatgcagttggaaaggggttgatagaagttaaaatacagtatcacaagtgtctaacagctgacagatggatcacagggaattgaggatcaggaaattcttgtgaatcctggcagttggcattaggaaagtggcagtagacgttcacatagactaggggttccagattctggtgacctgcccataaaggtgaaagaaaattatatctccaaacctccattgtgagcagcaatggagggatgccctctgccggacatattgttttctgctgttaatcaaggaagaacttgaacatgtaggtccaaaattaaaatgtatgaggttatttcctattaaaattgccctgagctgaatggtcagtatacaatttttttctgctgtgtgcctttttaaaagaggaacattaaatattttatatatatagagagaggcatataaaaatttagttaatagtgtttattatagttactgttatattattattaaattatttaatccttaataatttatgtattataatataaacattataattataatacctgaattacttctaaatagagttgacccttaccaatgctggagttaggggtgctaaccccccacgtagtaaaaaattcatatatgacttttgactccaccaaaagcttaactactaataacctactgttgactggaaaccttatgggtaacataaacagtcgattgatacatattctgtatgttatgtgtattatatactatattcttgcaataaagtaagctagaggaaagaaaatagtattaagaaaattataaggaaaacaaaatatatttactatgcattaagtggaagtggattaccataaaattcttcatcctcatcatcttaacattgagtaggttgaggaggagacgaaggaagaggagttggtattgacgtctcaggggtggcagaagcagaagaggtggaggaagtggaaggggaggcaggagaagcaggcatagtggatgtaattttatggaaatacgtggtaatttctgtctgacgtttttgctttttcattgctctaaaaatgtttctatgtggtaccaatccttcttccaccatttgctttggtttcagtgcccatatcatagaagggtccatgtcataaatgaagtcaaaagcagtcttgaataactggaattcttctgccagatgttctaatgtcagtttgttttctggcactggctcttctacatcttctccctcatcgtctggcactgctttagaggcactcatctctaccaatttgtcttctgttaattcctctggtgtggtgtctctcagctcttggatttctccaacatccatatcttgaaacctttcaccccccacctttttgccacatacacaatctcttttatgacttccttaattggctctgtcataaatcccatgaagtcatgcacaacatctggacacaattttctccagcaggaatttattaatttgtgcttgatagcttttgcagctttttctataacaatgatggcatcttcaatggtgcaattctcccagactttaatgatgttctatcagggttctcttccatagcactgacattttttccatagagtaccacgtgtaatgagccttccaggtccttatgagcccctgatctagaggctgaattatagatgttgtgtttggagacaagtagatcattttgagacctttgatgtcgacctcatgggattctcagtgaccaggggcattttccaatatcaaagaactttaaaaacagtctctcactggcaaggtacttcctgacaccagggacaaagcactgatggaaccaatccagaataaaaggttctcattgtccaggatttcttgtacaactgaaagactggcagctggtgttatcttttcctttcaaggattgggggttagcagttttattgagaaagatagccctgatcataaacccaactgcaatgcataaaatggttgagttagcctatctcttcttccttaagtcttggtgctcacttctcttctttactaaataacgaactttgcggcattcccctccccccaccaaatcccaagttagggcactttcatctgcattaaaaacctgttcaggtagacatcttttctccttaattattttcttaaaggcatctggaaacttttctgctgtctcttggtcagcagcagctgcttctcctgatatgttaatattttttaaccttttcaaaaattatcaaaccatcctttgcaggcattaaattctccagctttagatccctcgcttacttttgctttaagttgtcatatgataactttgcttttttgggaatcatattagagtctataggcatgcctttcttatagtaatcctgcacctgcataaaagctgcattttcagtgtgagataaaaaggtatttcagaaaaagtgcaagatctatatgcctgctggcacagctgcagcaatggctcaatgaacttcctttaaaaaaaaaaacccaattactcttagactggattcttttatcttgaaatggtgggcaacttcagctgcagacctcaatctagggtacctatcaggcaagtcagctctttcttgtaatgtcatgatttttctcagctttttagcagcacttgcaacatccctagtagcactttatctggatctcaaggtgttagtcaaggtttatggtattgcactgaacacaatgaaaattccactttgaaaagcattgccttagattacaaaaaccaactgttataaactgaatgtttgccatcaaatttcatacgttaaaatcctaatctccaatgtggtgatatttggagatggagactttagaaggtaattagagtaaaatcaaagcttttatttaaataaaggaagagacatatgatttcttccaggtgaggacattagtggagaagagggccttcacttctggcacccagactgtgctggcaccctaatctgagacttccagcctccagaactatgagaaataaatgattgttgttcagccacccagtcaatagcaatttgctattgcagcccaaactgactaagacaccaactcttacagaagaccctaccaaacgatctcattctggcagctggaccaatggatactatgttaatatggaagaagacactattattgaatgtatagttgttcataattaatttggaacaacttgaaatttatgagaaaatattaagaaaattacagacataaaattcaaaatctttaaaagttgactactaatttattcaaggaatgtttagtaaacctcttttaatgtatggccctatgactgacagagggagatgagatacaaacgtggataggaaacatactatctctgtgcacacaactctccttctaacagagcaggtgtaacaggcccacacgtgcctgtagtagaatattgaaagggacataggtgccttgggagaggggcagtaacgtgctgtgcagaacgagagatgatttacagcaaaaggaagtgagacagaattggaggaaggatagttgaacagggacagtaaaagaagggcaggaccagggaggaaaagatgagtaaataagtttggctaaaggttggttaatgtaaagggaaacggtgcggaaaggttaaggccaaatgacgtagggcttgaatcgccagtatgtgcagtttgatccctaaaaccactaaggcataccgaatgttgcagtaaacctaaaaattatatatatctctgcattgtttcaacatagtgtatcaaattacttgaatatagttttatttattattatatgaaatgtttactttttccaggcagaagctgacaacattgtgactttgcagccatttagagataaatgtgaacctgtttttctctttagtgttgtaagtatatttactttctcaattgcattatcagattccagtttgcagttaagaacaagtaacattgtaaaattaccatgaaattgtttgccaatgacagtaattacacaatgtttgccttatcttttcttgactatttataaattttataatttggctgctaggagcttattatggattgaagggattagatgatgacacactggattcatcagggaaaggaaaagtaagatggcgtttatctttactaaggaaatgatcggagatttgcacaataaattttttacaggagtaaaaccttggaaatttcatagatacctagcaagagagaactggttataaacattcatgcatatccatacaagaaagcatctgtatgatcagtcttttgtaatacacattactcttatctctatatttataaagaagaaagcaagtggatccaccaaaatgttatagcagttttctatgtgtgaggaacaggtgactaatttaagttttattattcatactattctatattttccacatattctgtgaggaacacacaactttaataatcagacagaggccaggcatagtggctaacgcctgtaatctcagcactttgggaggctgaggtgggaggattgcttgaggccaggaattcaagatcaacctggccaacatagggagaccacatctccattttcaaaaataagtaataataaaataaatataaaatataaatgaataattagaaagacataaatagtgctattttctaaaagcagagtgtacagttagtgctaaattgtgtgacacagggtatagctgctacagagttcgagaactgagacagaagaaagaaagccttcacggaggagatagacaggacttggactgttcctccactgtggatatttatttttgatattagaaatactcattaaaaacacatcttggatataacttttttctgctattaaacaatattcttgcaaccctttcaaagagttgaatcgctgggttaatgattaaaaaatgcattgaatggtaaaaaatgcattgtagatctcctctaagttggatgtttagaattcaacgatttaggtgaggggtcagctaacgttgtttttgttgttgttgttgttttgttttgttttttgtaaagggccagggagtgaataatttcagcatgattaaaatacagtctctggactgggttgaggtttgctgactcctaaactagatgtcattacactcatgaggggaccagaatgaataacaacacagaggcagaatgggcttggggggctcatggaacaatgaggaggctttagctgcacgtagtgggtaggtgcatgggaatgagagaaaagattgggcaggtgggtcacattgtagaggctggagctctgggatagtcgataatatagtttggatatttgtttcctccaaatctcatgcagaaatgtgacctccagtgttggaggtggggcctagtgggaggtgtttgggtcattggggcggatgcctcataaatggcttggtgccctccctacagtaatgagtgagttctccctctattagttcatgcaggagctagttacttaaagagcttggcactgtctcacctttctctcactccttctctctccacatgacatgctgtctccctttcccttcctccatgagaacaagcttcctgaggcctcaccagaagcagatgctggtgccatgtttgtacagtctgcaaaagtttgagccaaataaatttttctttacgaagttcccagcttcgtgtactccttgataacaacacaaaacagactaatcgggccatcaccccgaccgctagtccagtctgaccagtagacccagccccactctccttaagtgtaccatccaatccatgttctctaatgcctgcaatcagtgcccagagtttaagtccacccttcctcatagccatgtttcatccatccttctaatgcttattctttgtcacacccagttctccaactcttcccctatctcccaaacctttccactctatgacatctggaattaaaatgacttcctaagatttttgaccatggctctgagcttttgtctcgcttccttggcttaccttagttctaccttcttcctttggacactctctccacagcccagaagtgataactgtttatttcagaatgtgaagtatagttggtgtttgctttacttcttagttcttcaataactttcttttctttgctattactagaggtctgtttcacgtggctaaatctccaattcccccatctcactcctgtcatttaccgaccttcagatcaggtctattgatgactgaagtctttggcgtgtggtttaaagtcttactctcaatcctgagtcctgccatcaccttgaggactttagtatccacactgacaacccgcccaatatcctggcctttcaattcttgacctcctggctgctaataaacttttcttccaataaacttcatcgaatcactcctgcaatcatgtctcagactgcccattgctccacatccataatcattaatttaagaatagaattctgtgatcacaaaaacaccatcaagtccaatgctcattttattcagatattccctcaatgtccctttgtacgggtcagcatttttagctgacaacagattcattccagctagtctcagcagaagccttcctcaagagatattagataattcacagaattgttgaaagatactttttagttggaaatggtaactagagtttcaggtttcatttaaaccttactcaactgtatctttctcattggcttttgaatatgattaagtcttttcaatttaaaaaatatataatacttctttctgatagcatatccctctctagccaccatccatttcttgtcttcacctcacagctaagttggtcagaagactttttatatttaattttacttcttttcttttcatcccattaactcctcaatccattctacctgagctctgattattccaccaaaattgctgttgctaatgtatccaagtaccagcctgtactaagtataatggatattgttaggtattcatcatttgtacctcttaaatggtttgaatatggtgaccatgccctcctttttaaaatatttgcttcttttggcttatgtgacttggttttcctttcaccttcctggatgccacttccctctgttcctttggcaaattcacccttctttattccacgattaaatattgactttatcaggctgtacgctctccttagaaaatttcctctacacacagtttcaatcaccaccatctgtatatcaataaatcacgtttacatcttcagctgaatgctatgctttccactcgcagcatttccagttggggtctaggcatctcctattggctttctcaaaatgcatctcacagcaaactcattcaataccagatcttcctccccacaaaacacagtccccttctattgtctctgaatttggcatataatatgataacttataatttatccagttttcaagtgagaaacagaagagtcaccttgtgacatctctttacatcacattctatccaagtcataccttggacctgtaaattttactgcccaggtctctgtcacactcatctacctctttccatcctttccatctccaccaccgtcatctctccacctccacctctagcatagctcctaacttgtctgcgaatattttcttttgctccccccagcattttttccacacagtaggtgaaataatttttacaaacaattttaatcatggtcatggcctctgcttaaacattctgactgcacttaggatgaagactgaatccctggcccaccaggctgcgcacagtttggcttctcctggttgctgggcttcaactcacaccaggctccccctcactttgtcacctggccttgtcacttgccatcttcccttccagctttagaacccttatgtctgttattccttttgctctttcttctcctttttgcccaattagctcttacccgtctttcatattttaaaccaagaatcacttcctgacattgagaagtacctttcgtgatctctttgaccaaaacccattcttataggagctccaagggctttgcaccactcttggtagcacctactaaggttgctgtttcacatgtttgtgtttttatgtagggctttttaaaaaaaacctaattaggtcaggtaccagatccattattttataccattgtgcctggtacggcaccagtaaacagatgcttagtaaacaggtgttaaaagatgagtgagtgaaaggggcatggtgtcaaaaataactagggaggatgtcattgggaggcctatccagaattgttcaactttaaagcaaggatgcctcaggagagattgcatcaggtgagagctcctgcagggggatgacttgctgcaaggtgctggaggacatgcaaattggaggtagaactcaaagagctgagtttatcaagtcaagaacattcacagtattaagaccttactgtaaaacgttaattaccatagctaaaagaggattcatgaggatgagagtagggtagaagggagggatgacttagtccagtttaagtgttagttcttggtgtgttctccaaatgaaagttcccctcctgttttcatttcccttatagaatggcaaaattatcgaaaagattcagggtgcaaatgcaccgcttgttaataaaaaagttattaatttgatcgatgaggagagaaaaattgcagcaggtgaaatggctcgacctcaggtaatactttggattaacaacagtttgaagacaagcttatcatttagagtgaaatagaacaaaatgcactactggtgctaggtacctctaaaggctttgagtactttatgtcttttaattttaaaaaagtacattaccttttatttgatgttatcctaagttgtttaacctaattttgtaactatccaggtgtgtaaatggtgcaacttttctgggaagcattttggcaatgcatgtgtatatatatttatatacataaaaatgaaacctttcggatagttcacagaatcacagaagcatattcatggcttccctgaaagttaggaacctttgtccttctggtactttgctctttttttttgtttttaaattgactttataagtgtaagtatatagcaattatttatttgaaatttgtaagaacataaaagctatttggatgaattaaaaaatctggtactttgctctttaataggatattgattattggtttgagaaatattttttttttagttaaggaaatatcgttttgttccaaatttgctgagagtaatggttaagaacagatcttcacacttatcaaatgcccttttgatatttaacatgattatcatgtgtttgcagttttcttatttattaatttctgctttgttcttattttatctcccatgctcttattaaattttaaggtttggctgggtgcggtagctcacgcctgtaatcccagcacttcgggaggccaaggagggcagatcacttgaggtcaggagatggagaccagcctggccaacatggtgaaacaccgtctctactaaaaatacaaaaattagccgggcatggtggcaggtgcctgtaatcccagctattcgggagactgaggcaggagaatcgcttgaacccaggaggcagagattgcagtgagccaaaatagcaccactgcactccagcctgggtgacagagcaagactcctactcaaaaaaaatttaaaaaaaatttaaaaaattaaggtttgctacccttttcatactgcacatatgcattattcctgccccttccattttaaaacatcccttattttatttaagtggaaagctggagacagtaatgttagataagttcaggaactcttccactttactttctatttcttagactataaatatttactagatacaaaatttctaaaaacccactcactatcatattaaaacataactgtgttatctttgcattgcatttctttttcatagtatcctgaaattccattagtagactcagattcagaagttagtgaagaatcaccatgtgaaagtgttcgtaagtaaatttacttcaaagtaatccaagggttttctgtacgtgggcggtcatcacagcatcacttgtttcagcaaaacactggtaacaaatccatgtttattaaggaggaattattcagataaatgatgatttgggccttgcaagactcagctattaaaaagcaccttcttttcctcactcgccttacctttggttctgggcctggagcctttcagaggttaccctgtacaatggattcctgtctcctgtgacttatctggacagcagcttcctatttcatccttcatcatcttccaaatatttgtgatgataatttcttccttgatgacccatactcttggtttactttgcagttaacaatttcacgccttcactagattatctgcattggggtagtggggtgtatgtgttcatactctggagggagcagaggcaaacagccataaccaaatgagttatcttgcactaaaagctcattataagaatgtcgatacattcacagatgaatctgtcggtgatgtttacttgcatgattcacagttaaaacttcacttactggtagtactgtgctggatggatcctgtgtgtgattcttacgcatgggaattgcattcaaaccaccagggcctacctactcaatttttgtttcctctggattaaaaactcttgtaaatgtttcccctgcatgcaaatataggaactgccatttgattctaagtaggaaccctctggtagttgaaatgccgtagtaagatacacagctatcaatgggcaacaattaactgatcattagaaatttacattgctaattgccagatccttcattatccagacttcgtgccaagaaaatgaaattctgtctttttctaaatttttttccagaggaattatacagtattgctattatcaaaccggatgctgtgattagtaaaaaagttctagaaattaaaagaaaagtaagtaatattttccaactatgattaaattaattgcaaaataacaacctcttaatcgtcagttcaaagacaagcgtaccatttagagtgaaatagaacaaaatgcactactggtgctaggtacctctagaggctttgagtactttatgtctttacaaggctcgatctattcatgcatccttctgtaaatgatcctactctaccagcatcctatgtaaattttaaaaaattatagttcttatactagattgtatattagtctgtcttcatgctgctgataaagatgtatctgagactgggcaatttacaaaagagagaggtttattggacttacagttccacatggctggggaggcatcacaatcatggcagaaggcaaggaggagcaagtcacatcttacgtggatggcagcaggcaaagagaacttgtgcaagaaatcttccatttttaaagccatcagatctcatgagactcattcactatcatgagaacagtgcaggaaagactagcccccataattcaatcacctcccactggattcctcccacaacacatgggaattgtgggagtttaaaattcaaggtgagatttcgatagggacagagccaaaccatatcattctgctcctggcccctaccaaatgtcatgttctcacatttcaaaaacgaatcatggtttctcaatagtcccccaaagtcttaactcatttcagcattaactcaaaagttcacagttcagcatctcatctgagacaaggcaagtcccttctgcctatgagccagttagatcaaaagcaagttagttacttcctagatacaataggggtgcaggtattgggtaaatacagccattccaagtgggagaaattggccaaaatgaaggggctacaggccccaagcaagtctgaaatccagcagagcagtcaaatcttaaagtttgtatatttttgagccacttcaaaccaagtgtcctatagattttgctgaggttcttatagaaaatgtattgaaagctggtggtttgttaagcccaaaaaacaaacttaacttgttttacatgtgatcccacgacacctggatttgaccttactctctaattgaagattaccaaagctggatttattatagaagcagagcataagacagtgctcactgaagaacaagttgtcaacttctatagtcgaatagcagaccaggtatgaaagttaaaaagaaaaaatcctctatgtgtttaaatacagtggcctccataagctttaaatctttattacagaaaagcaaattagtaagtctgaacaactaaaataagctcctggtgtccctgttggtgtccatatcatggagatgccaatgatagtggctctgaaaaaaatcttcggtagaaatagtggctaccgagcaaaactggatggtctgattgtgttttgttgacatgaagacctctttatgtcaggccctccaagagcccctgcatcagtcctctggaagtgaatatccagtcattttctattgatttttattctgggttgaaggctctgtcaccagcttcacaagaatgctttaatcttttctttacctaagggcctttctctcaggctgccccgaccccaactgccccactcctgccacctccctaccccaccaactcttttttgtctggggatataatataataaaggcagtgctgtgtattagaaagtgtactggcttgggagtcaggagacctcacttctagaaatgaactgtccaatatggtagctactagatacatgtgatcatttgaatttaaattcattaagattaaattacattaaaaatgtgaagtctcagttgcactagccacattttaagtgttcaaatccacatgtggctactgtgttggaaagggcagaagagcatgtacgtcatcacataccattctactggacatcactttgtggaactgactgcaccactcatgccatctctgttggtcccggcttccatgtgtgtagaaagaaagggttatgccaactgtattcgcattaactgtaaacttctgagaaaatccaattcctgggccccacctcagacttactaaatcagaaactgtaggattgggctccagaaatatgtgttttaacaagccccgtagatgacttggaaacatcctaaatttgggaatattgttaggttacctttaagataaattcctactagctttgaacttctgccacttaaaaatgtaggagactagtgactgggaagggatagggagagatttgttaaagatgtgaaccaaaagtatctgagacaggttgcaatcaatttagaaagtttattttgccaaggttaaggacacgcccatgacacagcctcaggaggccctgatgacatgtttccaaggtggtcggggcacagcttgattttatacattttagggagacatgagacatcaatcaatatgtgtaatacgtacattggttcttcctggagaggtgggacaacttgaagcagggttgcttccaggtcttaggtagataagagacaatcaatagcattcttctgagtctctgatgaggcttttactgaatacacgatttacatgtgagatgacatagaggaatagtcacttatgccttagtcttgcttagtgaatctgcgtttttacataaacaactgagcagaggaagccatcagatgtgcatttgtgtctggtgagcagcgggatgacttttggctctgtctgtcctctgtcccctaccagtgaagataagctatcaattatcaatttacattgccagggtgaaatccaacagaactgttttagggtaaagatcttgaggcccacaaggaatttccttgtggacaaattatgagggaggtatgtagcttttttttttttaatctttgtagcaatcttatttaggaataaaatgagaggcacgtttgcctgatggagttcccagcttgacttttccctttggcttagtgattttggggtccaagagatttatttttctaaggatacaaatttaccctgctctggttattatacattttctttattgaaacatcactatgtcccccatgaatatatgcaattatttttcaataaaaagcaaaaataaaaacccccaaacaataaaaatgtattgttaacaggagatttataagagtaacattcctttgcccagggaccatggagagggaagatttcatttgacttgggtagtgaccaccattttagtccatccatttcaggagcctgaaggaaacagtttatcattttattttgtagtgtgacttcgaagagtttgtctcttttatgacaagtggcttaagctatattctagttgtatctcaaggaagtaaacacaatcctccctctgaagaaaccgaaccacagactgacaccgaacctaacgaacgatctgaggatcaacctgaggtcgaagcccaggttacacctggaatgatgaagaacaaacaagacaggtatagctcaagaccaggaattgtgttacttgcaatgtgttattgggtaatgaagcgtagtgtaggcacctcagtacctaagggcaaatgtttttatgttaaaggcataagtatttcttccagtcaacctaacatactgtatattcagaagagctgtgtgccaggtgaagtgtcagatacctggcattggaaaaagtagttggcttgtgggttgtagggtagtaagaatttacagatgacagtgtaggtttgaaagaaaagttttgttagatagaaagagcactgcagaagagtgcagcggggctcctcagtgagagaggactgagctcgccatggtggatttttgtttagggatatttatggaccttaaagctggagcttaagggtaatttggaccttattagccacacaggtcatgataaataattgcacttgtagacatgttggtgccttgatgtcagcaagggttgcacaatgagtttgaacatgcatgcattccggagatgtatagaaattctagttacttataactttttttttaagcctggtaccagatgccagctttaaataatagggaagtctagttacttctaaattcctcagataaggagttttgcctctggatagtcagcttggtggccctcaggtgatctttgctcccctcactgtgactgccctgaaagtttatgtcaagaacactagaaagggaggccttttccctgtttgtcttcctagagctgggcataccagtctggccacaagggctggggcttgaagggtgtattggaaccatgtataatccctgccaactcagtctcctctcccatctccccaccttccccttccaccttcccggtgccctaaaaacatgaaacatgcacttttactttagatggtttgtggttacaaattactgagaacaaaacggttgtatattttttgttgatggattttaaaatattagaaaatggatataaataatttgtagaatgttggttttatgcgctgctgtttgcgcctgttattcctctgaagactcagagaatggagagtgtaacaaagcagttgtcaggctgcaccggaaagaaagtcaggtgagcaagaacatacttagagtatctgagccttgaggcttcctgggatgtgtctccccgtgcttggcagcccatctccattgcattttctggctgagactatccagaatgtcccttgttggtccttcttgacttattaatgaatcatagtggcttttcttgggtgcctacctctgttggctcctagtgatgccatatttttaggaagtgggagatcctaatatcattaattccaagttgtacgcaggataaaggaactcataaggtaaatcctgctggcaaggagctttttaaacagtagcagttactttcagggttttaagggaaaataataatgagtgggctgagggaaggtttgttgggtagggtgtgttaagtttaaaaagataccagattttatcctagaaattttgagccattcaaaaaacaaaaagcgttctatgaagcactcattaatgtgacgagtgaagtcatcattccatggggctattgtttaggtagtaaacctccattacaaccaactttgagaagctccaattgtccaatactcgcatgacaccatggacaatttaggcatgttaattggcatgtcagaaggaaatgccagcagctctccctccagaacaagggcaagcactataggggccagatcagagtgaaatgaaatgtgtacaccttgctctggcacagtctacagtatttcctttctaaacttagagtccccatgtgcctttggcccatgtttatcccaagctggccacagcagacagcatgggacagtgtggagcatgcttgtttggtgtgctcgggctcagaaactgatactcaaaatatggcgctttgacatgctgaactgaaaaagcctcacaatctctctgacttgccccagcactcccggccagcagtctctctcaaagcacaggatgaagctgaatttcttttatctgcctaagatcctcagatccgacaggaacaattatttttcttcctctccctataagaccaagaatgtaaccacatctgaacggagatagtgtacaagttaatttctgtgcgttggtccattcattctccctcgtcatcctttactgtccttcaacagaattcttctccctgctcccattacctgttttgccagatggtctataacaggggtgtccaatcttttggcttccctggggcacactggaagaagaagaattgtcttgggccacacataaaatacactaacactaatgatagctgatgaacttaaaaaaaaaaaaagaactcgcaaaaaatatatatcataatgtttttaaaagtttaccaatttgagccgggtgcggtggctcatgcttgtaatcccagcactttggagggccgagacaggcagatcatgaggtcaggagatcgagaccagcctgatcaacatggtgaaacccagtctcgactaaaaacacaaaaattagctgggtgtggtggtgcatgcctgtagttccagctacttgggagactgagacaggagaatcgcttgaacctgggaggtagagattgcagtgagtcaagatcgagccactgcactccagcctgggtgacagagtgagactccatctcaaaaaaaaaaaaaaaaaaaagtttaccaatttgtgttgggccacattcaaagccttcctgggcctcatgcagccagtgggctgcaggttggacaagcttggtctataggcttctgaacctcattgcagggtgggtactcactctgtggttctctctgtgtacatgttaatcaaatttgtctgctttttctccaactaatatactttttgtctgttgatgcccgttggtttttcagtaaaacttgagaggacagaggggaagctttcccctgacttctataatgcttgttcttattttcacagctcttgctctggagggagggcctgataggcactgtcacttccatgtgacatctttcaagtaggtccagaatctaaaggaataaggacaaaaaactctcatgcgtaatttattcagttgttcactttcactctttattgccccctctcccctatctcccagcctgctcactctcctctctgggtggtggggatggagagggtgagacaggagagaagttaaaagcagagcaattgaactgggagtgattggtgacccctctgcgtacagagcagcggagtcccagagctttattggctggttattcctgtggagacaaacactcacagcttatgaattcacatgctgtggggaaactctctccatgccatcgatggtctgcctgctccagtggctgcagaagggtgggggaagagccagggaaacagggcagaggtacccatgtttgtcattcacattccagcttctttcatgatggctttttattacattatttacatgtctgtctctttaatcagcctgttttaagaaatcaaaggatagtgtaatttatctttgctttccagtctttctacagatcaggaaggtgtggttccattagctacattgctcagagtcacacaggtagtaactggcagagtcttctcattcattcacttattctgttatgtgttgattcattcatctagtatttattaaagacctactatatgccaaatcctagagatacaaagatggggaagaattagatgatgacctctgagctcactttcagtttaagtctttatgacagagtgaaggtgacatttccaaccacctctactatattgtattcctctgtccatagaaaatatctattctcttctcagtagcctctctatttgtccctatacatgtcatagctatagggagcttaattttttcctttatgatattctcatttaaattaaacataatagatacaattcctaaaataatccttaaaagtatttccgggatcagggaagtctgaatgctataccctgactctactcccatctgcaaagctttctttcctctccatagtcaaagggaagcttaactgataagcagctggctgtcagtgaggtctggagctctgttcaggtccctagggcaggagaagatgagggtggtgtggtgttttctccaccgagagtttggggagctcctgaactccccagaaaacaaggacctgcagacaaccacagaccctgagaataacagacttgtggacttcactgagacttcctgactcctaaagggccaggatagaactgagtagaattattgaattccttgccctagctaggtctctgggggcttttcctgattgcccctgcagaagaataatgacccactgtcttctaaagcacaagcttgtagaggtcatcttgccttccaactacagggtttccaacacatatcaaaaatcagacctaagccccagtgagccatcaaggaaaaatgagtacctgcctaagggagactggcagccagagaaaggaaggcctgtacaaaaatcacaacacaagtctagtgaaaaagaactgcttagagacagaaaaacccttaaataaaataacaataaaaaaaggacttgagattcaattgctaggtatacatttaaaaagcctttcaaacttgaattatacaaattgtgatttgaattataagttcagtggagaattggtatgatcatcatttgagactcaaattaatgacatggaaagtcagatgcaagaaatatctgaaagtacacacaaaaaattagacaggatgagagcagaagtctgcaatctggataatatgctgaggggatcaattgctaatgagaaactctgcacagagaaagaacagatggacaaactaactcaacaaataatgggggaatttttttcccagaataaatgcatttgtctgccaattgcaagggcttacaatagtccaccctcaactgatgccaccacacccccaccccacacacaaatacaggaacatcctgggaagaaacactgcacactgtgtccagacagacagagtaagcacttgtatacttcatatgtttgaaacccagagcagatcatcttaacagcctcttcctctgtatgatgaaattatttttaagtactagttactgaatgaggcaaacaattatgctagaataaaaatacagacaatgaaaatagtcttttatgggccagatgccgtggcttgtgcctgtaatcccagcatttgaagtcaggagctcaagaccagcctggccaacatggtgaaaccccgtctctactaaacatgcaaaaattggccaggcgtggtggcccatgcctatagtcccagctacttgggaggctgaggcaggagaattgcttgaacccaggaggcggagattgcagtgagccaaaattgcgccactgcactccagcctgggcgactgagtgagactctgtctcaaaaaaaaaaaaaaagaaaagaaaatagtctttatgtacctttgaatatataaacatatgagtataaaataaaaataaatgttacagtgtcccaaaggaaacaagtgatagatgaattgtttaattaatatttttaacaataaaacacatgtatgtctgtatatattaatctgtcacagaaaatgaagtagtttttgctttttgaaagctttaatttttgaagatttgtccatgatgttctcaaaattgatctccactctatgtttaatagaaaaagataggtgaaattcccattttacagtacattgcagaaattgcaataatgccaatagctttgttgtttttggattgattctatgtagagcaccatgtacagcacactacttatgaaaggataagtaatgaatatgtgtgaactccaagagtacataggcgcattatcactaatgttgattaggagtgctggtacatggcgctgataaaaagcaaccagacttttaattggttttattactgatttaaaattgcacttgcactttaggtggatcccttccaccaactgcatacttggcagcaattgagaataagttacttacaagggaaaaatacttgactgccatagggctcattttaggactactggaagaaaaaggctgcaacccctgcattcttacaaagctaagatatttacctggtagagcaaatgaagatcttcaaggacatacttagcaatatatcacctatatactccttctgtggaaaataagtgaggatatactcaaccaaatcaaaaatatgggaggaaaaaaaagaaaaacagttcttaacagtgaaccttggaatctctgaacacacacacagacacatacagtccataattctgggttttataatataacagctgatgaaggactctagaaatagaagaaaattcttctagattctaaattatctcaacaaaacctagaggtttgtgggtgtatgtggcaaaatggttcaaagatcaagaaggcagtattttgacagttgtattttgaggttcttatttgcagaaagggcataaatggagtattaaagttgggagatagtgtgtcagaatgcaagaaatatttgggacatacgcatctgacaacaggggcaggaaaaagacagtaaacattaatgcagtggataagtatagtaaaacttccacattaacaagggaaaaacatggaatgaagagcagtttgctcagaccagcaaaataaggggaaaaaagaagaaacctcaatttaaaataaatagtctagataaagtaagatgaaaaaaataaagtcaagaatatggctattaggctaactatgaaaaggttaattttcccgtcacatatagacattactaggtaaaggttaaaaaaacctaatttaaaaaccatcatattaatgatgtgcacaagaatcatcattgggtttaaaaatattgtgtgaaaaatatatacacagtttcatataatgtccttagagattacttattaattataaggggaaaattgtagcttttcagtagataaaatggggggatatcaactacattaatatcaccaataatgggaaaaactgacatcatacacctcctatgtgatggagcaagtaacggaccaagaaggacgcaggctcatgaagatagttttcctgccaaaggttcataaccagaatgtaataggaaagtactgggccatccaatagtttgaaaccatccaaaatgaagggaagtctacaaacaactgtcctggactattcaacatatcaatatcatgaaagacaaaagaggttgagtcgctgttggagataaaagcaaattaaggagatgggacaactacatgcaatatataatcctggattaatataaaaattactacagataagatggtattagaaaattggtgaaaattgaatacggactgtttatgaggtaataattttgtattaatgtaatatttcctgaagtatttagaggtgattggttaaaatatctgcagcttactctcaaatggatctgccaagacacacacacacacacacccacacagccccccatagcccccacacacattgggggatgaaagcaggagacagagagaacaaatatgggacagtgttaacagttggtgaacctagatgaagggtgtaaatgggagttctttgtcctagtcttgcaacttttctattaatttaatttttttcaaaataaaaaatttaaacaacttttctcatctatattctgtttagaaaaaaaaaagatgaaaataaagggatggccaaaaaatagccaggaaaaataaagtattaacactgatcattaaaattgctaaatttgataaagacacgatgtagaaggcaacatttatgacaatacggcacccaaaaaaagaaaaaattgtggccccaccaacataacggctaagtacctaaggagggaattactggaaaagtaaggagaactggaaaaaatacctgctagcagacaagaataagtaaggatgagaggaattaaaaatacatattccataaataatatataataaattgactgggcgcggtggctcacgcctataatcccagcactttgggaggccgagacgggctgatcacaaggtcaggagatcgagaccatcctgggcaacatggtgaaactccatctctacgaaaatacaaaaaaaatattagctgggctgggggtgtgcgcctgtagtcccagctactcgggaggcgaggcaggggaatagcttgaacttgggaggcagaggtagcagtgagccaagattgcaccactgcactccagtctggtgacagagcgagactccatctcaaaaaaacactatatatatatatatagatagatagatagatagatagatagataataaattatctataatatatgaaacataaacatatatacaaccttacacattacaaataattttttcttttacacaaagaatacctcaacaaatttttaatcaaaattttaccacatatatttttctgattataatccaataaaattggaaataaacaataaaaaggtaattggaaatgttcatttgaaaatatgaaatgcacttttagataacccttagttcaaagacaagattaaaaagaaaattaaaaactatctggaaagttctacatagggaaaagaaaaatttttccttaaaaacacaaaattttattttgatctttgtttattctctcataaagtcaaacatagataatatcatgtaagtaatttttgtagtgggctcaataaaaagttgaattaagtatcatattcttggatataatagggagatgcaatttatctttacatgacatttaatttttgttttattaaacttctagtaatttctgaacatatcagatttaatttgttggcatggttataaacctcagtttataataatcttaaattatattttggattttgacagtttacaagaatatctggaaagacaacatttagctcagctctgtgacattgaagaggatgcagctaatgttgctaagttcatggatgctttcttccccgattttaaaaaaatgaaaagcatgaaattagaaaagacattggcattacttcgaccaaatctctttcatgaaaggaaaggtagggaatcaagcataaattgtttaagtattttatatagatgagatttgaataaaccctagtataattgcatttaaagacattgttttaaaatttaacattgaagaaaacgcaccttaagaaattaatgtattaacttactaatatcttaatagtgaataaaacatatttgtagctgaagagtttacaaggtattttctaatctgtgaatttgttagagtagattttaacattgcaggaattattacataataaagatttaaagcttctatgtctgaaatgccccaattcaaagcttggatctaccataactgatagtgtgacttgaacaagatattttaccaagtttatttcttcacgtgtaaaattcagaacattaaaatgagaaaacacaaataaagtacctggcacataaagagttagttctttttaatctcatcccatattcttatagcagagtgaatatggcagaacaagaacacaagtcataaattaacactattcattctttttttatatctaatatatggaaacataattaccattaatatttatatattggccttttattctctgacttgtccaactacctaggagctttctaggagctttgacgtagtttccttggcatttctatgtagaccaggatttctcaacctcagaccggcttacattttgggccagatcattctttgtccagggtggaggattgactgtgttatgtgcattgtaaaatgtgtagcagcatccttggcctctactcactaaaagtcagtatcataccccccttcccctctgccccacctctcaaattgtgacaacgtcaaaaatgtctctggaggttgccaaatgccctttgtagggcaaaatctctccggctgagaatcattgatatacacagtaatagggtttgcaaagtgagatacttgttcctcttcatttccatctgtatgccttttatttctttttctttcctcattgagctagctagcacatcctgtatgacgctgaattggagtgatgagaggagacatctttgccttgtacctgatcttatagcaaaagcatttggtcttttaccactaagtatgttagctgtgtatgtcctttatcagattaagaaaattaccacctcttcctagtttggagagaatttttatcaggaaaggatgttgtgtttttctcaatttttttgtatctattgatgtgattatgttttttccttcattttgataacatggtggattattttgattattgatgttgaaacagccttgcattctccagaaaaatcccacttggctgtcatgtattatcctttttacacactgcaggttttgatttgctaatattttgttgagaatttttgtgtctatattcaggagggatatgtgttgatttcttttcttgtaatgtttttatctggttttggtgtcagagtaatgcaggttcataaagtgagatgagaagcagtcactcctattttatggacgagatagtgtagaatttgagttatatcttaaatgtttactggaatttgtgagtaaaatgatttagacatggggttctcttttttggaagattttgttttatttttgtctttttgccattttcaatgtcttttaatatttaaaaaagacaatattttcaaatacatgttatttttaaataaatagactttacagaacagttttagatttacagaaaaatcaagccaaaatattaaaccattgtagacttcgagaaaaattaagaaaaatactacagagttcccatatacctgctccctcccaccttctcctatcaacatcatgtattactgtgatacacttttacagttaattaaccaatattgttaaaatatcattaactaaagtccatagtttacattaagtttcactctttattttgttcatcctatggattgtgacaaatgcataatgtcaggtattcccattacagtatcatacagaatagaattgccaccctaacaatcccctgtgttttacctactaatctctttctctctcctaacccctggcaaccactgatccttttgttatttgatatgttatgggatgtcttagagttgatatcatacagtatatagccttttcattatatatatatatatttgtttttatttatttttattttttgagatggagtcttgctctgtcacccaggctggagtgcaatggggtgacctcagatccctgcaacctccgcctcccaggttcaagagattctcctgcctcagtctcccaagtagctgtgattacaggtgtgccaccatgcccggctaatttttgtatttttagtagagagggggtttccccatgttggccagggtagtctaaaactcctgacctcaagtgatccacctgcctcgcctcccaaagtgctggatttacaggtgtgagccaccacacccggccagtagatagccttttcagattgacttctttcatttagcaatgtgcattttgtgttcctccatgtcttctggtgacttgattgttcatttctttttatcactgaataatattccattgtatgtatgcaactaagtttatttgtgtagttacctatagaagggcatcttggttgcttccagttttcagccattatgaagaaaattgctgtaggtgttcatatgcaggtttttgtgtggatgtcagttttcattttaattgggtaaatatctaggagcatgagtacaggatcatgctgtaaaagtatgtatagtttgtaagaaagtgccaaaatgtcttccaaagcacctgtaccactttccatttttgttagaaatgaatcagagttcctgttgctctacaaccttgccaggatttggtattgtcagtttttgggagtttagttacattaataggtaaataatattaccttagtgttgtccttgtttacaattccctaatgacatattatgcagagcttcttttcatatgcttactaatcatctctgtatcttctttgatgatgtgttgtctctttatactttttgcccatttcttaattgagttgttcattttcctcattgttgagtagaaaggttttttttgtttgtttattttgaatacaagtcttttatcatgtatgtggtttgcaaatattttctccaagtttttggttcttggtttcttaaaagtggctttcacagaaaagtctttatttttaatttagtccagcttattagttatttctttttggattgcggttttagtgttgtatctaaaaactcattgctaaccacaaggtcacctagattttcttctgtgttattctctagaaagtttatagttttgtgttttacatataggtctatcatccattttgagttatttttatgaatagtataaggtctgtgtctagacttactgttttgagagggtatttctaattatttcagcaccatttgttgacaagactgtccttcctccattgtattgcctttgcaactttatcacaaaccaattgactatgtttgtgtgggtctttttctgggctctctgctctgttccattaatcaatgtggctaggtctggtagtatcacttctctaactttgttcttctccttcaatactgtgttacatctttggccttttcatataaacttgagatcagtttgtcaatttccatatccacaaaataacttgctgggcttttggttgggattgtgtttaatctacagaccaagttgggaaaaactgacatcttcatattaagtcttgttatctatgaatatggaatatctctccatttatttagatctttgattttttttcgccagagttttgtagttttcttcatttagattctttacatattttgatagatttttgcccatgtattttcttttttagtgctagtataaattgttttgctttaaatttcaaattccaattgctcatttctggtatatagaaaaaaattgacttttgtatattaattataacctgaacctttgctataatagtctcttatcagtgcccgaagttttgtgttgttgttattgacaatgatgatgatgattctttgggattttctacatagacagtcatgccctctgtgaagaacaacaatagtttcatttcctcattctgaatcagtataccttttatttccttttcttgtgttatttctttagctaagatttccagtatgaatttgaagaggagtagtgagagggagtagctttgcttttttttccgatcttagaggcaaagcatctagtttctttccattaaggacagtgttaactgtaggatttttgaagatgttctctagtaagttgagaaagtttccctttattcctcctctggtaataatttttatcatgaattggtattaaatttgtcatatgatttttctgcatctactaacataatcatatgacttttcttctttatcctattagtggcgattatgttaattgactttcaaatgttgatccaccctggcatacttggaataaatccagcttggtcatggtttgtaatttttttatacattgttaaatttgaatggttaatattttgttaagaatttctgctcctatgttcatgagagctattggtctttagttttctttccttgtaatatctttttgaatattatggtaagtctggcctcatggaatgagttagaaagtgttccctctgcttctatttgctgaaaaaaataaattgtttccagagaattggtgtcatttattccttaaacgttttgtagaattcactagcaaaataatctagtcctggtgctgtatttttcagaatgttattaagaattaattcaatttatctaatagatatagggctaatcatattacctagctctcattgtgtgagttttggtatttaatattcagtgtatttcaaggaatgggtcaatttatctgaattatcaaatttgtgagcacaaagttgtattgcagagaaaaagtctgctgtcagcttggtttttgttcctttgtagataattcagtttttgttgttggtggttgtggcttgatttatttagatacttgcaaaatattttccctttatttttgctcaattgtttttcaagattgtatagatatctaagaatgaactgatctttacacatttatttaactattaagcaccttacttagaaatttgcctgtgattgatgagaagtaaggtatcaaggtgtgggccaggtgctgtggttcatgcctgtagtaccagcaccttgggaggccaggcagccgcattgcttgagcccaggagatcaagaccagcttgcacaacgtggtgaaacctcatctctactaaaaatagaaaacgtagccgggcgtggtggcccatgcctgtggtcccagctgctggggaggctgaggcaggagaatcacttgaacctggaaggtggaggttgcagtgagctgagatggtgctactgcaccccagcctgggcgacagagtgagaccctgtcaaaaaaaagaaaaaaagaaaagaaataaaggaaggaaggaaggagggagagagggaggaagggaaagaaagaaagaaagaaagaaagaaagaaagaaagaaagaaagaaagaaagagagagagagagagagaaagaaagaaagaaagaaagaaagaaagagaaagaaagaaagagaaagaaagaaagaaaggtcaacaaggtgttcggggctttgaagtatgatttttttatgcatcaggttattccatgaaacttctatgcaattgctagacacctttatctagaaccaggaattctgtgtgtcttcatacctgtcaccaaatatggcatcagatagtgtcactggaatgcttgaaaggatgtttgaaaattctcatggacatagtgcaagcaaaataaaatatttattattatattcatcatggaatttagagtgaagcaaagaaactcaatgccgtcttgcaaataaggcatactcaccaatattttttcaatttatccgttggacggtgaggaccctctctacacctggtttataattcctttgtgatcacctaatgagagagtgcaaattagggaaggcaatctccaggattctcaaggattgacaatcgacctactctcccattaaatctactttctttagctttatgcagatttaccttccctgaatatttttcctgagcttttatcgtgagtcatttcaagaagctgttaacattatatggcaattgcttggggattggttgtcactttttaaactgtggtcatcaggtaccctcatttgagaaatctttttacaaaattagtaatttaaaaaaaacttcagtgtcttctaagaatttatatgattccactttttcaactttcaagagctatatatcctgtgttttcctttcttttctgtgaggtagttctgaagcaaattatttcttaaactgtattaacatgcatgatactttgttttattctttccttacaattgtttgcttagttctactttattcactctatttcctgttttttggcctcgataaggagcttaaggctgttcaagatcttagtcaatatttgtgcttttgacttatccttctttgtcacaagatgacctgcacagctccaaagatcatgtccctcaaacattcaaaagcaggaagcagaagatggtgtaggacagaggttctccccgagtgcctctctcagaagagtccccagtgtatttcctataaatatcattgaccatagctggatcacactgccacactttctgtaaggaaggatggaggtgtgagtattggattttctaggcttctgtagtgggaagtaggcaagagagaagaaggttgagaaataccttcaggtattcaatcaccttgtttatccccaaatgggacaaatcaaatcatggttattgaacataaaaattatttgcaatgacttccataattgtgttggttgattatttaggttactgtctacacacacacacacacacacacacccacacaatcactcacattcacatgcatacacccaagaaaaagatttaatgagatacctgtgtgtgtgtgttgtatatgtgtatgtgtgtgcatgcatgattcctatacgatgaaaaattggaaatagcatcataatgagatgttaagagatactattcaccttaaattaaaacctaagaaggtatttctgcaaactttcaaaatttcgtatgagaataaagtgcattgtatgccctcatgatagtatattatgtattgtgtacataaccagtaatctaccagtttaaaacttattatgtaactgtttttatttagatgatgttttgcgtattattaaagatgaagacttcaaaatactggagcaaagacaagtagtattatcggaaaaagaagcacaagcactgtgcaaggaatatgaaaatgaagactattttaataaacttatagaaaacatgaccaggtagaatccaggttgagaaaattcagtctgatttatttttgaatcatgtaaactttctcttaagtctggtttctatttaagctgccaaactcctcaagtctgtaaacatgttctgagtttacttctctaccagtcctgctcccatcccaatcctctgctcacctgcctgtcttctctagtcttcctggaatgttactggaatagtaggaaggtctcagaggaagttactggagtcccattgagttgaacaccagaagtccagggtgtacaatactatgaagtttaagcagagaactgactgactctcaagagcttttgtaatcttatagttaactagttctaggaaagaatgagttgctagaaatgtgctgggtttctttctagaagaatgactgaaatagcaattgaggctgaaatcctgcaagggcatataaaccagcaggaccatgggaacaatgaaagaaacatctacaagaatcatggcactccccttcccttcctttccctgcttctattcttttatagatatgctcttgaaaacatatcaacggaaaaaaatcacagacctctgttaaaagattattttacatgttacatgtttttgatctatttaacaatatgcatttgtattgcctatacataattagctactgagctacacttcttattacctcttctttgttttcttttctaatagtggtccatctctagcccttgttttattgagagacaatggcttgcaatactggaaacaattactgggaccaagaactgttgaagaagccattgaatattttccagagaggtaggattcataccatgggtcactatctgttttcgtgggctccattttaaacacctttttagatgtagagtattggaaccacagctctagtccaagggagcttctcaggaaagctacctttcctggggacggagtggactgcttatgactggaggtccaacccagtgacagcctgaggatggccaaagattttcaagaaaccactgtgaggtgctaggcttggggctgggagctaagaggtgtatatttcagtcaacaggtcatctcttgggagaaatatccaccctacccgctatttaggagaaattcctttgagaaggttatggtggcagctgtagcttctttaactgatcatgagttttaagacaatgatgactaattgaatatgtactctacaattcagggggaacatttattgacttagcttactgattaatcttagaagtcagctaaactttgtaatcaacttgacccctggcatattacctggcacatagggggaactctttcaatattttctgagcttacctgctaggcttagtatcatctgcaggatagaaatagtatctcacgcatctccatatttggcatgaagctgatggaaacaaattgaatttcaattcccttgaattcttcttgctgattttagggtaggattcaattcaaaggaagaaaggacacccctcatactcccttcaggtgtgcaagaatatagatgctctttaaggtactgcaaacatgacatacatgttgacacaataaataacaatagttatgaagcctcacttacatgaaagctgaagtgctttcttttgggtgggatacacttaaatctgacttgtgttgcattaacatgtattgccccttagttagccctactcaattatgtctttgcttatgtgccaatgactgtgaaggataataagcatagaacctctgcaagtggtgtgagcagagtgccatggaatcatttaataaaatgtggcatagagtgcaatgcatgctaccagagagagggattgctatcaacacaaggcctgtgccagtaggcacactggtctagacactgtggcaccaagtgtggaggctctcagttactgccccatctccaccccactatcatactgaaaattgccccatgttcacaattaatcttaatctttatttctaattgatccccacttttccactttccttggctccacccaccacttacggttgctttaggaataactcttcaaatggaacttcacccctttcctgtgcctgaatatcagattctatgctggcattgttttacccaaaatatgataatttgcatagaagagaagcacagcaacccctcgttgttacctgttactccctctatcccacaattcctccccggacattttccaataatcatgtttaacagcataacaggggttgggagaatgctctgcattgagtagagtaagtgctcaggatgactcaggctgtttcattcaatcattgtccaaatccctaacccctggcaatcacagagtccaagggactagggctgaaggtatctccaaattagaggtgtgggaacagccaagggcagaatggaaaggtcaaggtgataaggcaaaaaaaaaacaaaaacaaacaaacaaaaccctgaatgagtcattgagactagagagaaaagaagaggatctggaagctggggacagaaaaccaagtttccagtgatgtggagaatccacatcagtgttagcaggaaggaacattattcaccacagctggaatttgttgggttgattgccctggactgtttaaagggaaaaaagtgaaatgagcagtgagcattatttgctactgaaatatgcatagatagatagaaaaacagataaaaaggacaactgaaaaaataccaaagagcaacaactgattcaagagatgcatgcttatttataggaaagaaagcataacaataaactgtctaatgtggatggtctggtattatcagcatcactcctgcctcttcccacaaagctgtcctgtctacttctcttttattgctgttgttgctcacctggaggtttcccttcagtatcttctggatttaatgtttataattttatatctttggtctagagtcaaatgccatgtaatgcttgataatgtgaagcattatcacatggtgaaagccacagaagaaaatttatttagagttcaatacacacaccatatatttcaaaggcatcatctgattgcatctgcaaaatcaccttctgaaacaggttttattgttgtatttatatttgagacaactaaagcacaaagaagttaagcagctccctaatatcacacagctagcaagtagtgcaacaaggattctaccctctgagctttttcactgcacagggcatctatatcagtctgttctcatgctgctatgaagaaatatccgagactgggtaatttataaagaaaagaggtttaattggctcacagttccgcatggctggggaagcctcaggaaacttataatcatggcagaaggtacctcttcacagggtggcaggagagagaatgagtgccagcagggcttgtaataccaggtgcttgtaaaaccatcagatcttctgagaactcactcactagcacaagaacagcatgggagaaactgcccccatgattcagttagctcccactaggtcctgcccatgatttgtggggattttggggattacaattcaacatgagaattgggtgggaacaaagccaaaccatatcagcattcattcctctttcatagttatctgttaatattcatcgccttgatgatttaaatgatcacatcctttcttcctaatgaccgttatccttgaaaagaagtagcatgccctaagccgccatgtacttacttccttttgcacagtgtcaagatctggaattatttgctgttatttgataacttttgaacaacttatagaaattgtgttatattattctgttctgttctaatagcttttaaacctgacttctttttcaaagtttatgtgcacagtttgcgatggacagtttgccggtcaaccagttgtatggcagcgattcattagaaaccgctgaaagggaaatacagcatttctttcctcttcaaagcactttaggcttgattaaacctcatgcaacaagtgaacaaagaggtaaatatttaagaataaaagtgaatgtatacattttctccaaattttgtgaacatttaaaaaatttacaatcagaaaagcaaaacaggaaacagaaaattccaaaaaagaaaagttgcgatgagtactcctatccttcatttagattcaacaattaactttgtcatactttgtcttgctatctctctcacctctccctccctcatccttctctgtctttctcttaatcagaaatgatattgaattttgctgaagtctttttcagaatttatgaaaatgatgagttgttttttccatggatatattagtacggaatatcatgttaatgatatttcaaatattgaattatatccttccattcctatttacatgttgcttagttatgatgcatttttagatacgctattggatactatttgcttatattttacttggttttttttttcgtattgagacttaaaagtgagattgatctctgctttccatttttttggtttgatatctatcaggtttagaaatcaatggaatacttcataaggaatgtgaatatatttttcagtgctccaaaagagtgtaagcagcactgagattggtatttggaggtttggtaaaattttcctgtgaaaatatctgggcctgttgtttttttgtgggataattatttgattgctttctctgtttcttttatggaaattgctctattaaagttttctatcaccctttgagtaaatatagttaaattatattttcctaggaagttatctattccagctatgtaatttgtaaagtaatttcttatcattattatatttcctccatttcagtgattatttctactttaccatttcttatttcattctctttcaaacaataaaaatttaatttattcatgagttctatttttttctcttttctaactactatttttggttttatcttcatgattttctttcttctattttctagtagttttttcttatgttcttctagctttttgagttgaatattaagtttatttattttcaacttttaatttttattgataagaatttttaaggttatacattttcctttgattactgctttaattatagcccacaggttctaatgcatcgtgttttcattatcattattgattattgataattaattattgaaattttgtaattttggtttgtattttcccttgggcctttgagttattcaacaaataaattatttttaaagagattttttaaaattctggtagaagaaaaagcttgcatttttttgaaattatcgtggtgttgccgaactaccatatggcaaacttttgtgaagattctacatgtatgaggagaaaaaatattatcactagtgtcatggtgaaaagtttgaatataagataaaaccagccttacagtttgattcatcttgatttatttttccccaacttgatctgtcttgaatttgggggatctgtcagaaactagaggtatgagtcacctgttttcagtatattgttggctatatttcctgtattttctgatttataatgttggtggccatgttatttggtacatagatatttaaaactattcatggtaaatttagtttttagcattacacaaagttcttatttgtctcatttaatgccttggggcctgaattctgtattgtttgctatcaggaccacacaccctgctttcttattatttgcatttgccttgtacatttttgcccatttatttatttttagcctttttgaatcactttttttaggcttgtctcacacataaaatccataaaggcagatttgtattcatggctttctctcaaaatatatgttaaacagccaaattcactgtaataaaacagtacacaactcacgtatttttaattttttaaattgaaacataattgtccatattcatggggtacattatgatgttttgatacatgtacacattatgtaataatcaaatcagggtatatagcatacccattacttcataactttatcatttctttgtggtgagaacattcaaagtctcctcttctacctattttgaaatatacaatgcgatattattaactatagttaccctactatgcattagaacaccagaggttatacccatagacttatctctccctatttctccctgccccatagcctccccacctctagtgagcaccattctgctctctacttctaggagatcaacttctttaggttccacatatgagtgagatcatgcagtattttgtcttttctgtgcctgacttatttcacttaagataatgtcctctaggttcttctatgttgccacaaatgacaggatttcattactttttatagctgaataatattccattatgtatatgcatcacactttcattatccattcatccatcaatttttgttgataataaataggttgattttatttaggttgattccaaatcttggctgttgtggataatgctgcaataaacatgtgagtacagatatttcttcaatgtactgattttatttcctttggatatatacccatagtgggattgctggatcatatatggtagttctatttttaattttttaagagctgttgagccttttttcatgtatctgttggtcattgtatgttcaatagatatcttctgagaaatgtccattcaggtttttacccatttttaaaccagaatccttttttggggtttttgtttgtttgctattgagtttagttccttatatatgctgtatattaaccttttgtcagatgcatagcttgaaaatattttcttgaattctgtaggttgtctcttcactcttgatttttttcttcactatgcagaatttagtttgatataatcccatttgtctggttttgcttttgttgcctgtgcttttgaggtcttaccaaaaaaaatcactgccgagaccaatgctatgaagcatttcacctatattttcttctagtagttttgttgtttcaggtcttacaggaaaaaaatttagtagatgagataaactcacataatatgtttattttatgttaataatatgtttagtttaaaacatcttattattttaagttatatttactttacatgttatttttcatttactgttgttcttctctgtgtggtcttttacattttcttttgtgtttgagaaatttatttgttctgtaagccatttttattgcaatatctatcagagttgtccaagggaaagaatatagtcatgggttcttagtttctgtttctgattgggccagtaaagccccttcctcatccttcttttctgcttatcactagagacagaaactaaaaaccatggttttgggctgctaaaagcctaaaacaaaacacaacaacaaaaaaagttgggatggataggcttgaaagttcactcttcttgactgagtgcctattatttgttttctctgctttaaatgatatcctattacctttgtgacagttaggtacttaatctactttcttatttcttgagctattctcctattttttgaacttgtgttaaatgttaaatgtactttgtcagaaaatatattatttacatatatgctggatagaaataatcctaggctcacattttttttcttggagtttcttgacagagtatctctattcttgtttcctgcatttctttcaagaaacctggtgccatatttacttttgtttcattgtaagtaatatggtgttttgccagaagaaagtgttaatttttgtttgtttctcaagtctagtagttttactaacatatgtctgagatttgaccactcttgatttctttttctagatacatgttattctttttcactgtctagattcttatcttctcttatttcaagatggttttcctgccttatagttttaaatattagttctgttccattgttcttttttttttcttagggatttcaccagctggaactaacaggggattcttttgaagtttctgagtatttagattgacttactcaatttttagttaaaaatattctcttttggtatgatgaagtcaaatttcttaaatacatatagtaatatatattatttaattatatacacagatatgtacacacacacacctacatacacacacgtgtagacatgcttatctttgcctaacttctgtatctatcactttccctattgacttctctttctttattttgctttcctttacttggctatttttacttctgttctctatgtccttctctgtattttaagttacattagacacctagtttatttctgttattttatctttgtctttcgtgagtgcagcttttatttcacatctacttattgcttggccatttctggttttgagtttgaagttctgatttatgatttatgatttttttaatgttcaaactgcttaattcacattagggtgtcgtgttacagtttgggggggtatttgtcatccttctgctggcttgctttcttcctacctcccttcctctttctctttcttttatttatttctttaacaggggaataaattttttaattagcatagtaattttaattttatttttataatggctcagtaaagattaataagggtttgggttagctcatttcatttctcagctcagattttctcttggttttgtattaatataattaggtagtttcttaataggtagggcctttgcagggggtgaatctgtctcactacctacagtactctctgtttgtcttgaacgttaacctgagccacttgctgtctttatctaagaactgtaagagacttttcttttccaaggtggctcgttttaccaggaagtattgattttccaaaaactgcattagtcttcaaataccttgcttgcagtgccacaatcacccactcctaccctaattcattcttcatggtgcaaaggaaattatcgttttagagcacagatctgaatatgttcttgcttagaatgctttaaatgttccttgttgtttttagaggaaagtccagatttcttcacagggcatagctcttgataatccttcttctacttacttggccaacttcatctccagtatattttcacccagtcacttcttcctgccctctgcacttggcatacattactcactctgcctgcaatgtcctttccctacttgtccacttggtgatcacaccttatttttaccatgcttaacacaaaggtcagtgtctctgtgaagtcatccctgacctctccagagaaagttaattgttttctcacctgtggttctggggaccttatatattactctataataatgatcactttctcatgatatctttataggccttgctctctgttgagacagtctctgaggaaaggtttatgttttcttccctttcatttctgcagtgcctgtcttagggcagatcctggccacctcccttccagcaggagaggtccagccttctccaggctgtctgttggttataatcatattgcctttagctcccagaccactctatgtgcttttgatctggagcaaagaagaggccgttttaccagaaagctcccagtttctcagttggttcacctttgtctctagaatgtagccctcaaaacttaggctgttggtgagattttgacaacatttgctttgtttaattccctcgatggtactctgattcttcagggagaagagttcagattggctttatccttcaatccatatctagcaagaaattccttggcatttgtagtatgaaggtgaaaatagatctttattcttagcatgagagcaggtcccttccccttctactcttgtggcctactaggtgtttcaggtggtttctggaaaggtgagcctcagagactgaaaatctacattaacatactgaagttctgaatgtcaatttggtgctttggaattttaatttcgtttggcagagttttgccatgttaaaccacaatatgcaaattaaactatcattttccttagttatttcagtctacttgagtatggaggaaaagtgaagcaatctgcaatattatcaaatatttgtttttcttagagcagatcctgaagatagttaaggaggctggatttgatctgacacaggtgaagaaaatgttcctaactcctgagcaaatagagaaaatttatccaaaagtaacaggaaaagacttttataaagatttattggaaatgttatctgtgtaagtttctgatacataattgtttgcattataaaagtggtaaatgttcattatagaaactttgaaaaatgcaaaaattaattaaaacatttcatctaatctcattcatgaaaagacattctgctaacattcatggttcatcttttttctatttccttacctccctccctatcttcttttctctctctcattctgtctctcctcgctccctttctttcattctttcttccttcctactttcctttctccctttccttcccttcccttccctttcctttcctttcttttcctttcctttccttccttccttcctgtttctctaggtcttcacattagatatagaggctgcctcagttcaaaccgctgcttcgccaacatacttaattgttgcctgagtttccttatctgttgaatgggaataataatagtatctatctaataggcttgttggcagggctacataattgatgtgttgaaagtacctagaacagtgcatgacagatattaaacacttgataaatgttagctatgattattcacatctttttttacatgtgttgataccttgtcaaactatgtatacataataacataaatattacgataagaaatacactcttttaaaacttctttctacatgatgcatctgttcctgacaacacatacttttataaccaccacatagaaattacaggctaacatttattgtttccttaattccaggccttgtgatgagctgtacacactttatttcatttgactcttataataataactctgtgaagtagttttactagaatttccactttgattttgagagaacataggaccagggctagaagttgtccgcagtcacaaaactagtgtttcgctgggtcctgaacccagggagtctctgcttttaactgctgctttccaaaactctcttttacacagagttcataattatgtgaacatcattatcgatttactatgagttacatgtcttttctattttatatatattacacatcaaaaattttctatacagtcatgctttgcagtacaatatttcagtcaataatgaatcacatgtacagcagtagtcccataagattatcatggagctgaaaaattcctattgccttagtgacatcgtgatcattgtaatgcaatgcattaccatttgtgttcatatatgtttagatacacaaataacactgtattacagttgtctacagtattcagtatagtaacatgctatacaggtttatagcccaggagccataggctgaaccagatagcctaggtgtgtaagaggctattctatctaggtttctgtaagtatattctaggatgtttgcactacaatgaaataacctaatgtcacatttctcagaaagtatctgcattattaagaggtacatgactgtacatacacacacacatgcacacacacacacgtgtgtataaaatacgtataagaaacctctttaattgcatgtcttctcttttttcagttcctgacaatttgtcaatgagtttaggaaggcagaatttataaagttaacaaaatttaatggaatatatgtgctattgagatataaataataagcagaagcctaggactgtaccatgacagcttagaaaactaactttcatacttattgcaggttgcattttctgggaagctggaagtttcttgttcaggctattgagtaatgatgccatgaggaagacagggcaaagaagcaggatggggatgacggcaagtcaagatgtagtgcagaccagacaacagcctctgctaaccacagctagattggtctatcagagttgtccagtattggctgagatgaccaggctgttgtatgctcacatcactcagttacttgaagtaggccatcctggcaatgaggatggcctgagcaaggctatcttaacttgaggcaatccctgaagcggttagaggctgctggacaaccataaagcaacaagtcttgaatccatgacaatgtctctatttacagacctcaaagtagcaaaataataagacttcattgacaaatattctctagaattaaattatagcacccacctagcatataaacctattagaagagggagaaatgaaaaaaagaaagtacatgattgcactgataaggacaaagaataaaaaggagctccctggctcaggctgcagtgttctgtctttagccttgtttgcagtgtcaacagttttcagtaggctgggtcttctgaaagcaccgttctttgcaggggtccatctatggtcatgattctgaccaagtggaatgctgttgcagaatggagacgattgatgggcccaacagacccagaagaagcaaaattactttcccctgactccatccgagcccagtttggaataagtaaattgaaaaacattgtccatggagcatctaacgcctatgaagcaaaagaggttgttaatagactctttgaggatcctgaggaaaactaaagtatatactgtgaagtacgtacctgtttaattattattttattttatttgcttgttgcagtgactgaggctaggacaaacctgtcctaaaaagagaagaacttttcctaaattcctgaatcaagctttatttcctgtgagacacactgttctattgcatagtagccacacagcctcaaagctgaaccttgtagatgctgatgaccgtggggattctggttgcttgtaaccaggctggggatgctgcatccaggctggagggatggagacaacagggcaagcaacgcacccattggttcacacagcttggtcttgagctgtggtgtcttctaccatgatataaaaagcctcatgcagtccctctactcagctcctttccacttctctgctttgaatggccaaagtttctttctttttatctttatttgttctaaacaaaaacaaaacaaaacaaaccaaaccaaaacaaaaaataggatgcatgcgcagaacgtgcaggtttgttgcataggtatatgtgtgccatggtggtttactgcacctattgacctgtcctttaggatccttcccctcaccccccaccccccaacaggccctgatgtatgttgttcccttctctgtgtccatgtgttctcaatgttcgactcccacttatgagtgagaacatgtaatgtttggttttctgttctggtgttagtttgctgaagatggtgacttccagtttcatctatgtccctgcaaaggacatgatccttttgatggctgcgtagtattccatgtaccacattttctttatccagtctatcgctgatgggcatttgggttggtgccatgtctttgctattgtaaatattgctgcaataaacatatgtgtgcatgtgtctttatagtagaatgatttatattcctttgggtataaacctagtaatgaaattactggatcaaatggtatctctggttctagatccttgaggaatcaccatactgtcttccacaatgattgaactaatttacattcctaccaacagtgtaaaagtgttactatttctccacagcctcaccagcatctattattcctgacattttagtaattgcctgaatggccaaagtttcagtgtacagtgtacaatgattgtacagtgtacagtgattgaaaaacccacagtcaccttgggctggtgggaatataaaatggtgcatcttctggataatcatttggcagtttcttaaaaggttaaacatagaatcattatttaacccatcagttctattcctaggtgtattcccaaaagaactgaaaacagggactcaaacatatacttgtacagtaatgtttatagaaaaatgattcacaatagccaaaaggaagaaactacccaagtgtccattaacaaaacaatgaataaagtgtggtataaagatacaacggaatattatttagccattcaaaggaataaagtattgatgcatactgcaacatggatgaatctcaaaaaaattttgctaaatgaaatgttagacacagaagaacacatattgtatgttaccacttatatgagttacctagaacaagcaattatagagagaaaaagtaaattatagcttggggctgaaggaagggtgaaattgtaagttattccttaatgggtgcagagttttcctttaagttgacaaaatattttggaaattgtttgtggtgataattgcaaaccatgcaaatgtcattaataacattgatttgtatactcaaatggttgcaatggcaaatttaatacacacaacccctgacatattgccaggataaaaaaaatagtaacaaaaatagtgaaataaggaagaatgatttctcagacaagcacaaaaagctcttgcaagagaactcttcaaaacccattccaaaatgatacaaaattaagttagtgttacatttttaaaagaaaattcatgtaatcctaacacagaaacccttaattaaaagtaagcctttatgttgggagtgtaaattagttcaaccattgtggaggacagtgtgctgattcctcgaagacctggaaccagaaataccatttgacccagaaatcccattactggatatatacccaaaggaatataaatccttctataaagatacatgcacggatatattcatggcagaactatttacaatagcaaagatatggaatcagtctaaatgcccatcaatgatagactggataaagaaaatgtggtacatatatggcatggaatactatgcagccataaaagggaatgagatcgtgtcctttgcagggacatagagttggaagccactatcctcagcaaactaatgaaggaacagaaaaccaaacaccgcatgttctcacttataagtgggagctgaatgatgagaacacatggacacatggggggaacaacacacactagagcctgtcggtgggggctgggggagggagagcatcaggaagaatagctaatggatgctggtcttaatacctaggtgatgggatgatctgtgcagcaaactaccatggcacacatttacctatgaaacaaacctgcacatcctgtacacatactcctgaacttaaaataaagttgaagaaaaaagtaggcctttaataaagttcttaaacagttagtaaataaaggaaattttgtttcaaacaaaatgtaacaataccaacaaactccctaaactctttcttgggcatctctgacctgagagtcctgctgaacccccagctgctcccccaggccaccccacaaccctcgcctttacactccagcctgtccatcgtgttcagaaggagctgcacaatctgtcctggtatttttctcaccctcttcctattgtcttcctaacctttggtttaaccagcaattctgaatccttgaacgggttgggtagaaatcttactcacaagttaatatttttaaccctgtcacaaatgtttgttcattaactcattgctctgtaaatgtttgatgactgcttacttgctcagtcaggctgtctataggtaaaggttaaggcccatctcccagctctgtgatttgtgtgcaaaacttcaatatggaaactgataaatgctgaaagattagtgtatagcactgtcatttattttattaagtgcattctttcttttcctagaactttgagaagataatacatatgttcacgtcaatatacaaccatttggcacagcttcctgggaggaataataagaaaaacatgctttggaggaaaactcaagatacaaaaatgaatggctatgcataataacaataagaatgtattccccaaacaaatcttaatgtttatttttaactgatcttccggaaaagatttaaggtatataaatgcacacaatctacaacaagataattgagggaggaacacggaatgtggggaagaagagagtaggagagatcaaataaagccaggagtggagttaaatacaaatgcatactgcctaatgtatattgaaaattggtcaaagttttgactctaaattttcttgcagaaaatgaggaaaaggatgacatgtagatttatatagtttgcaaactatagtactgtccaacagtccacgcagtgtacctaactccctcatggtaagataatgcaagaaggtaataagccgattttgtttttgtttcttttcctctctcatgatgtaccctgaatgacattttctgcagtggtatgcccttaagcccatagccagagtaatgtgtggttcccagcatgttagccgtgacaccctctttttcactcaggagaaatattagattgcacatgattgagaataaggttgctgaatgattaacttttcaatttaatttcttaactctaatattaataaaagtaagacgctcacaagctttgatccttccacattagtaacagattactcactgcaatactttcatattccaacataatgtttgagaagcatgcctgtgaacagtgttaaattatacaaaatctaattatgtacataggagttatcagtaaggatatttctcaatctttctccagaatgcagtaaaaaataaggtaaatcgattatcggcttcctttagattgtgcagagaaataagtacagtcaataccttcactttcctcgcttctttcaccttccctgctcccgcaggttgaatagtattatctgatgctttccatggcctgatagtatctggatattcataatatgattgtgctgagtggcacactgctattgcctcaagaatgatccagaccttcgaatgcattggggaggggggaacaagaaaaaaaaaaaaaaactctcttaaaagtgatatcgtatttcaccagcagatggcaagctacactcagttgtgtgtatatgtgactaaagttgtgcaaagatttcatacacaagacatagagaaaggccatttctttctaattgaagtagctagaaatctaataatcaatgtctaaagagatctatccaattaagctttaagttgagttcgtcttggtctcgaggggattgtatttagtgggtggaacacagcagcaagaggtaggcatgtaaggactggggttagcagtacttggaaatatcttcttgcctctgggggagaaagattttaaaaggctagaaagtcaccagggcttctgctaaatgggctggtcttgaatttcggctggactttaggtagtaaaagcatggcctggaccactgtggctgagacaagtaaggcctgaaaaatcagcaggaaaagttggagcttgaggctgagaactgtcagctgatgagatacccaggagggtggggatgtgggtctgaattcagggacaggctcagtaagtaggcaatgggacacctgtgcagaaactgcctctatcccatcagccaaatacatgaggatgacttcgctgggatgaggtcagtgtctacatgaattcccccagacagaacagtccccattctctagtactggctcagtcatgcaccttgaccctaaagccagagtctctctgatggctacacccagtccatccagcccagttccatgacaggacacccaaagcattcttgatttgagcctaatgctctccagtaccttctttggatgccctgtggaagatggacagatttcgtaaaatatgctgtcctctatttgtggccctctagctggactgtcttagtgccccttctggacactgaaagggattcctgacactgatgcctatctgaactgtgtctgaacctgctcaaccattggaagctactttggatgacctccaaagccaaacattttatgcattccaaaaagggagaaagttgactcagcaattgtctgcctaattttcagctgctgaactatttcaatgacataatgaatattttaaatgattataattattcttaaaatgttagtgaattttaaaagtccatcagtttgaatcaacaacattattttagatttattttggtaccatggcgaaattttattcataataccattttttttgcttaacttcagttctttgcaccttgttatattattcaagttcttataatgttatgagatttaggaatagtcctctgattatatgccctccctgttagctgaatataattgttaataaacaatttaattgttttcccttttcataatatgtcatttaagtgagccatactggccattagaaagttgttctcattgagatactgcagctgcatgttttagttataaaatttttctcatacaaatatcacaactaaatatattagacttaggctgtaaaggcaaaattacacaccatggctttgttcttgacattaattacctctttacaaatattttcttacattccagtagacagaaatttctctcaggtagcaaagcaaataaatactgtaagttctgtagtggtgatcaacatattctttctttaataaattcgaaaagaaaaagacatgaaaaagcatgaagacaaaagtcgaaggcttagggattaaatagtgtatggctgccagttacagaaattgacagagacattctgttgcttgacactactttatagtttgtgctggaaaagtatggtggtcaaactttaatatttttatgattgtcatagtgtgatgagtatgagaatgtgaatcacaacctccaattgcaggggccatattgacaagggttctagctctgcaccctgaaattcactgtcacctttgcagcaagaccacactacctatgggttgctcccagtcagtgactgagcacaacaggatacttagagctatccctgggagaagagggactcctttgacagatgactggctcaagactcccaagtaaccttgccaaactttccttagactttacagcagtctggaatgcttctacccaacctttcttctctcttccctctctccttcactcagggtggacatccattgtgctctgacagctctcccagccctacccagatccctccccattctctctcacaggcgttttgcacatttaattctgttttggcatttgcttctctgaggacccagatgaaaacacatatgatcaagggaatagttttcaaattagcatgtctaaatgtctttaaatcaaactacattctatatatatacctgtctgataatatttttgtagtatctgatagttataaaagtaacacatgttcattagacaaaatatagaaaacctttatggcttacactcttttttttttttttttgagactgagtctcgctctgtcacctaggctggagtacaatagcgtgatcttggctcactgcaatctccacctccctggctcaagagattctcctgcctcagcctcccaagtaggtgggactacaggcgcccgccaccacgcctaatcttttgtatttttggtagagacggggtttcaccatgttagccaggatggtctcgatctgaccttgtgatccacccgcctcagcctcccaaagtgctgggattacaggtgtgagccactgcgcccagcctatgctttgcactctcttatggcaacattttttatggtctttagtattcaataatgaaggaaagttatttgtgtcacaaacacctatcctacactgacatgacttgggaaccacattcaaaagtccattttcacaaattattggtaaaataaactctgatacatccaagctatgcaactgtccaatataaacctactgttgcattctttagtggagcaattttcatgctgccttattaagttcatacaccaaaacaggaggaaaacccagaaggattcacaccaaaatgctagttttgacattttgagtagctactttgatattttgggtctttttgttttatttcatgtttttgcttatttctgttctttgaataataaggggggatattccattgctatccaagggttcagcgtcttctttggggtactttaaattaaagtagatgctctatcttgggtacttcattcatctggagaacatggcatgcttccttatcagttaaatcacagagttgacaattaattgatattatggctaataatatcagttaattactgatatactgttgggtggtatgcctctcactatgatgtaatacatctttcagtgtaaactgcttttcaaaagtattttccaataggaaatatggtcagcattagcataaatcagactataacaagaagcagaaatttgttatcctgttgctctttctatggtgataaataaatagtccctctagcagcccagatttatgttaccaagaagtcagtggactttggactggtaaatcaaaattcaggaaatttgagggcccagatctgcctctagctatgtgcaagaaatcagacaaacttatacaacctttctccaacaagcgaggttatgacttctgaggtcttattcaaccttttcattccatgattccaaacaatcattcttgctctttgaatggtaataatagcaggtacatccttgcagtaaaaatgtgctcttctttttcactcagggactggttaccccaaccagaaacaccctcaagctagtaaggggttttgctgtaagaatgcgatagaccatcttataggtatccaaggagagaaaccaaaagtgtgatcagactgcattggtttagagctgaaaagtaagaactaaggctatttatgtaagttctcatgtatcttaaaagaagtctagacagagagcatctattggcaactctgctatactctaattcttcagttcctgtagttaaccagttatattattaagtttgatttgttaaaaaaatagagaaggttgcataggcttttccagcagttaagaaatctgtctatctatctatctatctatctatctatctatctatctatctatctatctatcatctatctatctatctgtctgtctgtctgtctatctatccatccatctatctttctatccatctatctatcaatcatctatcaagccatctatttatctctatactttgaggggctcaaatcactatttcccagctgccaggagtgtaggaagtgctgagaatgttgtcagctgatggttcacagacgaagggaggagctttgcccaaggtggccaccagttccaactttacatttttaatcaatatggggaaggagaaataatcttagtgagggtttccatacaccatacacttagtgagcatttccatacatggatggtccaagcattctggggcgtaactgacaagatcaagaactttccttgctgagcatactccttggcccgaaaatgctatttaaacaaatgtatcccaaggtactaatgaaggatgtgcacagatgtttgactattgagatgtttattcagtattgtcagtgaagaaaccacctaagtatccaatagcacaacagtttgttgagtaatgcatactatggaatataacacagctgttagaaatgagatggtttctgctttcttgacaggaaaacttatctcaataaagggccaagcaaaggaggcaggttatgaaacacatgtatagcaggttcctagttttatttgttcaaatcattttataagtgcataagaaacacctggagaataatatgccaaaatactaatagtgattacctctgtgtagtggagagtaggattagataggattttatttcctttgggcgttgtgcatttattgaatgccttatagagaatacatgcttactgtgttagcaaaaggccaataaaattgttttttaaaataaatgcctccaattgtccacaattatgaaatttgttgataaaatgctgcaagataagttctttttttctgattaaagtatcccaactgtcaagtaattctcatttcagaggtggaacctcaactttcctctctgtacatttatatttaactcctctcacatgtatttaggcaaagaaaatatttaaatgaagaaaacaaaatttggcactcacatgaaggccatttttaagcttgtcaaattattctcagggtggatgtcctgggaagtaagatgagtgacatacctctcttgtgggtataaaatacttgagcattagccaactaattagtacctaactcctaatggtacagacaaactcactgtttctggtgctgcttaagagggtgttgacaagaagcatcatgatcatgaaatcaggtaaccaaaaaacaggaatccagacattgtctgcctctcctttttatttatttttctttattattatttttgtttttagagtttctagctaaaaacagagctgaagtcattgtaaaaaagacacattatagttttccatatgctacttctctagatttttcaaaaaatcccctttcatcacaaaaatccttctgcagaccataaacacataaagatcttttagacattcattccactactgttccttcttagaagcattatattttcgatcacattttaaaacatcactaacattgcaacaacagatatcaaaaggtaataaaacatactgtaaaaaaattacgtgttttgtttgaaatatggcatttattttacaatgcacatattaggtcgaattgtaacaagcattattttccctactcttctagagtatgcacacaggttactctgaatgcaatgcaataagccttttccaccagctttaactcaccttctgtaccaaagggcaaacctaccactatggcttgtgatggcttacaaagaaaaactgaagcatagccttaagaaaaatgctgcaagatgtgtctatgaagagcactgcagtgagttgttagggcaaggggcacatggccttacataggctgtcccaggcaatgcccagcctcatcctgtaaggaagtcggaagtctccgctttggaaactagttagctcacactcttttcgggtttgttctcttctgggcactcctagttttaatgttcttcttgggactggctggtttgggagcaggaggctttccctttggtttggggggattactacgactggtgcgcccggctgttttcttcttgtcctgaactgttctccgctgttcctgcagcctctcttcccactgctgaaaagcaatttgtaaacatgactgtcaaattatctcacccctttatggtgctcagctaatgtgaaaattaaggcaagtttttcactgtaatatattaatgacggtaacaattgtaatagctaccctatgtgaagcacttatcatgtaccaggtgacttggaaagtgctcagtgtgtgatgaagtttccacatgcattcatttcattgaaacaacagtccttccaaataggcaccactgacaggggcaggaaacaagcccaaagaggttatttgcagtgcacagagctggtaaatgtcagagtcaggattcaaattcacccactctgactccagagcctgaggccctcacccatgcacttttgaccactagccccataatgcaacattcctacagtgcaaagccttctaaaaaggctcttatttcatggctactagcattagtttaccccatgtcactgggaagtcaggagtttgttcacttcattctcccacatccaaaggaagacagaggccccttctacacctagtcatccgctaacgtgctagctatccagaaccattgggaattgagtcattctgaaaaatcaagtttctctgatagaaaaaaatttattctttaaatagctcaagtaaggaacaataaaaaagtgagtccacttgaattgacattgctttatattaacgcagatgtgcctgcttggctagagtctatttcattcagccaaaagtttgaccacagtcatcagctgggtattattctaggcactaggaatgcaaagaaaagaaaaacattgtccccactgtgctatgacacacttctagtctattctaaaataataaactcactatggtatgttgctatcatgtggtgatatttgcaaatttctactgaagtatattggaaaatatgctgccaaactgaatggtccccagagctatgattattgaatgctttcctcttggcaagctcaggttctcatggtctgcttgccttcatgtattgatgcttctaatctactgtagtcctggaaaccagataaccaatcttgctagaatttcctgtctaatagaactaagcatgctcctgagcagctcatgagtttttagctctgatttaacacaatagtgtttggttctcttattcagaaacgcactgactagcggaggctgtgttctaactacattctccataactcaattgttaatatgtacttttctcttgcttggatctctttattggtgcaaactaagagagcataggcaatagcaatatgttttgtgaacctataaacacaaattcttctgaatatatatgacatattttgcaaagaaggatgctttaaaaatttaaaaccaattacctggtgtctttagattggtataatttcacatctctgggaaaaaattattctaactcctctaattgaattaccaatatttctacgatgttaccacaaaaatcatagatttgactgcaaaacgattactttttgcatataatttttgacaaaagtcttaaattattataaatacaggaaaagattctgctgtgtatagtgatagggtaagttttagtactagatatttcacccctccaaatatatgtcagttttaatctcaatagatattaagtctgctcaagtatctcatggttcactaaaacaactacatgtaataaagaaacaaaaggctcatttaacttggaaataaccagtaccttagtattgaacacaactaaatcacctttgaagtcgaatgatagattcctggtaaaaattctgagtgagaatagctacactcttaacggcctattcaaaagacaaatactgttgctattgctggctcttatgagagcttggagattagagaatgggaagaattccccaactctaaagaaatctgttatgtgcacttacatccatcttcacagcattgttcatgatacttactatggatcttttactaagctgatctctccatttttcaactaagcaattttcaagaagcatcatcctgaaaaaaaattatcttagtaaacagatttttattacaaaagtaaacagctaaaaatacagaaattgtaaaaaaattattcaataatcctttaccccataatccacacatccaccatttatattttattggtgtttcctttcattcctccttgtaacaatattaattatatttattagatcacattgtgtattgagatgatctgctgatctgcaaatttccttttgtcattatatgatctaaattttctgatgtaattagagtaatttaaaaatataatgttaataatataatactatgaatatggatatccataatatatctatccatttctttattgctgaattccccttttgcttagctatgattaccagtattgcattgaataaccctgtatacagtagtgtgcactggcttattattttcttaggacagatttttaaaatagaataactgagttaaagggtatgtattttttaaaaagattttcaatgcatagtgccaagttgttttcaaaatggttgcactttcatccaattcactaacattaagaattaggtgaaaatggaatcttatttttatttggatttagaattaaggagataattttttaaatgtttacttactatctgtattctatttgtattactatttgaacttctctatataaatttctgtatatatatttctatatcatgatctcaatgtttaaatattaattttatgaactctttagtaagattactattttttcatatcttttcaagtatgtttctcaatttttatttgcctttctatcattatttgtgatttttatatgtataatattatgcagtcagatatgtgtattgatatttttccttgtaatttcttacattacttttatgtttacaaattacttttcttttcagatataacatatttagtcactaattttgtcctttttttaaagttcttagaatatttatctatttaatccatttgaaagttattgtaaagcacagtataaagtgaaaagaatgtatttttttacaaataggaatattttcaacatttaccaaataatacattcattttctattgatgtgccatatttccttcataatgaaaagctgtattttatgcattaaaacctgtttcaagagtttttcctctgtttcatttatctttacgtctactattgcatcacatggttttaacaagtgtaactttacaccaggtttgcgggtctcataaggcagatttcctctcttattttcagaattgtctttacatacccttaccaatttattagaatcatttgtgaggacataaatcccaattatccaaaactatttttactgggatggattataatccattcatctctccagatagaatgtaatgaccaacaacctggtatccccaactggatctctagcactgcagcagatgcaaacaccttggtagagatgagtccagaatcactgattgcttctttagggagacaagatatacgcagaatctggctttaaaaccaagaactcaaggtgatatccatgttgtaaggagggcacccaagtactgatagaatacagaaaagtggagttagttcccaaagatgtttttggtttcttttcagaggaatagtcttaggttatatctagaagaaacagatgagcattaacagcagagaatgggagggatgccttgttatgtaaaactgagtgattttgctggagaagtatactgcatcaacttatggggcccaacatggaggctgggctcaagagtttgactttatattacaagtaatgtaccaatatccaaaaaaaataagaaagaaagagaggccagggagacaaatacacacagctagaatttgtgtgtatgtgtatgagtgtgtgtgaagcatatatttatttgtttatacattgccttgtgatgatttgaattgagaatcacatatccgattcagaaatcaccttaaagtgtgtgtgtgtgcatgcgtgtttgtttgcaatactctatcaaatattatgaagtgtttatatggaaaatatgtggaactatagtctcaactccctacttacttgatctgtaagctattaaagtggccttaaaagttcagtatgtgccactctaaaattgtttgaatgatttgaaaagaattgttcttccttaaaataattgacttgctgtaaattttgaagtcacttaatgaattttgaaactgatttttaaagactctattcaaatactcatattttgatttttccttcattctatgaagaattaattgatagaatatatgctattcaaacagaggcatctgttaaactaatttttttaaaaagactttggcatatttttgttatatttttaaaccatgactgctaactgagattgaggtcttcctaacagtgtgcatacagttccttctgcctctttgtgcctaccttgagcgccactcgtaacacatgatgagaacatcttgatggggcaggatgtgtggacactggcaagaagaatttgtaatgagcgggacttgagttcgagggatgggtgatgaggacttgaagatctcttttacatccaccaccgttgtgacctcattgcagccactcctctgcacagcttttattttggcatgaataactgcaatttaaaaatagataaaagtgttgttgaaggttttggggaaaaactagggatggtgtattcatgccaacttctgagcctctcttaaagaatcactcctgtaattatggttatgtccaagtggcctgagtgcaggcaaacagcccacacagtcatatgctaaatggatggtgtcctatattgtcaacattgtcttaaatgttccggggcatactgcaagataggaaagcaagctgaaaagcaggttttagtctttctctgcctttaggtcagtaaaaaattcacagaaacatatatttgtattcttccttgtggtgatttgaagtggggatcatatatattcagatcagaagtcatcttaaggtttgcatttcttcaatcactcatctgatgcttgagcttcttctgttttacagagatagtcattagtcataacatttttgaactggagggagtctctgaggactactgttctcaatcttttaacttcacagactgacaaagtagacccatggtgagcagagatagaactgttattacagatggctgttaatgtcactgtctctgaccaagttttaaatgctggtttctgtggtctcttgctattactgcctcccgtagagttgtaatcagcctaatatggctctgtcttggattccatttcaggaagccagtttatgaagacaccaaaggacttgaatacaaaatggtttcttcatcaaggtcgttcaaaggccataacaccccagagaatgacatgacagtgaaactcagattaatatctcaggctggatcttggcagaggagggactaagtaaatcagatgaggatggtagctacatagagcaggctttaagaaaaaaagctacaggaaaagataaactactttttgttgttgctgaattacccccattggctaaatatgattcttaaatctgatagttttgtaacagcttattttttttcagatttctacatttctgtgatcctcctactttcatgtctgatatgtatcctaaagtttcttactgatataaaatttcaatctgcaagatgaaaactaagtcagcaaacaaaataagcattttccctaaaaccactttatgttatttcagcagaaatgatttaagacatgcaatgaaatataaagtaggcagcccaaacagacatttttaaaatgtctgccttttacatttctttttgaattgaaaaagaacatatgttaattaaatttactttcagatgacaattgtgaaattaaaattacttaaaacatttcaaatttcatgactgacttattcatggaagaaaatgctgaatggttctttcaagtaagagagaggagggcatttaaactagttcgatagtgtaaccataggattttgtgattaacatttttttcacaatttatttaagatgttaaatatttgtagctagtcacaagtaaaaggatatgcaggcagatcttaattgtctgggcctatgggccttaattctctgactctcagataatcagatccatggatcattctctcattcttcctgcagcagtaaaacctcaggaagagaacaggtggggtgtgccatcagggctgataagcacttctcaccaagacaaggaggatcaagatgtcaaattttcaatctgatgcatgtaatttttatcacctgggtcatttcctttgtttgcacttgattcatccagaaaagcaagatattttgcagttgttattgtgccatatattaatagaattcacatgatcaactggaaaaatagtcaaccttttgttttctttactttgtgactagctttagtgagagcgaccttattgagattccagctttgtaatgaaccaagtctcaaaagtaaatggctttaacagacgacttaccatagctgtagtttttgctgagatacgttgccaaagttggcttcacctttttacacttgcaccgatctaaaaaaggcagaagaggcagaaagttggaaaaagaacagaaatcactctggagaggagaagtagagggaacgtccatgaagaaagaactcaccggggcttaggcgtttacagtcaacatcaagaggcctttcctgtaccatcatgtctggtgtgatgtctatccacttaacatctgaaacacaaacagggccacatgggcgtggttggtgatttggtctgttcacccagctggtataaagagccctctgaagatataaactaaaacagtatctcaaaataatagtatttaatggtaaaaatgggccaggcgaagtggctcacacctgtaatcccagcagtttgggaagccaaggagggcagatcacctgaggtcaggagtttgagaccagtctggccaatatggtgaaaccccatctctactaaaaatacaaaaattagccaggcatggtggtggatgcctgtaatcccagctactctagaggctgaggcaggagaatcgcttgaacccgggaggcgaaggttgccgtgagctgagattgtgccattgcactccagcctgggcaacagagtgaggctccatctcaaaaaaagaaaacaagacaaaaaatatttatataagtaaaaacggcatgtgattgttgacttctcctttcataatgatatccagggcttaggaaagaaatcctctgggggaatatttgcctatccaagcacaaatcgatgtgaatgtatatccatttaacctcactggtatatacaaccaaactggataaatcacatcactctctcccaaagtcatatttaaatgttgattttccaagttaacagtttatgttaatcaaaataaccaaaatatttccaaatccctacctcatatcttgcagtgcagaaacagttcacaggtatataaccaaaaccaagcataaccctctattatttatataatttaaacaataaatatgttttctttcctaaaactctaaattagagaggagtttccatttaccctgttcacttaaccactcctccttcatgtttagagcaatgctctggggtataacttcagagattccagcacagcaatatcatagtctgtttaaatgtggggtaacctgggccagataaagcctggataaaagaatgcaaaaatattcctaggtttcatttcaagaagtgaatttaaacctctccttctttttagaaaagcagtcaaatgaccaaagaaaaaagaaggaagtggaagcagagatggggttaactaaaatgccactgtagttggctccgggccaatgactatgaaacagacctcacaattttccagggaaactgcaattacaaatctcactcctggtgggaagcaatgaccgttactgctttttcagaaaaaaaaaaactttttaagaagtagcgctaaatggaacgagtattggcacctgcttggtgagattattttgggcattaaatgagtcaataacgtgtaatgtgtttaacacttgctcagacacctagcaacacctgtttactgctattatcatttctgttattactataaatgcaaacatcatcgaaggctccctttgtaagcaaaatctttttttttttctttatggggtgcagtgctctccgctagctcctaaaattcctatgggagaaaccagactttttctgaagaaaatgtttcccccattctttcccacctcctacaagcctcagacgcccctggcagccttaggtgtggccgcccagttctcgattggcagccacagccccgggcgcctcctcgcctccctccatccttcctacggcctcaccctccgggaggtccgtgacgatggcttcaggcgagatgcacacgccacggtcatagacaggcagctcgtcgcaggccaggctttcgggccagctgtggttgtacatcttcatgaggggctcgcagtcgtcgcgcgcgcgttggcacaccgacttgcacggcttgatagggtcgtgcaggaactccagggtgcaaatgggcgcgtacatggcacagaggaagaagcgcagcacggcgctgcagttcacgtccaccagctcctcgtactgctcgatggccaggatggcgttctcctgcgtgctgtggtgcaggtggttgggcatccgcgtgatgttccagggcatgtgccggcacatagggatgcgcaccgcctcgcagggcgcgccgcgcacgcccagcgccaggtgcagccacaggcacagcgccactaggatggagaggaacatggcactgccctctcgcgctgcgaccccggcagacagaaagcgcccttctcttcctgccaccctcatctttcgctgtcccttcgccgaggaagaaatcctctggggcgcaggagagtttcttcccccaaactccagtcggcagcaaagcggggccgcggggtccggccgcggagctccgccgtctggcacacagggcacgagcagcgccagctctcagccttcggggcgcgaacccgcccgggcagctccagtcccggactccgcagctcggagcgcagccagccacggccattgcgggaccctatttatcccgacacctcccctgacgtgggctcggaacgctcccttggcagctgcagccgcggcgcgggctccccctcggccgccccacccccaggcccgtcggtgcagaagcggtgacatcaccccctctgggccgcagcccagggctggaagcctgctttccccctaaagtccctcctttttagtctggccagtcttttttcttcggaccaagaaaaagaacctctggcagttgttttcgacaccggatacaagagggtgcgggagagaatttcaagagagagaaagacactctttggctgaaaactgaactttgctccctctgccttagagtttttccaagtatagagttgggggaaaataggagcttctgctgccctctaattctgaaatatatttgctttctccggtagggggcatgaggagcgctgaggacagttgggacaatgtcctgcaaggcaggcgagagtgcagtgaatgtcagaacaggagggtcacgttgtataaatcactcccactccgcccttagttgtgtggagtgtggtttgttgttgttgttgctagtagacagtttgggccgaaatttttccagtataacacttggtttgtttctgctccaggaagttaacagaactgggggaaggtgtgctagcatcttccagcttcagaaatgtcttctaacatttcctcttccttctaactccctgttcccctctgcagcattagtggaacccaggagaaaacattgggcaccacaatctgaaaggtctcccctgctctgatccttcatgccaaaggatttccacctcagcagcctaaaatcttgatttttgatgtgctcagagactgttgcttgagttgagtaagaagctgtgtactatgggatgcaagtatgtatgttttgctttctcttttatcttacttgcattaggaaaaggtagtccaattgctggctcagctatctacagaaaagggaggatttatttatatgagattgatgtatatcaatcttcaggtggtaagacttctggtatatgctatttattagggcatcagcaatatggaaacatgttctctgaatgttaatctttaaaaacatagtttaacttgaatttaaggcacatggtttttctctccaaagcttaaacctacacaattagtttagttttgactgaggattaaaactaaagactaaggattaaaacagctgaggaaacaacaagcacaagtgacatctattgggaatttacaatggtcaaggtatgaagctaagaactttaaatgcattatcttattttttagggaacatgaattaaacatagtaagtgaaaaggataaatgagacaaatacatttcaggattcatccaaagagtctggttcttatttaggggaagcccagggtgttcttacactgccaagccactctagaaaggtaatctagttcctatagaaccagtctccacctccaaagatgccaagccaggctagtaaaatatcacatgaggaggaaagcccagatgacatctcaagccatttctagcagtaaactccaatgagtctaaacccttcactgggtgaaaaagattttcagctggagttcctacctggggagcaagagaaagagctgaactaccctacacttttcctatgaatctgagcagggcaaactcggagagggctcaaatttctgcagccagtttgaacctgctgcatctgtttaactatgtaagtaccaagtcacaaagtcttatgggcttccctgatgttctctgaggcatgccctttaagaaaaggtaagaggaaatgaagagcccttcttcctaaagctttgtgcctgccccattcggcccattggtagtgtctctggtggttcgacagacagggggcagcagagaaggatgcatcaggaaaacctgtcaactgtccctcctcttcgggacttccagggaggctgtgattctagaacaccctacttcagcattcagtccattctttccatgccttacatttatttaacaaggctcgggaagttgcctcattcagtggcttctctctggtgactccttttggtctcctcaagtgcctgttctttgcccatcctttaaatgtctggagctctctggggctccatcctaatccttcttctcacactcaacactcccctgaactccaggttttctcacccccaacacttaggacatttggggccagataattttctcttcatttgggagaggggaggtggctgtactgcacattgtaggaagtttagtagcatccttggcctctacccacaaaatgtcagcggtagcctcctccccatctacattgtgatcatcaaaaatgtctccagatattgccaaatgtttctttgctggggagggggatgtgaaatttccccaggaaccactgttctactcttcggcttcatttaccacctatgtacctatggcttcctaatccaaaagctctgctggtttccagaagtatttatccagctgtcccttggatatttccaccttaatactccacagtcagctcaagatcaaccaatcctaaaatgaattgatcatctctcctcactcaggactggattcccagtggcccaaaccagaaacctctctctctgagttgaaatgcttctctacagctcccacctgtcttccaccctttccatgaccactcccgctgccttagctgagtcaggatcatctctttccaggatgataacagtagcttcctcctctccctgccttccctctggccctaccctttctgttgtctaagtgggctttctaaagcatatgcctgatgatgctcctccctagctttacattgattgatagttcccacagtcctcaatatcaatgacaaattccttaaaatgagtgctatggcttcagagtactcctctaccttgtccttgaaccccagcattattcttttcttgtccttatgcccttcattcaggaatgttatctcccactttcacctggctcaatcttaatcatccttgaaatgcagttcaaatggaaagacgctatacatttttttagttcctttcttttttcttgatttcatactttatcactatatttttagagacagggtctcgccatgtcacccaggctggatggagtgcagtggcatgatcatagctcactgcaacctctaactcctgggctcaagcgatcctcccacttcagcctcaggagtagctgggactacaggtgtgtgagcctcgctcattccatattatagatcctaacattacataactataaacccaattaaccttattcttgaagaagcgaaaccccccagacacccaaaccactcggctggtggtattgccaggcgatgggaggagcagtctcactgcaatgtgaccttgaggctatgtccatgagtcctaggcccaatgcaaggggctgtctactagtctcctagactcttcactgggaatgggagctgaggagcggccatgatgaatagctagtatcatttcttcaggaaaagactcgtctttccacttttaatttggaggaagaagtttgcaattttgtcgaggggcaatgtaggcggggcaaacgtttgcacagcaaacgcagcagctctgcttttcctatcttgaccttgaacttgcccctccctgtgtgattacctgttgaacactgaagttagtggagaaacacacttctcagcacagtctccccccatcccccctcttaaaacacgatgcctcccaggatgctagtggcaccactgccactgcatttcctgttggcagcagtgagcagtgaaaaccgaagcggcagaaggcagtggcagcaggcagtggcagcaggcagtggcccaggcagaaatagctcccgcgcgattcactggagccttccccgggccctggtcccggctaccgggactcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgaccgcgatgccaggacgcgctcccctccgcaccgtcccgggcgccctgggtgcctggctgctgggcggcctctgggcctggaccctgtgcggcctgtgcagcctgggggcggtgggagccccgcgcccgtgccaggcgccgcagcagtgggaggggcgccaggttatgtaccagcaaagtagcgggcgcaacagccgcgccctgctctcctacgacgggctcaaccagcgcgtgcgggtgctggacgagaggaaggcgctgatcccctgcaagaggtacaggtcatcggcccgcggggcgggagtagggagccgcgcgggcatggggagggcgaggtcgcagaggcctgcgccctgtaactctttccggccccttgcagctcctcccttctcccagagagatctttcgcgaggagggtctcttggggatagcatggtccgggactgggaggggcgctgcgcccaccgagggcggcctgctggcgggggactcagtaacacccagcgaggcggtggcaggtaaagaagggacccatccagggcgggatcaagctgcagagtgccccatgcccaggttcgcccctgttctcacgctgctgagtcaggctctgggctcatggagccccctgcagtctagggcgtgtcttctgcgctatctcatttctttctagagacatctgctagagaggcacgcagaatatgtattttctaagaaatactttttgtattttaaaagaatatggcaagattacaaacggtatgggaaagtgataaaaagaaaatttcacccacaaacttagcaaattgttacagcattaaaattttggtctactccttttaagttttttgtttattttaaagcaaattttacatactatgatcaaaagccatacgttatctgaatctttttttaacttaacattgtcccttatatgttcttatttgccattttattagcttgcctcctatttttaatggctgcacagtatcgcttacaggggcaaagctgtaagtttcttttaagtattggtctgaccattcaccttttcacatctgttgtgacaaaggaaaccctctttttgagatgtcatctcgcttgtggcccctttaagacctgatttctaatttgggatcaccacctgtctcccttccagagccctgccgttccccctaagtgtgttcctctcactggcctctctttatggcatttgcatcattaggagttgcaaagtgaatttccatggtttgaaacgccaatggactgtaagatctatagcaaaagggcaccattagtttatagaacaaaaccaaacttgataatatcatttattctaaaagcatttgttcaagtattaggcgacttgaagaaagtacggaaagggcagaccctttcaaacaatatcaagggtgcaaaataatgcattatgaaatgcagcacagagcagcacagtcatcatggtggactgggaattgattcgaagtctttcaagaacatgaatgttttcagtagggtcttgaagggcacagtaataataataacaactaacagttgcatacttattatatatgaggcatgacactgaggactttacatctattatataatttagtttaaatctcacaataacttgacagtataggttttatgatctccattttacagacaataactctgaggtctagggagattaagcaactttcttaagatcacacagctaatgcttgaggaagctaggggggggttctgacgcctatggtataccaggttcacattcattcatttatttaacaagcatttgttcatgttaggcactgtgtataaacagaatggctcctggctttcagggaggtcagagtctggaggtgaagtcacataaataaaaaaaatttccatacagtgggatgaggggtgagagctggggttgtgatgagaagaactcagttgggcacctaacccaggcttcctggaggagctgaaatgagagtgagttccaaaacacctgtacaggttttccagggagatgtggagagactgctggtccagggggatgcaggtgtatccatgcctggtatgtgtgtgccatcccggagtttttagagctgagtaaattccaaaaaccacagaccactcactattagggctgaagcccaggacatggcgaagggtcatactgaggagttttaaacagtggaatttgtgattagattatataaagatccctggatgtgtccttaagaatgcattcccaagatgtggacacaaaatggagccatgtggagcaaaagtggaagtgagaacacaatcttggagattgtcgtagtggtccaggtgagagatgggtagtagcgatggaaatggtgaacagggggcaagtgaatgcattagggaagtattgaagaggttcaactgaggaaaatgtacatgattggacgggttgtggcaggcgtggtgagggagaggaaaacgttaaagaggcccccatttttggcttgtgaagctaatggtactgatggcatagggtagatggtgatgctgttccttgcaacagggcttgactttgtgcacttctaattaagggtgcattggtatcctatgtaattttatgtgaagacttgtacagtagtggcgcattgatgaatagtcatattgaagatggactgggatggccgagagcacactgctgaagcagaggagtgtgtcaaagagaaggataagggttcatctctccaaaggtagtatttttttttttacaattaaaaaaattagactttagagtcagacaaatctggatctgaatccagactctgaatatgggtctttgggtaagttaataaagctttctgagtctcagtatcctcatttacaaaatgtgaatacttataatgcctaatttattggattattatgggaattaaatgagctcaagtgtataaaacatacagtacaatgtctgatagtacgcacaagatgctctgttcatggccaaggttggtcccatcgctaccactatcatcattatcctggtaaagttaccatagcccagagacttgctgccagccctttgggctcagaaacttgatacagcagcacacacagacccttcctttgggaacaaccttcgagtaaggaaactcaaatgctaaacctgtctacttcaatgagtcttattgctggcatgaggaccagcattctcaaatccaccagactaggtcattctctccctgtagtcagaactatgtggggagccaaattatcatcaggcagttgtgagcaaagagttggagcaaattcattgagcaaacatctaatgattgcctgccctaggttaggctgtatgctcaatgtggagttttccatcatgaataagacaggccagcctggggtaaggtttaatggtaatcaggcaaaggcaaagtgatgcattgattttcacaatagagatgacttggtggtggttctgtgctaccccaactgtgctgttcctgaccccttccactcagaatggacccttggtgagtactgctcaagtctgtctgagcaacccttcttccatgactccatgactgactaatatagcctttagatgtgtgttttatacctttagtggagtcacagccaactcttgctggcttagaagcatttttgtccctttgcggtgatttctcattcctctgccctaatccaataggtgctggtttcacagttaaacttctaaaagacattgttttccctttctttccgagttcttggcaaggttctttctgacagtcacatcgctggccctaagtcagatgtggaaaagaatgtttaatgcataaacacatttttaagctctttaagtgtagatttgttggaacaaactcagaaactttttcaggtattaacagtctggccaagcaaccagatgttatttgaagaaaatatggatgagttgtctcttcatatttatgagtaagttgagaagtaagttttagaattggatcaacttcttaagattttcattttgcatccagatagttatggaaaatcccattgatagttactgtggaatgactaggattttccaggctctgttttccctgagatgatggaaaagattaaacaactttacaagcttcagataagacaagcctgagcagcaaatgggaaatattagtaattgataccattttattttctaattccaactgtcttttctgactccttgattaaattcacaagtatttatttgaaagactgaaggaaatcaagaagatgattttcatatttcaggcagcatgttgaactttataggggaagcagcgttgatacacaatgaaccctctcaggccaccagtaactataggctcccccttacaaaatggtggcttgggtgttggaatcaatgaagctcttaatgcagagtgagcagagaggcagtaaaacaatatgcacagtctggtatcttggaatattatttcatcaccagtcgtacatgttctattaaggatttgtatttgtaaaacatgaaaaatatgtcacaaatggggcagcaggtggattcttattcaaattctgattaattcatgtctgcttctcttgattctcccagagcatattatttcttggagaagagaatagcattaacctcttttttaaacagagaatcagcctcctgtagtggagagagcaggggcattcatgttagaccatgatggagtgacaaccatggcttctaatcctgccttcaccccaataaggtcctcaacattgcagaacctctgtgtttttcatcttttaatttaatttgaatgatgcctacaatgttgatactaaatcacttttaggctttcatttgttaaatgctaggtacagatagtattaaatgatatcctgaaggcaccaattgtacttttattatatcaggctgattcactgtttctaatgcaatgaacttgacacagattttaaattttttctcaatctgtcccattgtgtagacaaattaattcaaagttctttttcttccttctctttttcatctaagcctgtgcttatgagtagaaaaagagaagaggctaccttgaaatgcctcgggcccaaactcagaaggctctgcactcaactgagcctcccttcctactaagaatggaatagtgttgcttataggggtgttggtccaagtatcagctgtggatgattaattcccagggctgctatcacctaaggtaacttcagtaatcttatgtgtttggaaaggaggatgaggattatttttcaaatacataattttgttttattttgaaacaatctcacacctacagaaaagttgcaattataatacaaagagcttccccctcgcctgaactgtttgatagtaagttgccaaactgatatacccacgatccccaaatgcttcagtgtatttcctcccagcaaggacattctcctgcataaccacaatacaaccataaaagtcaggagattaacaccagttcattttgaccatctgaaattcaggtgtcattcatgttttgccagttgttctttgtatgttcttcatagcaaaaaaaaaaaaaaaaaaaagatttaaatgcaagcattacacttaagtgtggtgtctctgtggtctctttctgtctggaatagttcctaagtcttccttgcactttagtgcttttaaagattgcaggccagttattttgtagaatgttccttgatttgggtttgtctgatgtttcctcataattagattcaagttacttacctttggcaggaatatcagggataatactctgttccaattgcatcctgatgttcactttgatcacctgattgactgttgtctgccagccttcttcactgtgaaatgatacattttttctttttaattagtaagatttggtagggaaatattttaaaaccatgtacatatcccattcttcattaatcttctgaattatactttatttgtatcagtgtggactcaagccttctaattttgttctatttgctctcgttgtttactttgctgttcataatgtcctagatttggccagtggaagcctcttcaaattggtttctatgttcttttgatgtgtttgggcacttccttgctttccggcacagcaagatatttcaagatcatctatacttttcctgccccagtcctaggataaaccatttttcaagaagccctggttacttttcctggagaataatatgtggaagttagaacctgtgctctggtcatgctcagtgctatcaggtggcactgctaccaggtcctctcaatggacaaagcaaggggtgttaagtttgaatacacacatccctccccacacacactcatacatatatacacatttacatctatatttatttctgaacctccagttctaatccatacaggtgtttaaactgatgccttcattctaatccaacactacatggttcattctagttttttttttcctttcatttttgctactcccttctcagccagtgagaaaactggcttactattcaattgcagtaggtaaccagtcatgtatcattacgctgtctccttcacacatgggctctgcgctccaggccagcccatgtagaagcctatcttccttggtcctacctagtggctttagtctaaattgttcaagagaaaggagtagatgaaattatgttcttaacatatgtttgtattgcttttggattctcagtatgtcatcattacaaatcctcagagggtgtttctgtgtgactgggggaggcagactaatataaagtgctcaataaatctatttgatcatgaatcttgtcttgcatggattggattttcattttaagaaatcacgactttgtgaatattaagagcatgacttctcctttgacctttactccatcattttggtctcagatggctggagatagcatattcttttgtgagctgaggaagtcttgactgcttgtggcctcctgatcctcaaagaataaaccatactgatttgcaatacttgagtttcgcaatatttgagtttttcttcaagaaacagattttcttggaagcacacaaagtttgatttaagggacttaattcagtgtgtctatagaccctggatttcagacaattaatgctgagatggggagggagaagcaggcactggggaaaaaagatccaaagaagataagcccaggagagtaaggaggctgatggaatgtaagacaaatttacgaatggaagccagaggtggtcactatactgctttgaaaacatctttactttctccaataaccttgagctgtttcttcctgattctgaccttgaggatggtggtcaggggcaaagtgcccaaagatctgaaaatattccaccaattagtggtttgtttttcctggaataaatatgatagtcttagatttcaccaattccagtaaaaaatttctattttcccccttaacattttcttttattttacccatctttaaataaaaaaaaaaaacttctcttgatcttaccagctgaaatctcattctcctcttctatttaaagcaaatctcatgctaactacaatttttgtactcccatgctctcttgaacaccctccaatcacttttgtcaccattctattgaaaatactctggtcaaaagcaagaagctctacattactaatcaaccaatctttgatcagtcctcatcttattgtagattaattccccaatcttgatgcactgtcttcacttggctttcaacatgctagtcttctggttttccttctcccaccttatttcctctcctcaagcctttttgctctttctgctcttctctggactgctaatagtggactctcccagggctcaggctctcatctctttatgttcctacctataccctaattttgatatatactgaatctgaccatacctctactgttattctggcccaaacttttattatgtctcggctggatgtttatgatagcctcctaacagttgtccccacttcggaccttgctccctttagtctgttctccacatagaaaccccaggggttctcttgaaaatacgtcatgccacttcttggctcaggatctgctccccagccttttccctaccttatctctgtcaccagctcactcattgtggacctggcctcagcacgctgaccccattggcacttgaatctgtcattccctctgcctagaaagactttttcctaagaagctgcatgacttactcccaaattgaactgtttctctgctcaacattctcagtgccccctcactgctttatattaatatatccaaggcacttatgactatctggcagagtgtttaacgttaaagtttgttccttcatctcccccaccttccctcatgcacaataaggctccgtaaggccaggggttttgtatggttgttgctgtgtctctaactcctcagaacactttacattcttttcaacatactatgtgggacctaaacgaatacttgtcccatatgaaaagagctgtgttctgatgtcggagaaggcgattcccaagctccattttctaactgctaagagcagggcctgactaatttttatttttttttgaatcagtgaatgagggaaatgaataactgataatatacattcattgtagaaggatacctaaataatagatatgtattttctttccttttttccttataattaaatttcttagacaataaaatgatagatttatgtaatggtttcatggtttttcatttatatgttacgttatacctcttttctgttaagaatgatttttgacatcgaattacactgcagtgttttgaaaagttttccagtagggttgaagtggagggcacaccaccacctccagagagtggatgccccaaactcctttcgcccatgagccactcccccactgccctctcatcaaacactgtcttcagtgtctctcttgtgcctcaatttcaattttggggaatttcacccaatgtgggcatttgagatttatttctaaagcacccacagtttctcagaagcagtgcctttttgagtcgggaggccatctgaagaggaatcagatccttagcagggtgcctaagttaccctcagtccccccaaagaaaggagaaactcttgggatgatggctcccctaaagaaggcaacttctcctggaggaaaaggatatacatgccttggatgactcctgcccgctcacagaaggctgcttttgttgtggcttaaagttagatcttctggtagagttctagaatgtgggccctgccgatgagtgacagccaaaagctcaccttggaagaggcaccagagtcacagccccagctctctcagggaagacgctgctccagagcatctcagaagccaccagggaagacagtggcagatgggaagccggtggtgcagggccaagggcacagctctgcctgacgcagcattgtcagcaataggtaacatataacttatgaggagtatctgagtaccagcaggcactcttgggagtgaaggatgggggaagagaatctgccccagacttcatatccattggaaatgccacatcaggtgctgtatcttggcatggattgtgtttcctgtaggtgtgggagttcttcttctcacagtcaagccctccacctgtcccttgtcacacaccctgtccttttgaatagaaattctcatcctagcccagcttcaggcacggcctggcttacccttggaccccagagatctcacccttctgaggtctcaactctccttaaggagttaggaaatgaagcttgggaatccacttctcggacatcagaacacagttccttttgcacaggacaagtatttatttaggttccacttagtatattgaaaagaatttgaagtgttttggtggtttgtagtcctctttcatcatgctgaatcaagcctcaaaaaggtcaatttctgcagttgttaaaacacagaggaatttttatagtgtgtgtgtttgcataagtttataaggagctttgtcacaaggtcttctgttttagagaaacaagccattttactcctttcatagttcactgcaatttattttatactaattttcgtatttacctttatttcaattcatgttttagtcagctagagaaattattcaattttttttttcagagaagacactaaggttgcatactttcagagattttcaatgtctaagcacatctacttattgccatttaaataatgattttttttggtgtatacaatttgggtaaaaatagtctttttgcttaaatatgtttatggcatttacagctctcaaagagaagtctgaggccaggtgcggtggctcacgcttgtaatcccagcactttgggaggccgaggcgggtggatcacctgaggtcaggagtttgagaccagcctggccaccatggtgaaaccccatctctactaaaaatacaaaaattagccaggcatggtggcatgcgcctgtaatcccagctacccaggaggctgaggcaggagaattgctggaacctgggaggcagaggctgcagtgacctgagattgcgccactgcacttcagcctgggtgatagagcaagactccataaaaaaataaataaataaaaaaaataaaaaaaagagaagtctgacaccaaactaaatttggtttcgtttcaataattttttttctgcccatgtttttgtaggttgtttctattatccttgaattttattaacatctccaggtaaggtgtagttttaggggaactttgtttttgtttcactttgttttgtttttgtttttgttttttgagacagagtctcacattgtcacccaggctggagtgaagtggcacaatctcggctcactgcaacctccacctcctgggttcaagtgattctcctgccttagcctcccgagtagctgggactacaggtgcacaccactgcacccgcctaatttatttatttatttattttttgtagtagagaaagggtttcactgtgttagccaggatggtctcgatctcctgacctcgtgatctgcccaccttggcctcccaaagtgctgggattacacgcgtgagccaccgcgcccggtcgggaactttcctctagtatttctggaggtttgatactctgcttttttgttggttccttacagaatctctttctgcttatctgttctggttctcttacattacatctgtcttccaaatgtcttctttgctttagccttttcatcacttaatatgtttttttcccctctgaattctacaataataccctctaagtcactgcctgtgaggtggtttttgttgttgttgttgtttttgccatagtcaatctgctttacaaagccatgactgcatttttaatttctaaatttttaaaatttatttactcatttatttagagatgacatctcactatgttgcccaagctggcctcaaactcctgggctcaagtggcctgcttacctcggcctcccaagtatctgggaccacaggcccttgctactattttttattttgataatgatatttttcatcagaaagctatccttgtggtcacacattattccttttcaattgtaaacacagtctatcccaaatcccagtgaaaataaaaaataagatttatatttcagagtttcattaaatgttagctggaagggtttgcgtgagtttatatttcaacatggtgggaattgatctatttctgctaaatggcatcatgctgaccctgcactgtccttcccatccttcttagaggacatcccctgctatgtcgttttagaagccactgagcaccatggcaacctggatatctcagtactaatgatgctatttctttttgtggtggtgaaacaaaactcagcctgcactactgtctcatgagaaattttttattatctttcatcagatgaaagagtatttgcctacacattgccaatattcatccagatatattttgggaaaaaaagctcttcaatttctcaagcacttttttcatcttttgaactggaatccaagtcatggaggcccatcaccttacagcttcttaaatggcaaacataattattctttgattttgcttttcctcaggctgcattcttaagtaatttaattttccttttgttatatgtgattggcaacaatgcgcacaatgagtttgtatctaacacaattttgaaatagtgttttttcttttttatgtctcataatcattgcagggtgtaactcaaacttagtatacgccagcatggcaagtggccgcggctcaattcttcctcttgagagtcagatggccggcatgcattactaatctattatagtgcgtattaaacaaatccaaagtttgttcaattttttccataaaagccaaagtccttttgtaatcacaatataatatttgtctactcccttttctgtaatttaatatatcttggatggctgagcagttctacatggatgggaagaatcactccttccccctgttgagagcgagaaggcacatggtgtttaagagttagaatgagtctggttgatcccgtacttaactacgaagttatgctgtgagcctcatattttctcatctgttaaaaaaataaaaatgctaataacatgttcaaccagctgaatttgccagtctgtaacctctgctttggatgtgttctttttttcctgactactccaaattgtgacagaaaaacacttgtctcttgactgttaaggcagtagctgctcaggttcacctatacccaggccaagctccggtatttggggttctaggattagtcaaatatttgggccctgctcattctgagagggaaggctctcatagagattttgtaatgaattgagtagatgttatccataaaggagtggtttttattcatttcattaaggatatttacagctataagtgtcagaaaatctgactagcaaatgctaaaatataagaatattcgttgtttactccagaattcttgggatacatgttcctaggtctgattcaacagtttcatcaagaccccaggcttatctgcatccacttattctgccattcttttttttttttttttttgagacggagtctcgctctgtcacctaggctggagtgcagtggcgtgatctcagctcactacaagctccacttcccgggttcacgccattctcctgcctcagcctccccagcagctgggactataggtgcccaccaccacgcctggctaattttttgtatttttagtagagacggagtttcactgtgttagccaggatggtctcgatctcctgacctcctgatccacctgccttggcctcccaaagtgctgggattacaggcgtgagccaccacgcccgacctactctgccattcttagcatgatggctcgtagttccaagattgcatgttgacttgttgcctcatggcttcaagatggctgcctctgctcctagcattatatcctctcccaactacagtcaaagacagaaagtgaagggagtagcttccctagaacaaggactctcctctttttttttttctttttcctttgagaaaaaggaggaatctccagaggattatctctcattacaaactttcctttagatcttcaaagccagaaccagatacctttagctctaagggagactaagaatatgagtacagtcagccctctgcatccatggattccatatccatggattccaccaactacagatggaaaatattcttttaaaaaattaaaaatggccaggtatggtggttcatgcctgtaataccagcattctgaggggctgatgtgagaggatcacttgaggccaggagtttgagaccaccctgggtaatatgacaaaaccccatctctacaaaaaaatacataaaatgtccaggtatggtggcatgtgcctgtggtcccagctgcttgggaggctggggcaggaagattgcttgagcctgagaggcaatggttgcagtaagcaaaaataatgccattgcactccagcctgggtgacagagtgacactttgtctttaaaaaaaaagttaactatgacaataaaaataatacaaatcaaaaatatagagtgtaaccactatttatatagcatttacattgtataaagattataaataatctagaaataatttatagtatacaggagaatatgcataggttatatgcaaatactaaaccattttatctaagggacttgagcatctgtgaattttggtatctacagggctccaatcttccatggaggtagagggactaatcagtgtgattttctcaacctctatattgagagacagacaagggagaaggggtacaaatgcctgctgggtcttttagtaagggatccaccatagcactcagatgttctgtccttcatctctctatcccacctggatgaattagcccttctttgttacgtagtagagcaattcatatgtgtacatgtaaaatgatttgtttccctgttaaacgttaactgatgatgataaacacaaatatgagattttcctgccatggttatgataccttacatttatataacaattttatatctattatctcaaattctgttcataagaatgtcataagtttcaaatttttggtctctccatatgagaagtagagagatgacatttattatcatacagctcatcaatagcaaatgaggaagcttgattctttgacctaagctttttaaccttttacgttgtctgtaaaccttatgccaaattaagaaaactagaaagttttttttccctgcttctagtagggtaaacttttagtatcttttctaatgcagagaaattaatgaagctctacatctagttcaaaattccagtgtttttgttgggtaggggtggggaggtgggacagttagtagtatctcataaaatatgagatgggaatttcatttgatccaatgatcccattctataaatttttttgctgggatataaacacagaaaggtaaaaggttttatctccaattcatattcagcatcattaatattaacaaaactgtagaaataatctaaacggacatgatttgggaactagcaaatcatggcatatatatatatatatatatatatatatatatatatatatatatatacacaagggaaatgtgaatctgttaaaattattgtaattcattctcacttatgaatattgatataataagtgattaaaagttccttaatagcagactaagtccaacagcacattaaaaaaatacattgtaatcaagtgagatttattccaggaatgcaaagatggttcaattttagaaaatccataaatatctataaaataatcatgtgattatagccttagtctggcagaaaggcagttgataacattcaacaaacattcataatacaatggattcagtaggaactgatggatgcttctttaacatagcacaacctgtgtagttcttaatttacttgaaaccacagccctttttctgctaaactcaggaagaaggcaaggatgcccattacctacattctatttaatattgtgctgaatttactgaccagtatagacagagaagacaaagtaattagtggtaagggattagaaaagaagaaattgaaaaccatctctatcaatgatatggatatagtattcctggaagacacaaaagacctgaacataaaactaattcagacaataaaagtaaggtggctatatgtaaaattaacatgaaaaatcaatagtcttcatatatacaaacaataaccttgctagaatgatagtgtaagagaaagtgtcatttaaaacagcaacagtgacaacaaaagatcaactacttagaaacaaatttaaaggaaatgtgcaaaccttgtataggaaaaaatttaaacaccccttttttggagtgataggatgattcaacatcataaagatatcagttctcctagatttaactgaattccaataaatgcaaaaaagcaggatttattttagctaagttgatgctaaatttcatatggaaaaattaaaaagcccaaacataggaaaacgttggaaaagaaggacacaagaggaggactagtaaatttgaccaaatgttgaaacacactagtaagtctctgtaattaaaaagtgtgacattgatgtgtaaataggcaattcagtggaataaaatagagtcttgaaatagatccacatacatctggaaattaggtatgtgataagggtggcatctcaaatcactggggaaaagatggacttattaatcagtgttgttggaacaactgagaaaagatgaaactgaatccacatctcacaccgtacataaaaataaactgcaaaccaaactaaagatctaacaaacaaaataaaaccacacagttatgatagaaaacatgatgcattcctttataatctgagagtaggaagctttttttaaatatgacaaaacccagaaacaataaaaggaatttgcttttaaaaatgaaaaagcctttgcattgtagaaaacatttaaataaaaccaacaaatggcaggggaaatttatatcaagtacaaaacgctaattaattaatgatctatagaaaatagagaagagaaaaaaattctgatgtgcagagaaatgaacagtcagttcatggaaaaataaaatcagatgatgcttaatatatgaacactccaccaactattatgaaaggaggtgaattaaaattacactgctctttgaaaggttagtgactgagggggcacaatggaggcttctgaggtgccttatctttgatctgtgctggagatactcagattgttcacctaaaaagtttctcaagttccacaccttaaatctatgcaatctattgtacaaggggacttttgcaagttcataggaaaatagaattaaaagatatgaataaaaaatataaacatttcttgacagaagccccatcaacttcaatacagctttgtaaatgataataacagtcatttagtccatccttaacaaagtgaggtcctgggaatttaaccatgtcaatgcagtcttttttacatattaactgaagaaaaatgggtgccctttaaatttttttttttttttttttttttgagatggagcctttctctgccgcccaggctagaatgcagtggtgcagtctcagctcactgcaaactctgcttcccgggttcatgccattctcttgcctcagcctcccaagtagctgggactacaggtgtcagccaccatgcctggctaattttttgtatttttagtggagatggggtttcaccatgttagccaggatggtctccatctccttaccttgtgatccgcctgccatgacctcccaaagtgctgggattacaggcttgagccaccacacccagtgcctttaaatatttttaaagattaggaaacaaaaagaagtcagagggagccaaatcaggactgtcaagtggatgattaatgatttcccatcaaaaatctcatggaattgtccttgtttgatgagaggaatgagcagaaacattgatatggtggagaagctctggtgaagcttctgtggacatttttctgctaaagctttggctaactttctcaaacactctcataataagaagatgttatcattctttggcttttcagaaggcgaacatgcaaaatgccttgagcatccagagaaacttaccatgacttctgttcttatccagcctgcttttgctttaactggaccacttctaccacttggtagccattgctttgattgtgctttgtcttcaggattgtagcggtaaagccatgtttcagctcatgttacaattcgtaaaagaaatgcttcaggatcttgaccacttgtgtaaaatttccattgaagggtctgctcttctctgcagctgattgggccgccacaattgtttcagtacccttgggagtgaaaagtctgctcaactgaaatttttcattcagaattgtataagctgaactaattgagctatctgtggtgctggctattgtttctcctgttaattgtctgtacaattgtcctatacaattgtctcctgtacaattagggcatgaccaattttttttttttttgagatggagtctcactctgttgcccaggctggagtgcagtgacgggatcttagctcactgcaagctctgcctcctgagttcacaccattctcctgcctcagactcaagagtagctggaaatacaggcgcccaccaccacacccggctaatttttttgtatttttagtagagacggggtttcaccatgttagccaggatggtctcgatctcctgacctcatgatctgcctgcctcggcctcccaaagtgctggtattacagacatgagccaccatgcctggcccaagatttttttttctcacaaattgatgtggatgaactgccactgtgggcttaaatcttaaatcttaatcttaatattgactcctacctttttaaaatgagttatttatttgtaactgctgacttctttcaagcaatgtcacatagactttttgtaaaacatcagtgatttcaccattctgccacttgagccttataataaatttaatatttgttcttgctttaattttagcagaatgcatgttgctctgataggagctctacccaaactgatgtcttattcttcttggtgcctcaaactagatcctgtttaggcatgttataacaagttttgtgagtttgttttggtgaaaaaagttggaatccatgcatagttttttcataatacacattttccgtgaactttttaaagacccctcttatggatgttatacttactaaaaatattcttaacaaaaacctagtagtcagataccatttcttattcctcagattagcacaaatttaagtttgacaacatgctctgttggcaggactataaagaaaaaaggcactataatatattgctgataggcatgcaaaatagtacaaccctgtggagagaaatctggtaatatttaacaaaaccacaaatgcttttaccttttgacctggtaattccacatctaataatttaccctaaacatacaactccaaaacagcacaacacaaggtcattatttttgttaatatcaaaggaatagaaacaactcaatgtttattggtagaagactggctaaagaaataatgatatttgcacacagtaaatttacatggccatgaaaaaatagggatagtctgtaggcattagtggagaatggagaaagcaagatgcagaaaggtctatatggcatgctactctttctgtaaagaagaagagaaaataataattcacatatgtagttgcttattttttgacaggcatgcaggaaaaataaaatggaagcagttgaaaagtgttatctataaggagcatgaggaatagggaagaggagatagggatggaaggggaacttgcctcaacgtaccattttctgtcattttgagttttgaaatatgaaaatttttacatatttaaataataaaatcagagaggaaaagtgtaaagtccctgaattgggaacaaactaaaacaaaggaacctaatgatctatcaatctggaaacataaccacacagagaataggcttattctaagtaaatttttgacacaatactgactctcgatactagggaattatattctaaggataagaggaactacaatgaaatcttaaacttcacttggcaattttgttatttataatagttttgaagttattatttcaaaatcatagaataaagcaaataaatgtttttgttaatgtttttaggaagcatgatttttattttaagaggaaagatatataaaagatatacaaaaaataggggggaaaacctgtaatgttaatttaaatggaaaatatctatatgaattcgagttttttttttctaattggaagctctgaccacttgaaaagcattcaaagcaatgtcatctcaatggcaatgagcccatctagtgccctgatgtcagtttctaagttgtttccccactaagggtaactagagttttttagagaaatgcctgatttcagatctgggacagggaaagtccaaggttagcctgtgccaccttgtgtcgtagaacatcgggaagcactcagagactaataggattatgtcagaagatacatgtaccaacttgaaggagctccctctggccaaacttgggtaaattttagcatcaaaaggaataatgactttaattgtttgtcatacattgaataaataataaatccatgagtccagagtggtactcaatagactaagatagatggatgtcatttactataccattggtactatgatcctaactcccagtgaaataattgattcaggaaacggatttgcctaaaaccattaggtgacagttattgggtaacaggacatttccaacatcacaaagtatcactcatcaattacttgccaattgcaaaaggaaacacttttataacagatatctggagtcaccatataacttggtgatcaaagttagcagcattaatagtgggaaggtacatcacctgtcttcagatatgataaagtccaaagtatacaacctcaccaatgacatgttatttacaaacatcttggaactcaaatcgaaaagagcctttagacttcatatccatttcataagaatgacaaacgctcaaatagcaatttaaatgccaccatgaggaaactgccaaagaaatccacattgtggaatatctgcaaacctgaactcttcaaagagtcaatgtcatgttggaaaataaaaaggtaggagtactgctccagatttttgatagagacataaccaaatataatgcttgaactttaattgaactctgatttgaaaaaccagctttaagatgtatttggggggccacttgaatatggagcagatatcagggaatgaatttttatttctaagatacagtcctattgtgaccatgtggcagaagctcttgttttaaggaagtatttagaaaactagaaaaaatacagtaaaatgtagagaattgttgagcctaggaggcagacataaaagtggtcattatactagttctccaactgttctgcatatttaaaatattttataataaaaattagaaaaattagatttatctttttacttaaaagattatcaagggcaaattgttgaatttaaaatgcatagttagaaaacaaataaatgataggcactcatttgcgtaaaatgagtatagtacatattgaaaaatcaatccaatgtttgtacacctatgtttatagcagcatttttcacaatagccaaaagttaggaaacacctaggaatccatcagtggatgaatggataaataaaatatggtgtatacatacagtgggatgttattcagccttaaaaaggaaggaaatgccaacacatgctacagcgcagataaactttgaagatattatattgactgaaaagaataaatattgtgtgattccacttacatgagctatgtagagtagccaaactcatagaatggtggttgccaggagttggggagagggaggaatgggttattattgtttaatggatatagagtttcaattttgcaagagttctggagactgatgtaccacaatgtgaatatatttaacattactgaactgtacacttaaaaatggctaagatggtacatttttgtcacatgtatcttgccacaattaaaacataaaaatttagatataaaaattaatacgtacataaagacatatttagaagaatatatgtccagacacatgtacagagttgttatttctgtaaattagagtttcttggcaatttttgcttccctttccatccctagattgcttaatttttttatattgatcatgaatctgttttactaaaaaaaaactattttcaaaagcaagaaaacttccccagattttcggtgtttcagaaaacatggtgattcgagagcctactttttagggaaatggatttgcaggaaacaatggaaattgtcaatgtaacctgagaattttagtaaaagcaacaaaaatcctttgtcccatatggtgagaagcaaaacaggccgctggcccgtcctgtgtgttgtggttgccgtggagagcttggccttctgagcctttggcagggcctagccaacctgaccttgctcacagctgaggctcagcagcagcagggcctttgtgggaactcgcctgcccctcccagtgaactatgctttgcttggtgcctggccagcaaggaggcgaagtttgtctgctgttgttgacctgggctggtctgcctccctgtcctgaacaccaattccagcatctcaccttgcttgactgtgccccagcgggggcgttggtgcctctcatctcacaattgcctctgtgacagagccagtctttgatctcgcctccaggaatccaattcctctcaaagtctgttaatcccttgggtccacgggttattcccgtacagcatccccactctgattactcatctcaaccgtggctgatctttgcattttgacctttggtccctgtcaggccacaggccctgtattctatttgtgatgcagagacttatgtcctaactgttaatatgttcacataaacacacacgccactacagtatcattaaaatgttttctaaaatttgtcatagagcagtactagcatttatatccacatgggattttgaaaacaaattatatagttctattttgttttccattaatttattattttcagtttaacttgaggtacagtcaacataacctcaatatcagatgatgtctacttttaaaaaagcaaatattttgaaaacatagaaaagtacagagaacaccaaaacgaacacttgtgttcagaccacccagatttagcaaatgttaacatttcatagtgattgttccgggtctaaaattctcattttaaaattaaattttacttctgtatgtgggcagagcgggcctcagggaaacagtgaagctgtgagtgttccctccctgctgtcccctgcccttctgttgcaggtgactgaccaggcatctgtggcccttgatgccacacagggccatgctgggcctttcccagcacagctgtgctggcagctgctccccgggtctctccatggagcactggagtcctcaattctaacagaaatgatagaactgagtagcataaaaagctgcaagccaaaaatgaaggaaagtttattagaacaaaggaagcttattgtaactctgtaagcgggggtgctccaagcatctcagaaaaaaagagcccaggaaatgaacagctgttggaatcccagtttgctagtgcttctctctgcttcattctttaatcctattccatttgcgttttggaaaatagcctccctcagcttcgaaatttacatgtggtatgtccagccacataagaggctgactattagacctcggttgccatgacacaggtcgagatgaaagaatctcattgtctcctctctggtctagtaaactctggtgaggaaggtaaatatgaggctagaatgacatgtatgacaaatatgaggctaggaggactgtattagtctgttctcatgctgctaataaagacatacctgagactgggtaatttataaaggaaagaggcttaatggactcacagtggcagaagaaggaagagcaaagggacttcttacgtggtggcaggcaagagagagcttatgcaggggaattcccatttataaaaccatcagaccttgtgagacttattcactaccagaagaaaagcatgggaaagaaccgtgcccattattcaattacctccccccaggtccctcccatgacacatgagaattatgggagctacaattcaagatgagatttaggtggggacacagccaaaccatattaatgacacttctgtgatcctgtggatttggggagtgatggcgatgatttcaagaaggaaaccccctctcctgcacatggctacatattctccagggaacaactattgcagtctgagaagcacacaacagggatatcagcaaaagctaggaatgcctttctagcccagatatctagcactggggaaagcacaagatattgctggtggtgaggagaacaatgaagacaacttgttttttgggtggcccacgggtcattaaaagtatcacaggacaggatttgtgtatggacaacaattcccatatttacaaatgaacaatgctctaagagttgggttaatgttgctgtgtttcttcaatcagtgcttaggctctattgtgtcagagatttagctggttatgagaaaacagtgacaatccaaacccaaactttttcaaagggctaacagttttacgttgaccctgcatgcatattataaaaaattagctccatttttgagcaatatctcataaaatgcacacttatatttctttctatattcattctcatttctaaaggtatgtgtctgggttatttttacccttgtaagccgtttcaaatcttttctgaaataaacaagatacacataaaggtgtaaaatgatgtcatgtttatatttccatactacctcatagaaacctgaagcatacggctactaataatacaatgatgtgcttcataatgacgtttcagtcaatgaagtggtggtcccatgagattacaatggagctgaaaaacttccattgcctagtgacctcatagccatagtatgtggtagcgcagtgcattactcacatgtctggggtggtggtggtgtaaacaaacttactgtgctgtcagttgtacacaattctagcatataagtaattactgtattatacttttttttcttcaacttttattctaagtcaggggtacatgtgcaggatgtgcagatttgttacacaagtgaacgtgtgccatggtatcttgctgcacggatcatcccatcacctaggtattaagcccagcatccattagctattcttactgatgctccccctcccccaagctccaccaacaggccccagtgtgtgttgcttccccgacgcgtccatttgttctcatcattcagctcccgcttataagtgagaacatgcagtatttgcttttccgtttctgtgttaatttgctgaggataatggcttccaactccatccatgtccctgcaaaggacatgatcttgttcctttttatggctgcatagtattccattgtgtatatgtaccccattttctttatccacattttcagtctatcattgatggcatttaggttgattccacgtctttgctattgtgaatagtgctgcaatgaacacaggtatgcatgtatctttagaatagaatgatttatattccttggggtatatacacagtaatgggattggtgggttgatggtatttctggttctaggtctttgaggaattgccacgctgtcttccacaatggttgaactaatttatactcccatcaacagtgtaaaagtgttcctttttctccacaacctcgccagcatctgttgttttctgactttttattaatagccattctgactggcatgagatggtgtctttttgtgtttttgatgtgcatttttctaatgatcagtgatgttgggctttttttcctatgtttgttggccacatgtatgtaattactatattatacttttatcgttattttagagtgtgctcccacttacataaaaggtaactgtgaaactgcctcaggcaggtccttcaggaggtatccagaagaaaacattgttattataggaggtgacagctccatgcatgttactggccctgacagccttccagtgggacaagatgtgggagtgaaagagggtgatacttatgatcctaaccttgtgtaggcctggctaatatctgtgtttgtgttgtaatttttaacacaaagttttttttttaataaaataaattttaaaatagaaaaaagcatatcaaataaggacataaagaaaatatttttgtatagctgtgcaatttgtgttttaagctgtcttactacaaaagagtcaaaaagtttaaaaaatcaaaatgtatataaagttaaaaagttacaggaagctaaaattaatgtattattgaagaaaggaacatagtttttataaatttagtgtagcctaagtgtacaatgtttataaagcctacagaagtgtatagaaatgtcctaggccttcacattctgtcaccactcactcactcactcacctacccagagcaacttcgagtcctgcaggctccattcatggcaagtaccctatacatgcgtaccattttttatattttatcccatatttttactgcaccttttctatgtttagatacataaatgcttaccattgtgttacagttgcctccagtatttagtgcagtcacatgcagtacaggtttgtaccctgggagcagtaggccatactgtgtagccctgttgtgtagtaggctgtaccatccagatttgtgtaactgcactctatgatgttcgtgcagtgatgaaatagcctaatgacacatttctcagaacataagcctatcatgaagtgacgcacgactgtgttttgactataaagacagtaaccatttctaacatttttttccgaagaaaatagtttttaagctcgggcttgggctggagagcaaatgtcttccctgaagtctcctctagtgcattgggtctcataagccacagataatttgttggctatttttatttgctgatgacaagtcacttctctaggctcttcagccctcaagtgttgcagatttcactttctgaggtcatggctgcaagacacattttcttgaccagcagctgtggcctgagttttagattgacagtgaaatgcatagaaacacagcaggcttcccccaacaccaagatgtctcagctttaaggaagatacaggactgatgccaatactgcatggctggtgactcctgggctcagcctctgaatatctccctgtcactccccaggaagggtgagcaggtggtcacgggaggaggctgagagcatggagagaaactcagctaagggagtcatttgctctggggtcgcctcagcttttgtctttgctctcatctcagccactgcagggtatgtgggctgcgcccgtgccggatcagctatgcgcatcaaagccccttactcatgactgctcggcagtggaggcagtgaagcacaggcactcggtccatccagtcctcagtgtgttcttgtcctatgttcagtatacccccataattccttgactgagtgctgtgagagaaaatgcaccacacaagagtcaagtcctcctgtgtctctgtgggtaaacaaaagttcacaaaccagctcttcagccggagccatatcttccccatgtttgtatgctaagcacagggtctggcatatactaggtccttggtcaaaatttgcccagtgaatatacacttttgacctcaattttttttttttttttttgatggtggacgggatctcacccaggctgtatgtagtgcggtggcatgatcatggctcactgaagctttgaactcccaggctcaagtgatcctcttacttcaacctcccaagtagctgggactacagctgtgcactgccatgtctggctaatttttaaaattttttttctagagacaggggtctcactatgttgcccaggccggtctcaaactcctgggctcaaaacgtactccatcctcggcctcccaaagtgctgggattacagggatgagccatcatgctcggtctgacctgtgaattctaattatttcatatgcaggttgtttcatgtgcctagtgtttataaacgttaagtgattgcctagctagtaatttctttctattttaaaagtaatatctatcaaaggtgtttgtgctgttaaaaggcacgaggatggtaacatgaagtcccaaactacttctttccatctgtgtttcagattatttgaatatattttgctgtataaggatggagtgatgtttcagattgaccaagccaccaagcagtgctcaaagatgaccctgacacagccctgggatcctcttgacattcctcaaaactccacctttgaagaccagtactccatcggggggcctcaggagcagatcaccgtccaggagtggtcggacagaaagtcagctagatcctgtaagggttcaaagaatctaagcattgtattcagcatgcatgatggggaaaaaggtttaagtcctttaaggaaggtagtttttagggaaacatccgcttaatcaaaaattttttaaagcctccacttaggtctgcaggttactttgctcactatgtggcaacgggatctaagcttcatatttgaaacacctcagccttctagtgccacctgcacctctctgccactttggctcctgtgaacttagccttgattttgacattttatggtcgtcccgaggtctgtgacatggaaggcatctgtctaaggcacacatttgaattgggtgcctccttttctttcccccacttcctaaagttgcaggggtcaaatctactcccatcatgctgagtgtgcaaaccagcctacttttatgtgaagccattctctgccctgctgctgatatacgcctatcccaagacagtttttaccacacaggcattcatgctgtggaacacagtatggtgatttctcaaaaaattaaagataagactgccatatgacccagcaactccacttctgtatatatatatatgccccaaagaattgaacgcagagactcaaacagatatttgtacacccatgtccacagcagcattattcacaattgccaaaaggtggaaacccaaatgttcatcaacagataaatggataaacaaaatctggtatagtcatacaacagaatattattcagccttaaaaaggaaggaaacaccagcacatgctacagcctgagtaaaccttgaggacataatgttaagagaaacaatgcaggcagaaaatgacaaatacagtacaatcccacttacatgaggtatgtagagtcgtcaaattcatagagacagaaaatcgaatgatgagttccaggagctgggagaggaggaatgggaagttcgtgtttaatggagacagagtttcagtttgggaagatgaaaaaagttctggagatggatggtgctgatggtcaacaaatgtgaatgtactcaaggccaccaaacacttaaaaatggtaaaatggtaaattttatgttatgtacattttaccaccataagaaaaaatatgaacttcttgcctgtcttctttatttaaaagtcaacttttttcctcttatagatgaaacctggattggcatctatacagtcaaggattgctatcctgtccaggaaacctttaccataaactacagtgtgatattgtctacgcggttttttgacatccagctgggtattaaagacccctcggtgtttacccctccaagcacgtgccagatggcccaactggagaagatgagcgaagactgctcctggtgagcctgtgcatagggaagcggcagcatcggatgtcagccccctgcggccccagctggagatggatatgagactagtcaagatgtgaatgctaattggagagaaatataattttaggaagatgcacattgatgtggggttttgatgtgtctgattttgactactcaagctctgtttacagaagaaaattgaatggcgagggtgtggccatatgaactgactagatggctaatatggacactttgggtatttctaatgcctgttcagggctggttttctgcatgcacgggtatacacataatgcagtgccatgcacatagggaagggtcagtaagagaagtttgccttggcagcaagtatttattgttgacattattcagaattagtgataataaaaagcagagtgattttggtcaattttattattaattcttaaattccctgcagagaatgccccctttattgctgcaccagggttggcattgctcccactgagccctactccaccctgtccctgcactcccttggttgccaaaaaaatgataacttaaatcccttccagacttaagaattttatggcatggcccaattgatataaacatttagaaggaaatgaaaagctaaaataggaagtaattattcctctaaagaaacattttgagcaaggcagtttagagaatcctaatgtctacactggcatagcacgagccatgtaagcttcttttttttctatgcaagagtattgatgtatgtgctgaatcttcacagacttgtcaatacacaggcagtattctaaaatagcactgaacagggagtcaggagactattgtctcctaaacccaggactagagttccctcgtactgtcactcctttggtcattaaatgcactgggcttgcccgcactttggccttcctagaacactgcttcataacctctctgtctgacttctgcatctccttccaggtcagctcattcacaagagttgctcccaagcctggatgagttgcaccttgcatcttgagcatgcatttctcacaataattattaagctgtgtgataatttctgctttcaggacactcatccattatcttggctgtgagctccttgggtacgggtaccttgtatgtttacttttatatccctagcacaaagcaagtgcctggcacatagtcagtgccctaagtattcgtagagtgaagaatgccagcctctcttgtccctggtttccttatgtgttgaatgtggttgagtttgtccattgctagggagagacttccagtaataaaatttactattctagatgcttctactgttatgttttatctgcccatttatctttcttagttaccaggagaaatgtgtgacacctatattataatgaaaacaatctcattacttatagtttatctatattaaacaaatttaattgcattttaaagcattctttgatactgttgcttttgcaataaatatggataatcttggttataagggagttaaaacaatgctgtaataaataaagtgcttcatgtgatcaaaatcaaa

SEQ ID NO: 402 - DNA, 74986 bp, Homo sapiens
agtttctcccacggccccatgtccgcatggcggtgaaggtcgaagacgcgcgacccaaagggccaggttttcagtcagcccagcgttggcgacgggcgagggcagaacacaaccaccaccctagtcccgcccggctcggggcctagcttctctactcacagcgtcggagggagggagggagggagcgagccagcgtccccgcgtctgcggcaccctggccggcccttcgccctccgacgcgcgcgcctattggccaccgcagcctctcccacatggggcgaaggcgcgccacttcattggcccccgcgtgaggggcggggctaaagagcgcgggtcctcggccgtggagggtcaagtggcttcttctgagcgctgagggaggggagcgtgcgtaggggatggtgccagcgctgcgttatttggttggtgcctgcggacgggcccgcgggcttttcgccggtggctcccctggggcgtgcgggttcgcgtctgggaggccaagaccgctgtgtggaggtagccgcagcgccagcaccaggtgagtggccgctggtcctccccgccgcctgcgctgctgcccctcgcggaggcacctggtggtggacctgtgcccctgttcgtatttccctgtcccggggtgagagcaggttggggtcctgtggcactccaacctcggatcccaggagctaccaacctgcaggttcattcgttgtatttacgggccggaggaaaggcagtgtatagagtagaggtcgggagtagctctggctttgaacaacccgtccactttctgttgaactctgggctagttacttaacctccttaaaggctcagttgtgaattggaccttagtctctcctgtaggtggtcatttgaaggataaaaggacctagcacacagtataagcaatcaaatatgctctttataagctggagtctttggcgttgcttggaagatctgaatacagtcttaaatcagttcctggcacaccccgcatagtgttgcccccgtcggaggcagctcttatgctaatgaaagcccgcagaattcagtgtcctgtgatttatagtttggacgtcacattcgaaaccattgtctttctctgtcctctgtagaagaaacagtttgtgtgaaggctgtaaggcttggagaggttttggctattttgacgactagaaggtgggccatatgagtgtgactgaagtttagtggaagacatatggtgtggaatgacccagaaggactacatcacagcaaggtttttagtttattttaaccacacgttgacttttattctaagagccacgggaagctatttaaaagggttttaagaagaggctacgctttaggaggccgaggcgggcggatcgcctgaggtcagaagttggagaccagcctaaccaacatggtgaaaccccgtctctactaaaaatacaaaaaaattagcctggcgtggtggtgggcgcctgtaatcccaactactccggagccttaggagaatcgcttgaacctgggaggcggagattgcagtaagctgagatcgcaccattgcactccagcctgggcgacagagcaagactctgtctcgcaaaaaaaaaaaaaaaaaaaaaaagaaaagaaaagaaaaaaagaagaggctaataattaaatgttgatgttctaaaagttgactctggctgctgcgtgttggtggatagggggagtagagtgggataccagtaatagcgattgtgatttgttatggggcatgtggacagttcttttgggaagcttttcttaaggaaagaaaagtagggctagtgaaagttttgtttatacttaaaatgtttttttaaaaaatttttggagtcagggtctcactgtgttgccaaggctggagtgcagtggcacaatcatagctcactgcagcctccaccctcctgggctcaagcgatcctccctcctcagcccccctccccaatgcttcctgtcctccaggagctgggaccacaggcagctaattattttcctatttttttgtagagacgttgcccagggtggtctcgaacccctggcctcaagtgaacctccctcttcagccacccaaagtgctgagattacaggtgtgagccaccgtgcctggcctatacttttattttgaagtaattatagatccattggaaattgcaaaaatagtacaggccaagcgtggtgactcaggcctgtaatcccagtgctttgggaggctgaggcaggaggatcacttgagcccagaagtttgagaccagcctgggcaaaatataagatcccttctctacaaaataaaaaataaaaataaataaacagtacaaagagatcccatgtacccttcaccccatttaccccaatgaaaacatcttatataactatagtacaatatcaaaactaggaaattgatattggcaaaatccacggacattgttcagctttcatcagttttacatatattcgtgtgtgtgtgtgtgtttagttctatgcagtttaatcatatgtattaatttgtgtaactaccacctcaattaagatatgaaaatgtggccaggcatgctggctcatgcctataatctcagcactttgggaggccgaggtgggaggataggttgagcctcagagttggagaccagcctgggcaacaaagggagacggcaaaacccctgctctacaaaaaaattaaaaaataattagccaggtgtggtggcttgctcctgtagtcccagccacttgtggggctgaggcaggaggatcgcttgagcccaggaggttgaaggtgtggtgacctgtgattacaccgccgcgctgaagcctggacaacagagcaagactctcttaaaaaaaaaaaaaagggtggtataaaaatattctattgccacaaggttatctgttgtgttacctatctctttatattcacaccttcctctccattcttcctaactcttggcaactgtgaatctaaatttttttttttttttaacacgaagtctcgctttgtcacccaggctggagtacagtggcatgatcttggctcactgcaacctctgtctcctaggttgaagggattctcctgcctcagcctcctgagtagctgggattacaggcatgtgccaccacgcccagctgattttgtattttgagtagagatagggtttcaccgtgttggccaggctggtctcaaactcctgacctcaggtgatccacccgcctcagcctcccaaagtattgggattacaggcatgagccactgcacccggcctgaaattttttatatcaccaaatattcagtataaaacttttagaaaaaggacaagatctttggacatagagatgacatcaaaagcatgatctctaaaagaaaaaaattgacaaaatggacttcatcaaaatgaaaaacttttgctctgcaaaagactgttaagagaatgaaaaaactaccaagacgtgggaaaaaaataccagcaactgcatatctcccaaaggactaatacacaaaatacataaagaactctcaaaacaagcctttggagattggctttttttcacacagcatactatccttaagatccatgcaaggcgtcgcctgtattgatagcaggtttttcaaaattgttgaatagaattccatggtatggatacatcacaatttgtttaaccgtttaccatgggttgaagaacatccaagctgcttccagtttttggctattacgaataaagctactatgaacattcatgttcaggtttttgtatgaacataagtttcatttctctggaataaatgcccaagactgcagttactgagtcatgtagtaagtccatgtttagtttctttttaagaaactgccatactcttttccagagtggctgtactattttacattcccaccagctatgtgtgagtaatccagtttcccttcattctcaccagcatttggggtgatcactttttaaattttagccattctgatagagacgtagtgatatctcattgtggtttttatttacatttctctgatgcaatgatgtttgaacaatgcattgactaatggtgttgaacatcttttcatgtgcttctttgccatctgtgtatctgtcctctttgatgaaatatttgttcatatcttttgcccactttttttttttttttttttctgagatggagtttcgccttgttgcccaggctggagcgcagtggcgcggtctcggctcaccgcagaggcctcctgggttcaagcaattctcctgcctcagcctcccgagtagctgggattacaggcatgcgccaccatgcccagccaattttgtctttttagtagagatggggtttctccatgttggcatggctggtctcaaactcctgacgtcaggtgatccgcccgccttggcctcccaaagtgctgggattaaaggcgtgagccatcgcacccggcctgcctacgttctaaatggcttgttttgagagttcttttatgtatgagtcctttgggagatatgcagttactagtatttttttccaatttcttagtttttttatcctcttaacagagtctttttgcagagcaaaagttttatgttttgatgaagtccattttatcagttttttttcttttatggatcatgtttttgatgtcaactctaagtcccaagattttgtcctattttttcctaaaagttttaaagtgaatattaggtgatgtaaaaaattttgtgttagtttttttaactataatggtagtgtgtgtttttagagatgccttttagaaataacattgaaatatttacagatgaaataatgtggtgtttaagatttgcatcaaaataatataatacaggaggggatgaaatagagtatagaagaagcaagatttgctgtgagttgataattagtgaagctgggtgatgtatatgtggggcttcattgaactattttgtctaactttgtgtaggtatgaacttttccataaaaagcttaagaaaattatctgttaaaccattcattggtgttaacttgagattaagtgagttgtagagaaagatgtctctttcagcctccgtggttagcttggcctgcaactgtcctccagcattcatctatgactattgttctgttcacctgtctccatagtggatgcttggagatttgtgcttttgtttgtgaaacatatttcaatgattttgtgtcactggataaaacagtgattcttcagatttgagaagagggagtgaagggtggcacatgtagttggaaaaagcatattcagtatgatagttttatgtttgaaaataagaagggtttattgatagttgtagtataatctgcaaagacaatatcttggctgggaatctgtaccaaggtaataattctaagtggaaggtctacctccccaaaagcttttgtgttataattatcaaaaggcagcaaggggccaggcgcagtggctcacgcctgtattcccagcattttgggaggccgaggcgggtggatcacctgaggtcaggagtttgagaccagcctgaccaacgtggtgaaacctcgtctctagtaaaaatacaaaaactagcccagcatggcagtgttcgcctataatatcagctactagggaggctgaggcaggagaatcacttgaacctgggagtgggaagctgcagtgagccgagatcatgctgctacactccaacctaggcaatagagtgagaccctgactccaaaattttttaaaaaaaaattttcagtataaacaaaactttcaccagccctgcttttctttccttaagaaaagcttcccaaaagaactgtctacatgccccacaacaaatcacaatcactgttaactggtatccgactctactcccgctatccaccaacacgcagcagccagagtcagcttttagaacatcaacatttaatcactagtctccatctaaaaaaaaaaaaaaaaccccaaaacaaaaaaaccccccaaaaaaaacaaaaggcagcaaggatgagaagcattattatggaagtcaagaccacccctgtaagggccaaggttatgctaccttttacagaaaatgagccttgaaggcaaaacatagcatcatagttgaacttgaaagtaagaaagaaaaacagtatgaaagatatctctcttatacacacactgccatgtaattgatatagatatcaacttgataaattaaaaaaatacagctgggcacggtggttcacacctgtaatcccagcactttgggaggctgaggtgggcggatcacgaggtcaagagattgagaccatcctggccaacatggtgaaaccccgtctctactaaaaatacaaaaattagctgggcatggtggcgcgcacctgtagtcccagctacttgggaggctgaggtggaagaatcgcttgaatccgggagctggaggttgcagtgagccgagattatgccactgcactccagcctggcgacagagccagactccatctcaccgaaaaaaaaaaaaaaaagtcagtcaaaacagtcagtcctcgtttttgtgggttctgcatctgcagattcaaccaactatggatcaaaatatttggaaaaaacagtaaaaaataacacaatttaaaatacagtataacaactattcacatagcatttacatggtactatgtagtataagtgatccagagatgacttaaggtatattggaggatgtgtgtagattatatgcaaatactgtgccatttcgtatacaagacttgaacatacgtggatttcggtatccatgggagtcctgaaaccaatcccctgtggatattgagggatgactgtatataaaatatgattaagtaatacacatacaaatatcttaagtatttgtaagtgttttgaacacctaccttagtggaagattatagaggttttgaaaaataaaaagcctatcttaacaatagttattctggaattcttaaaagccaggctattttagaatccataaaacatctgtttattgtgaaagttgtgtaaagggtcaatctgtaaatcagtgtaagtacctagtggaatgtgaatgctttaccttttatccactgaacttatgtttttttaaaacctgcttaaaggcttggacttccaaatacattctgatcacattagtaattttttagttgaccactgtaggcatttgccaataactagtattaatgtagtggacccagaatcccattttacttgtgctgctctttttatgccctctctttttaaaagtgggcatcattcaccatccttgacaaccattttatccaatctaaagctgctgcaggagaaccacctgctgagcatcacctggaggttctccctgttcaagtataaggcttatgctctgacagagggaactttatccacttatgacccccaagttaatttaagatgcaggatttgatttatcaagcttacgtgttagttcctagttgtctaggatctgtttctggttccagatacagccaaagatgtggtagcaattctaatcaaattgatgtgctttgctaaggattttgaaattgaaacttagatcacttttcgaagaaagggcctaatctctgaaatttccctctgtctacagttcctataagatccatatttgttggctatcaggtcagtgttaaaggtaatcttttaagcttcgaattgcagatttatataaattatacatggttgttctaaattttttttttgagacagagtctcgctctgtcgcccaggctggagtgcagtggtgcaatcttggctcactgcaagctccgcctcctgggttcacgccattctcctgcctcagcctcccgagtagctgggactacaggtgcccgccaccacgcctggctaattttttgtatttttagtagagatggggtttcaccgtgttagtcaggatggtctcaacctcctggcctcgtgatctgcccgccttggcctcccaaagttctgggattacaggcgtgagccaccacgcccggccctaattttgtaaatggttgtataatcaggatttgccatggcaaagattgtggttcctaagcccatttctggaccaattattgccccaaggtttattttctcggagttgtttacttctcaaagaaaaacttgtaaaaattcttgcacactaaagtgttaaagctttaatgtgttaacacattgtcaagagtactacattggaattttgaaaggctgggtagtagaatcatgactatgcttaacacaaagtatagtcatgcaccgcataacaacattttggtcaaccacagactgcatgtacagtggtgataccaaagattataataccatattttttctgtaccttttttatatgtacacatttttagatgcacagatacttaccattgtgttacagttgcctgcagtattcaatatagtaacctgctgtacaggcttgtagcctaggagcaataagctatcccatatagcctaggtgtacagtaagctatatcatctaggtttgtgtaagtacattctatgctgtttgcacaaggaaatcgcctaccaatgcatttcttagaacctaaccctatggttaagcaacgcatgactgcagtcacttatgtaaccagcctggctgccgtgctatggagataaagagcagattgggcaaccagctatcctgcctgccagtaagctgtagttgattatactactgaccagtgatgcgtataacttttgaggttttttttttttttttttaatgcgtctaactttttttttttttttttgagacagggtctggcgctgtctcccaggctggactggagtgcagtggcatgacctcggctcattgcaacctccgcctcccaggttcaagcgattctccagccttagcctcccgagtagttgggattacaggtgcctgccaccacacccagctaatttttgtatttttagtaaagatggggttttaccatgttggccgggctggtcttgaactcctaacctcaagtgatccacccaccttggcctcccaaagtgctgggattacaggcatgagccatcacacccaggcttgattagtataacttttaagggttttttttttttaatacatgtgaaaccaaacagcacagggcccaatacattgctctgtcgccttgctctgtcaccaggctggagtgcagtggcgtgatctccactcactgcaacctctgcttcccaggttcaagtgattcttctgcctcagcctcccaaatagctgggactacaggcacgcgccaccacgcccagctaatttttgtatttttagtagagacggggtttcaccatgttggccaggatggtctcgatctcttgacctcgtgatccgcccccctcggccactcaaagtgctgggattacaggtgtgagccactgcgaccggccgccgaatacgttttcatgattacaaattaatggtttaattgtccattgatgaaaattatgcatgtgaagtttggcgaggtctactgtaaatatgaattactttaaagatgactttcttttgaagctcatttgatatagtcatcgttggtggcggaattgtggggcttgcctctgccagagcactcatcctgcgacatccatcactttctattggtgttctggaaaaggagaaagatttaggtatgtatataatcaatgttgttctttgggcttacttgggcatctgctcattttgtctgttgtgaatctttcatgctgaatgtcagtgttagtttcttagtttgtgttctaaaagcagagtgtgggacaaggacatggctataggttatttgagaggttaaagccgagtgtgggacaaggaggacgtgtctataggttatttatttgagaggttatctcaggaaacaggagtgagggggtgaggaaagtaagacagggaaggaggaaaagacatgagaacacatcaagattgtggctgtgagcttgattccaccggagcctctgaggagcaatgtagtatttcccaggattgtgctcactttatccatcggctcttctctctattggttgaggattgccgctagtgatgttgagcaccccgtgcccttctctaaaaaagttaccagaggccccaaggcagagtgcaaagagccctagggggcccctgaagtggtttgctggtaatgagaggtgagtttgtgcaccaaagttgtagttgaaatcagagatgggctggagggatgtgacatggataccagggatgttagaagaagttaccagtgatctgaacaaattcaggcagaattttacatgatgtggtctctaatagcttcaactataagtttgttctcttacctcttatgttttgtatgaatcatgtacttactcttaccctgtttctcttgttctgtagctgttcaccagactggacataacagtggtgtcatacatagtggaatttattataaacctgagtctctgaaagccaaattatgtgtacaaggtgcagccctcctctatgagtactgtcagcaaaagggaatttcctacaagcagtgtggcaaggtatggcattttattagagccttgactaatttccaactagcatttgcttagtgatgtttaatattacattttttaaaaatgtatttttttctttgtatctatgtaatttttcaaatctaatcttagggaataactaaaaaaagatggtgtgacgttatgtaattttctaaataaaagttttattgacatataatttatgcaccatacaattcgcccttttaaagtgcacagatcaatttttagtatatttatagagctgagcaatcatcaccactatctaatttcaggctttttcatcaccccaaaaagacaccccatacccattagcagtcacttcccatttctacctcccccgatgccctagcaaccactagtatactttctgtctttgtggatttgcctgttctgcacttttcatataaatagattcatatactatgtagtcttttgtgactggcttctctcacttagcataatgttgtcaaagttcatccctgttgtagcatgaatcagtacttcatgtcttttatggctgaacaatattccattgtatggatataccacattttatttgttcatcagttgatagacatatggattgtttccaccttttggctattatggataatgctgctatgaacattcatgtataagtttatttgtgaacatatgttttcatttatattggttatatacctgggaggggaattgctggattgtcagggtaactccatgtttaacattttgaggaactgccaaattgttttccaaagctctgtgctattttacattcccaccagtaattaataaggattccaattttccatgtccttgccaacatctattttggtttgtcttttctattttagccatcctagtggaagttttgatttgcagttccctagtgataatgatgttgagtgtcttttattttttcctttttagaaaatagttcttgagcccaagggtttgagaccagctcgggcaacatagtgagaccctatctctacaaaaaatttaaaaagttagccgggtgcggtggtgcacaactatagtcccagctacttgggaggctgaggtgggaggactgcttgagcctgggagatcaaggctgcagtgatccatgattatgccactgcacttcagcctgggcaacagagtgagaccttgcctcaaaaaagttaaaattattattttttaactttatttcttatttaaaagttgagacaggatcttgctttgttgcccaggctggtctcaaactcctggcttcaagcactcctcctgccttggcctcctgaagtgctgggattacagatgtgagccactgtgcctggcctaaaattattttttaattgacaaaaattgtaaatatttatcatgtacaacatgttgttttgaagtatgtatacgttatgggccgggcagggtggctcacgcctgcctgtaatctcagcactttgggaggctgaggcaggcagatcacttgaggtcaggagttcgagaccagcctggccaacatggtgaaaccccatctctactaaaaatataaaaattagccgggtgtggtggcacacgcctgtaatgccagctactcgggaggctgaggcacgagaattgcctgaccctgggaggcagaggttgcagtgaggcgagaccacaccactgaattccagcctgggcaacagagtgagactctgtctcaagaagtatgtgtacattgtggaatggctaaatcaagctcaccaacatatgcattacctttcatacttattttttttttatgatgcaaacacttaaatctactgtctgagcagtcttcaagaatataatacattattaactataatcaacattttgtgtaatagatatcctgaacttattcctcttacttaactgaaattttgtgtcctttaacaaatatctttccacaccacccctgcctccctgccaccctcagcccctggtaaccaccattccactctctacctctgtgagttcaactttttgagattctacatgtaaatgagatcacgcagtatttatctttctgtgcttggtttatttcacctaagataatgtcctccaggttcatctctgttgtcatttgtggcatggaccatttgtgacaatagagatgaacatggaggatattatcttaagtatttctcattatcttaaagattttctccttttttaaggctgactggtcttttgttatgtatccacctgaactggcctcccacagtgttgggattacaggtgtgagccaccacgcctggcctgattgtatggtttttgtcattcatcttgttgatatgatgtgtcaccttgattgatttacatatgttgaaccatcctttgcatccctgggttaaatcccacttggtcatgatgaatgatctttttaatgtgttgttgaatttggtttgctagtattttgttaaggatttttgtatagtgttcatcaggaatattggcctatagttttcatttttttgatgtgtctttgtctgggtttggtatcagggtaataccagcctcatggaatgtgtttggaaatatttcctcctctactttatggaatagtttgagtagggtttagtattagttcttctttaaatgtttggtaaaatttagcagtgaagccatcaggttctgggcttttctttactgggagactttttattatggcttcgatcttattgccttttattggtttgttcaggttttggatttcttcatggttcaatcttggtaggttgtatgtgtccaggaatttattcatttattctaagttttctaacttattggcatatatagttggtcatagtagcctttaacaattttttgaattactgtggtattggttgtaatgtctcttttttcatctctgattttatttatccgggtcttctctttttcttagtctggctaaaggtttgtcaattctatttatcctttcaaaaaaccaacctttcattaatcttttgtattgttttctttgtttcaatttcatttatttctgctctgatctttattatttattttcttctactaattctgaatttggtgtgctcttgcttttctagttttttaagatgcattgttagattatatgaagttcttctacttttttgatgtaggtgcttatagctataaactttcctcttagtacggctttcgctgtttcccataggttttggtatgttgtctttctattttcatttgtttcaacagatttttaaatttccttcttaatttctttattggcccactggtcatttaggagcgtattggttttgtttgcttgtttgtttatttttttgagatagagtctctgtctcacccaggctggaatatagtggcactatctcacagatcactgcagccttgacctcccggccgggcatggtggctcgcacccctaatcccagcactttgggaggctgaggcgggggatcacctgaggtcaggagttcgagaccagactgaccaacgtggagaaaccccatctctactaaaaatacaaaattagctgggtgtggtggctcatgcctgtaatcccagctacttgggaggctgaggcaggttagttgctagaacctgggaggcagaggttgtagtgagctgagatcgcgccattgcactccagcctgggcaacaagagcgaaactctgtctcaaaaaaaaaaagtcctcccacctcaacctctggagtaatggggatcacaggtgcaccaccatgcctggctaatttttctttttttttttttgagacagagtcttgctgttacccagcctggagtgcaatggtgccatctcagctcactgcaacctccacctcctgggttcaagcaattctccagcctcagcctcccaagtcgctgggactacaggctcacgccaccatgcctggctaatttttgtatttttagtagagatgtggtttcactatgttaactaggctggtcttaaactcctgacttcaagtgatctacccacccaaattgctgggattacaggcatgagccaccatgcccagtcattttgttgttgttgttcgttttggtttttttttttgagttaggatctccctccgttgctcaagttggtctcaaactcctgggctcaagtgctcaagtgatcctctcaccttggccacccaaagtgttgaaattacaggtgtgaaccactatgcctggccagaggcatattgtttaatttctgtgtgtttgtatagtttccaaaattcctcttgttattgatttctagtttcattccattgtggtcagagaatatacttgatataatttcatttaaaaaaaattttaaagacctgttttgtggcccaacatattggtctatccttgagaatgatccatgtgctggggagaagaatatatattctgtagctgttggatgaaactctctgtaaatatctgttaggtccatttggtctgtagtgctcagtagtttattctttgtgatgcttttgtgaggagaattgttttcctactttcattttttataattcattgctaatgcatagaatatgattgatttctgtatgttgattttttttaatccagtgacctttctgaactcattttgttctaattgtgtgtgtatgtgtgtgtgtgtgtctatgaattccttaggctttactatatgcaggatcatgtcatctgcaaataagttagttttacttcttttccaatttagatgtcttttaactacttattctgcttgcctgatttccatgggtggaagctccaatactgtgttgaacagaagtagtaaaagtggaccttcttgaattgttcttgatctaatagagaaagcattcaatcttttacccttaagtatgatgttagctgtggattccctttatcagattaaggaagttcctttctattcctagtttgttgaatgttttctatcatgaaaaggtgttgaattttctcaaatgccttttctgcttctatcaaggtgatcatgtggtttttatcctttattctattaatgtagtgtattaatacatttttggatgttaaattgattttacattcctgtgataaatccctcttggtcatggtgtaaaatcctctctatatgttgctgcattcagtttattagtattttgttcagggttttgcattaatatttttaagggatattggtttgcaatttcttacgatatctggttttggtaaaaggcaaaatattttttctttctgaagagaaaccagagcactggttttagtatcaaactaatattggcctcacagaattagttgggaagtgattcttactcttctgttttttggaacagtttatgaagaattagtattacttttttttttaacatctggtagcattcatgaataaagcctctgggcctgggcttttttttttttttttaatgtgggaagttttcaatcacttcatgtgttataggtttattaagtttttcttctcaaatccgtttcagaagtttgtgtctttctaataatttgttcatctagattttctaattcgttgccatacagttgttcatagtattcttttataagtccttttatttctgcagtgttggtagtcatgtccttcatataagtttttttttttttttttttttttttgagacagggtctcactttgtcacccaggatggagtgcagtggtgcaatctcggctctctgtagccttgacctcctgagctcaagtgatcctcccacctcagcccactagtagctgggactacaggtgcacaccaccacactcagctaatttttttgtatttttttgtagggacaggttttgctatgttgcccaggctgttctcgaactcctgagctcaagcaatccaccagcctcagcttcccagagtgctaggattacaggcatgagccaccgtgcctggcccttataatttttaagaataaaagctcattgtcaccattaaagttgctatgaggctgggtgtggtggctcacgcctgtaatcccagcactttgggaggccgaagtggatggaccacctgaggtcaggagttcgagaccagcctgtccaacatggtgaaaccccatttctactgaaaacacaaaaattagctgggcatggtggcaggcgtctgtaatctcagctacttgggaggctgaggcaggagaatcgtttgaacctgggacgcagaggttgcagtgagacgagatcctgccattgcactccagcctgggtgacaagagcgaaattaaaaaaaaaaaaaaaaagatgctatgaaaaaaaaattgtagggctggactcagtggcttatgcctgtaatcctagcactttgggaggccgaggtgggtagattgcttgagcccaggagtttgagaccagtctgggcaatgtggtaaaacgctgtctctactaaaaaaaaaaaaaaaaaaaaaaaaaaaaattagccgagtgtggtgcacatgcctgtagtcccagcttctagggaggccgaggtgggagaatcacctgagctcgggaagtcgaggctgcagggagtcatgactgggccactgcactatagcctgggcaatgggagtgagaccttgtctcaaataaataaataaatagaaattttaaaaatagatacaaatttttttaagagacagggtcttgtcctgttgcctaggctggagtgcagtggcacaatcacagctcactgcagccttgaactcctgggctcaagtggtcttcttgcctcagcctttgaagtagcttggattatagacatgagcccctgtgcatggccacattttaaaaaacaattcagtaaaatgggcctgacataagtgaaaaaggcaagatataaaagtctagttacagtttttattatgagttgtaagaattctttacatattctaaatactagacctttatcagctacgtgacttgcaaatattttttctcattgtgtgggttgtcttttcacttacttgatagagtcctttgattccacttctgtttttaaggttaattatttattgatttaaatagcctttataccttgattaaaagtgtcacctcatgaaattctgttgcctctttggtatgaaataatgacttgtgaattctaatataccttcgaatatgcacctgtgttttcctttgcccctttctttaagtaaagaagaaactgtacctcagatatttttcccataaataaatagaaaagaaataaataagttgatgaattgactgttttccccctgcaacagaatgttttgtaaatactttataatatattccaaaaataaaagggattgttttgtcagttatgttccatcacattcagtaccagttgtctttctgatgtgctgatattttacattttcctgaagaaataagaaggccattctgttttgggggggaaaaaaagtaaagtccaagcaacttatgcttctctcctttctgggtttgagaatgtggtagtgatgagttgcttatggccaagatgcacatagagactatgataacagaagtggaaattgaagctacatttcatttttagggaaaatttgttttaataacattttcttaagacaacttttcttggtggaggaagaaaatagtcatgaagaaaggaagaattagatatgtgaagaaaaaataattttaaaaaattaacctcctttgggtcatacaatagttgatgattttccattgactttatctttcatcgctgatgatacattcacctctatccatgctccttacctttttttttttgaagcttatagtagctgttgaacaagaagaaattcccagacttcaggccctatatgagaaaggcctccagaatggtgtcccgggcctgaggctgatccagcaggaggatataaaaaagaaggagccatattgtagggtaagtgattaacaaagggatgtttttatttagggcttagtcctgagacatggaggctgagggtgagtgtataggaggcaggaataatataaaatcagttagataatcctgtcacagaagtagtgaagtgacagacacaagagggcattgtcacaaactctggacacctgatttctttctctgtgagaaaataccaggtctgaccaacatgaagacaagaggaggcctgagaccacatggcatgtttggaaaacactgagcagtgaggtgtggttgggagcattgggtatgtagggaaatataagagatgagactgaaaaggcagggttaggcccacataaagggtttggcattcatgttaataacattgaagtttatccagtaggcacggggagccattgaacatttttggaggagggcagctgtagtgtctgatctatacgataggcggataaggctggcatgagtttgatcctcctgcctcgacctcccaaagtgctgggattgcagcatttcactttcttaatattgtcttcagattaacagaaattcttaatgttatcaatttatgcatatgtttgtttttttatggttagtgttttttgtgctctagttaaattttctggatgcattcaaagacttggtaagaaaaataaaataaaatagaaaaaaaaagaaatctttgcctagcccagggtctagaagatattctatgtgtttttctaaaagttttattgttttacatttcacatttagatctacagtccatttggaattgatttttatatatggtataagttaggggtcaaggtgtattttttccccaaacagatatccagttgtgtcagcatcacttatcaaaaaaccattattttcccactgtgctgcagtattgcctttatgatatcaggtatgtggcgggtctatgtctggactccattctgttccattgcctcttctgtgctactaccataatgtttaattataatagccatttttttttaaatgggttcttactctgtcacccaggctagagtgcagtgacgtgatcacagctccccatgaccagctaattttaaaatgtttgaagagacagagtctcaccatattgcctaggctggtctcgaactcctgggctcaagtgatccacctgttttggcctcccaaagtgcaaggaatacaagcatgagctatagtagcttggactatagtagttttgtttttttttttgagatgcagtctctctttgtcacccaggctgaagtgcagtgccaccatctcggcttactgcaacctccatctcctgggttcaagcaattctcctgcctcggcctctctagtagctgggattacaggcacccgccaccacacctggctaacttttgtatttttatttatttatttattttgagatggagtttcactcttgttgccaggatggagtgcaatggcgcaatctcagctcaccgcaacctctgcctcccgggttcaagtgattctcctgcctcagcctcccgagtagctgggattacagacatgcgccaccatgctcggctaattttgtatttttcgtatagacagggtttctccacgttggtcaggctggtcttgaactcccgacctcaggtgatcctccagcctcggcctcccaaagttctgggattacaggcgtgagcgcctggccctatagtagctttttaataggcctgaatatctggtagagtaaggccttccgtttttttcttcaacattatcttggctactcttggatctttacatttctacataaattttggagttaatttgctaaactccacaagataacctgttatgattttgactgagattgcaatgaatctgtatgtctgtgtggagacaatttacatctttgtagtgtggagtcttccaatccttgaacttcatatatccctccctttgtctggatctgttttaatttattacataatgtattttaattttcagtatggaagtcttgcatggcatgtctcttatatttattatctacaaagaatttgtatttgatgttttctgatactctcattaatagtattgttatttaaaattcactttttatttgtttgttgcaggtatgtggaaatataattgatttctgaccttgtatccaactttctagttaaattcgtgtattggttctaaataatttgtctagaaattcttttggactttttatacccagacattttatctgcaaataataactatttatttcttcttttctaattcatatacttggttgatccaatgtttaatcctagtttgtatagttttatatgtgttttttgtttatttttacaagctgcttcatcctttctgcaaaaagacaagatagaaatgtattttttcaagtccaggaaaaataaaagcttgaaggaaaaaaaatgtattttttccctttatctctagttgtaaagttaaagttgggtcaaaatatgcaagattttctgaattcatgtaaagctcctaagacgctgctggtatccaggagtctaaatagtgttgaatgagttcttcctgcagaggttatagcatcttcgtctccagcaagccacctattcctttcctggcacccagtcaggataatcaaactattttgcttgtgggatacactaggtcttgttacttcccatttctctcctcaaatatttcttatctctctgagatagtgaattagtgactgatttttttaagtagaatattttcattgaccatcttattttggccacctgcttatttcatactctgagcaaattctaaatggtcaaagtcttggcaaattctgtcctgtgggccaaattcatcctgccacctgtttttgtatggcctgaaaactaaaaatgttttttgtttgtttttttttttttttttttttttttttgagacggagtctcagtctgtcccccaagctggagtgcagtggcacaatttcggctcactgcaacctccgtctccctgggttcagcgattctcctgcctcaggctcccaagtggctgggattacaggcacatgtcaccatgcctggctaatttttgtatttttagtagaaacagggtttcaccatattggccaggctggtctcaaactcctgaccttgtgatccgcccacctcggcctcccaaagtgctgggattataggcgtgagccaccgtgcccggccatgctaaaaatgttttttacattttaagtgtgttaaaaaaattaaaagaagaacattattttgtgatgaattaaaattatatgaaattcagccaggcgtggtggcgtgtgcctgtagtcccagccacttgggaggctgaggcaggagaattgcttgaacccgggaggcggaggttgcagtgagtggagattgtgccactgcactcaagcctgggcaacagagagagactccatctcaaaaaaaaatatatgaaattcaaatttcagtgtccgtaaagttttattgaaatacaaccgcaaatattcagttatgtattgtctgtagctgttttaacgccaaacagcctcattgagtagttgcaacagagatcataagcctagatagtcaaaaatatttgccatctgtctcttataaaaaaggttgcctacccttgatctaaatagcagatagctaccgaaggacttgagcagaatgctgacaggcaaaaggtactaatttaggaaatttaatcaaatttgaatatgtaagatggaactggacgtggggagaggagaaccaaagccacttattgttatttttgaattatctgattccaataattctcagtcttaagggagttttttttgtttgtttgtttttgtttttttttatgagacggagtctcactctgtcacccaggctggagtgcagtggcgtgatctcgactcactgcaagctccaactcttgggttcacgccattctcctgcctcagcctccagagtaactgggactacaggcgcccaccaccacacctggctaattttttttgtatttttagtagagacagggtttcaccttgttagccaggatggtcttgatctcctgacctcgtgatccgcccgcctcagcctcccaaagtgctaggattacaggcgtgagccactgcgcctggccgacttaagggagttttgacatattatcctttactttatcttgctgtatccttcaactttttgaaattaacttgcatctagcataaggtgagcagtataatgtagctgttgataagtcagacagacataagctccattctcacatctgcctctttaatggctattaacattgagtgggttataatctttctaatcctcagactcatttgtaaaatggagattgttttgagaattaaatgaaatactatgtataaggcattcggctaaacgttaatcccttaagaaatggtatatattattatatgcttttttgaacaatcctagtaaattcaaattggttttgtttgaaatatttggggacttttcatttctgctttctttagcttttttctgcctataaagccagcctcctctggtcagctcattagagtgctctttctaaatctatgaatgaggtgctccctgaatcatgaatttctaataaagctaattagatctttaaactaaatttgttataattttgtcttttaacacactcaatggttttgtaacgcactgtgtagataagaaacaggataatagattaccctgttaagataattaagaatatttagttatgtgtattcttccccctgtttgtatttccccttttcctgatgtgttacatttaatttattattttattctgtttattttctttaaggcatatcagtcttttttagagtgagatagcctattttaaaacaatagagatcctagcatattataaaactagggttgtgaataactgatataagggctggttgtttagactgatgttatgcttcaaggaaaaaaaatgctagtattaaaattaagaaattaggaggctgttatatatgtgggagcagagaatatatgggaaatctctgaactttttgctcaatttttctatgaatttaaaactgctcttaaaaaggagtctacttaaaaaatttagattaaacccactttctgtttcttatctatacagtgcattacaaaactattgagtgtgttaaaagacaaaattacaacagatttaaagaccaaattagctcttttagtgattcatgaattaaggagcatctcattcaaagatttagaaaaggcactctgatgagctgaccagaggaggttggctttatagacagaaaagggttgaagaaagcagaaacagagaacaaaaagcagattggttgtttcaaagttactttcctataaggttaaaacagaggccaggcacagtggctcacgcctgtaatcccagcactttgggaggccgaggtaggcggatcatctgaggtcaggagttcgagatcggcctgaccaatatggtgaaaccccatctctactaaaaatacaagaattagccgggcatggtggcgcatgcctgtaatcccagctactcaggaagctgaggcaggagaatcgcttgaaccagggaggcagaggttttggtgagctgagatcgcgccattggactccaaaaaaaccagagaagacttccttatcaagctggctaaaaccagcctgtttgtgaacttggctgttagttatctcttgtgatttcttagaaggtcatataaacaatttggtttccatctggtgaggaggattttagcatgagagactccattttggtttggtctgtagaggtctaatacagaagctcaatgcaaaacaacagcttcctatacacgttattaaacatgtccttcccgaaaatagactaaatctattgctgtttcatagctttatatgattttgatggaattcaattgtgaaactaatatatcagaatctcacatattttcaaaaacccagaaaaaaggattttgaatttttacaacacaaagaaattataaatgtttgaggtgattgatatactaattaccctgatttgatcattacacattgtagacacatactgaaatatcactgtgttccataaatatatacaactattggctgggcatggtggctcatgcctataatcccagtactttgggaggctgaggtgggtggatcatttgaggtcaggaattcgagatcagcctggcaaacacggttaaaccccgtctctactaaaaatacaaaaaatagccaggcgtgtttttgggtgcctgtagtcccagctacttgggaggctgaggcaggagaatcgcttgaacctgggaggcagaggttgcagtgagccaagatcgcaccactgcactccagcatgggcaacagagtgagactctgtctcaaaaaaaaaaaaaaaaaaaaaaaaggaaaaaaataaaaatataattatgtgtcaactaaaaataaaagtttcaaaaatttaaaaaaaaactttcattgatgtgctcctatcaagtattaccttgaagaatgaaagaattgataacctccttcaaaaggacatgccaatttttaaaaccttttaatttttatttgctcatgaaaagtctttcaaatgtaagatgcatatcaaaaaaaaaaagtacatctgagctgctggccccattatagatttggtcatgaaaataatttaattgtagagtttgaaaaacaggattactggtatcctaatggtactgaaatttggagaattggtctatctgattgttgcctgttgtgtatccttgttaaggctttaaagagaaaaaatcggaacaggaacccatgattttttatattatgcattactgaaaaaaacaaaacttttcagatgttgtaaaagttatggatgagtctggatattgttctctgtacctgatgaggtgaccatcacaggtccttggaatgaggtcagtgagatatgtgtgcataggtaatgaaattatatgtattacacatatttttgtgtcttataaatgaagaaactttactttcccagggtcacacagctcccaaagagttgcccacctcaagatctgactcagaactggtattttttctgtttggttcaaccaaaggttttttgattactatgtgccacacactatgttaggcactgtagatagataagaagatgaataaggcatggctgtcaacctgaaggaggttatagtgtaaaagaagatatagtgataagtattctgatagagctggtactctctcttataccaatgttaagggaatgcttttagcttagtacaattgtttaagaaagcctcagagacaaacccccacttgaaagatgaatgagtaaaataacttacaaaagaggcatattctgcttctctctgaggcctccacagaagtgatatatactttatatgattccaagttgtaatcattagtgtttcatatatttagggatggcaatatatagtagaacatgtagtttggttattttctaaagatgttttgaataaagtccttccttccctgccaaccttaccactgctataggaatattgggtaaaatgcccattgtacggggtcacttgttttttttccaggccacccagaaagaagtttaccaaggcagctctaaagagcttcttagaccaagtccctttaagaaaaccaagtatcatcggggagaggcccttggaaaattttaaactgcctctgtaaactttgacttgggaggataactctttttatttttttttaaagtacttcttgcagagcagggctaccccataagcggtatgcccagagtagccgaaggtaactcttgactgctccctctctgggcaaatcctcactgctactctgccctctggtctgcttttgccattttgttagcactattggtcaatcacatgttcatctgttcctctgtatcctgacttgagatctactctcaattttccctgtcctgcttgtctggttcttgcctggttctgatctgccaaggcctcagatttcagtctctgacctgctgacctggacagttcatgcccaacctcctgggtgacagacacagccagcctgtctaccaacaccaccccaacttggcagcctctacctttgcagctagtcccaggccagagcattggattgcatggtgatgatgactcttttcacctttctacaacacacatgtataggtggggcacaccagcatcttaggaggagaggaaaggccaagactagaaagagaaagaaaagaagagacaccttctagggaaggtctggaatggagtaaaggggatcctctatgtttaaacacagccctcaaattcaatccttcagtaaatgtttgagtgtcttcagtgtgtcagacgttgtgctgggtaataggagcataagatgaataaggaagctatttggaattgcaaaaaactattgattgagaattaagcacttttacagaatgtttttatccctctgttatacttgtcacataattttatggtaggtaaggaagttttcatggactaatctcttggtattatcctaagtgagcttctaagattattgtacccaaaatattgtttatagattgaagttgagttactggcatgtgaatttagtcaatgactaggtcttatgtttactgactgtatcaaaacagaaggaatgatttcctatgcttggcaaatactcttatattctagaaatgagactgtcaggaaaatgatgaagtttgccaaacattgctttcaatttgttaaaaaagagactgttgatgttttgggagtctttaccctcagtgtgacctggtcattagaaaacattggtcccagtgggatagcaaagagaaaatctttttttaaagacgaagtctcactctgttgcccaggctggagcgcagtggcatcatctcggctcactgcaacctccgcctctggggttcaagcaattctcctgcctcagccttctgagtagctgggtctacaggtgcccgccaccacgttcggctaatttttgtatttttagtagagatgaggtttcaccataattggccaggctggtctcgaactcctgaccttgtgatccgcctgcctcagcctcccaaagtgctgggattataggcgtgagccactgcgcccggccgcaaaatgaaaatcttctaagggccaagcaggggaatatgttggggtgatggtcaggtggtgaatacaagagtgagatctttacaatagtattatatcagatattattttaaaaccaccacaacaataatgctgtgctggccaaatgagaggatggcagaatttattaatagcactcaccgtctggatgttatcctggataccaggctaccctcttggggaaattgattgggagaactgatatatacaaaaaaaggcaacagaaaatggtgctattaacaatgatcaccaaaatgtagtcagtacttagtgtgtgaaattctcctcttatccttttctttagaattagaaacggccaatgacacgttcaacatttattctaaaaaaataaaataagcatgtgttatataggtcattcatctacagattgatgaacattgatttggacatgtctttagggacaaaaacagaaacaaacaaaaaaatccaggctattaatttcttgtattacctgaagaaaaagtttgagttaaccacataaaatctccattccatatttgtagtctcaaagatagggtctgggcagcaagtcaaagcaatgctctggaaacattgtgagtagctagaacaactcttgagttcttactaagtatggacaacatagtatatactactgggaaaaatctcactagagcttatttaaaacataattgtttgatgatacgtaattcaactcagaatcagatatgaatcaaatcagaatcaggtatggtgagggataataaatggaaaagaaaaactcattgtagcagcaagaaaagcttggcaaaatcaactcctctaaaggacaaaattgtttcttgattatagagattttgttatttagcaagtattatttctcttatctgttatcttttcataattctgtttcagggtctaatggctattgattgtccacatactggcattgtggactatcggcaggtggctttgtcatttgcccaggatttccaagaagcaggtggctctgtcttgaccaattttgaagtaaaaggtattgaaatggctaaagaaagtccttcaagaagtatagatggtaagccatccttgtcttttctattgaatatagtcagccctccatatccatgggttttgcatctgtggttttaaccaactgaggatgaaaaatatttgggaaaaaaaacaataaaaaataatagtagaataatacataatacaaataaaaaagatagtataacaaaaaaatagcatttacattgcattcggtgttataagtaatctagaaattatctaaaatatccagcgtatgtgcataggttatgtgcaaatgttatatgcattttatatgagggacttaagtatccttgaattttggtatttgtggggttcctggaaccaatcctccttggatactaaggaacagctgtacttatattgattttttttttaattgggatattttagggggtagtgctggtgggagggccacatggagctaggctagagtatggtgcagaaccagaggtaggtacagaaggtgcagactgaatgtgagagaactgggactcctggagggtcttgtgctggtagaaccaggcggtggtccgacacttctgactggtgctaaaatctgaactgccaaggctgtttatggaaaatttgtctccaaacacttccctaccctgtagattacagtcagaatctcttgacaatgcttgttaaaaatgcattttttttttccccttggggcagggtcttgctctgttgcctaggctggagtgcagtggcacaatcccggctcactgtaaccttcacctcccaggctcaagtgatcctcccacctgagccgcccaagtagctgaaactataggtgcttgccaccacacccagctaatttttgtatttttctttttttttttaattttaatttttatagagacaaggtctcactgtgttgcccaggctggtatcgaactcccgagctcaagtgattttccctccttggcctcccaaagtgctaggattacaggtgtgagccaccgtgcccgtcccaatttttgtattttttgtagagatggggttccaccatgttccttatgctgctctcgaactcctggactcaagtgatctgcccacttgacctcccaaagtgctagaattacgggcgtgagccactgtgcctggccaatagctaacatttattaagcacttggtcctttccaagtattaactcatttgacttttacaattctccgtggcagggtaccattattactcacatttttttagggtgagaaaacaggcacagagagagtaagaaacttggccatggttgtacaagtagtgagtggtggggtttggatttcaactcatagactgtacctaaagcccacatagttaattactgaactatactggacccacactatgttccccacaagctgaataacgagcaagaatttcagattaacaaagatgtcaggtggaaagcttcattggtttaatgaagacagaagagttccagaaattggtggttagaatgaaggaaaaagactggctatgaagcacaacaggaaggtggaagctaagaggctggactaggaaagtaggacaccaaggtaattgcagaggggaggtctaggaaagggtttcttaatcctgacactattgatattggggccagatcgttctttgtcgtagggggctatccggtgcactgtaggatgttttgtagtatccctggcttctgtccactagatgccggtaccatcacgcccccaagtgatgacaattaaaaatgtctctaggctaggtgcagtggctcacacctgtaatcccagcactttgggaggccgaggcgggcggatcatgaggtcaagagatagagaccatcctagccaacatggtgaaaccccatctctactaaaaatacaaaaacttagctgggcatggtggctcacgcctgtagtcccagctactcaggaggctgaggcaggagaatagcttgaacccgggaggtggaggttacggtgagctgagatcatgccactgcactccagcctgggtgacagagcgagactccgtcacacacacacacaaaaaaaataaaaagtatctctaaatgttggcaaatgttctcttagagttgggggtgaaggaatcactcctggttaagaaccattgctccagacttacaattagactagtttgaacaaccaggaatagagataaaccagtagactgaaaaaaggacaaagaaccatgaactgaagaattttgaaagttcctataaaaccagaattttataactatgaatgataatttatttttattttatttattttattttttttgagatggagtttcactcttgttgccccggctggggtgcagtggcataatcttggctcactgcaaactctgcctcctgggtttaggtgattctcctgcctcagcctcccaagtaactgggattacaaacatgtgccaccccatctggctaattttgtatttttagtagagacgtggtttcaccgtgttggccaggctggtcttaaacgcttaacctcaggtgatcttcctgcctcagcctcccaaagtgctgggattacaggagcgagctactgcacccagcttgaatgacaatttattatactgctggaaaggagagaaaaaaattttcatgacatgacatctcctttttggcttgtctatatatatcaacatgtaaattagtcttccagtgtgctagactttaccactcctaaggaacacataccattctggagaattttttttttcctttttctctcccttagaagtctggacagcaaatctaattgtgaagttaaaatttgcacaagtactttgagaggccaaggaaggaggatcacttgaggccaggagtttaagaccagcctgggcaacatagcgagaccctgcctctacaaaaaatttttaaacgttcactgggcatggtagcacacacctgtacttccagctacttaggaggctgaggcaggaggattgcttgagcacaggagtttgaggctgcagtgagctataattgcatcactgcactgcagccaggccgacacagtgagaccttgtctcaaaaaaattttttttttagggctgggcgcagtggctcgcgcctgtaatccgagcactttgggaggccaaggtgggtggagcgcttgagctcaggagttcaagaccagcctgggcaacatcgcgagaccccatctttactaaacataaaaatttttttttaattaaataaaataattttttcttaatttgcaaaatcctatgggactcagatgtacagcttaccggtataactattcaggttctgtatctctaaatggcaaacgtagtcagtaggaaaattggcaaacctggtgtctatgtgaagagtacaggactgaactgatcctttttattgatagctgtaaatatgtctatataaagcagtgacctgggaggcgcgttggctcacgcctgtaatcccacactttgggaagccaaggcaggcggatcacctgaggtcaggagttccagaccagcttggccaacatggtaaaacccatctccactaaaaatacaaaaattagccgggtgtggtgatacgtgcctgtaatcccagctactcaggaggctgaggcaggagaattgctggaatccggtgggcagaggctgtagtgagctgatattgcaccagcgcactgcactccagcctgggcaacagagtgagactctgtctcaaaaaaaaaaaaaagcagtgacccatgtggctcagtcttagagaggtgtcagggtcacgaaggagtaatttcaaaagaactcttttgcttgtatatttcttttttttttttttttcttttgagacggagtctcaccctattgcccaggctggagtgcaatggcacgatcttggctcactccaatctctgcctctcaggttcaagcaattcccctgcctcagcctcctgagtagctgggattacaggcatgcaccaccatgcccagctaattttgtatttttggtagagatgggatttcatcatgttggtcaggctggtctcaaactcctgacctcaggtgatccacccacttcggcctcccaaagttctggggttacaggcgtaagccaccatgctcagcctgcttgtatgtttcaagaaccatgaaagggatcgaagcaatctttttaaatatgctttttcctctttactttcttccttctttttttttttttaaataataaaaagagttgaggtctcactatgttgtccatgcttgtcttgaacccctaagctcaaacaacctgcccaccttggcctcccaaaatgctgggattacaggcatgagccactgtgcttggcccaaaatgcaaatgttagcatcacccatacttactgaatcagactgtctggaaatagcacctagtaataagcctttagtgattcttagacacatccaagttttagaatgtcagaatgacagcctaaggtcataaaatgacctggccatttggaactccccccacctcatgcccagcccccacagtttaagagttcacttagagtttgttttgttttgctttgagggcattaattttttttgtccaaatgatagatttgtgagccttctatttgctgttgagaaatttgaaggagaaaaaaagtagtgttctgttctttcttccttgacaggtttttaaggagatctaagccatctgaatcattctgtctttctgaattctaagatgatgagcaaaattgttaaataattaaggttgttttaggtaggtagcataataaaccaaatttgtgatacaagtagattgtatttatctgctctacatacgctttataaaactttgagatcccatgtatctgagtgggaactaattttaaaaatggtcaattttttattagaagtttttgtgttgtgagaactcttgcttttctaaacaacatagaacctgcaaggaatccagtaaccaacacttggatgacaaggtttctcatatcatagctttagtctgtgggaaaatacatactgatttatgattatccattttacattgcggtttccaggattatagttcagagaatagctatgtctatattggaggtcaggtggcatatggtttataagcatagattaggtgaattaaaatcaagctaaaaacatgctggagttttatatgttgttaagtatgaactagtttaattgttatttggtaaaaagtttcagaatgaactgtaaggtgcaatcatagtaatgacagaaaaaggttatttaagtttgtttctagtatgatatttcaaataatgttggccttttgctaaaaataaatttttcacttattcttttttttcaggaatgcaatatccaattgttataaagaatacaaaggtaaagattcttaagcaaaactgctggctactttctttccctcccctttattaaaaattaaattaacccacagggctgtattttaagttattgaatgacatttgtctaatgtaattctgagagaatttcttttagggaagtttaacagcttttattctaaggagggtttcaacttgggaatgtcctaattaagtggctctgctggcaaagaacaggattataagcatatggagtgtttaattttaaggcaaaactaatattttatcactctatctactgatctccactaacttattaactctctataaatcagaagacttcggaagagggagtatgcaggttgtccagagggagatggactgcttttattcatcttcacatggacctaaagcaagaaccactgaatggcatagaagcagtggattccctgtaggttcgctgcatcaagttgtactcaagggagcagagtcattaatgagtgctataggatttattataggaataagaccttacacaattgtggaagtttctgggaaagcatagattcagaagagagttgatggatcagtaattgggaaacagagctgaatgcggagctggaattcactggacagtgggtatctgtctgtcacctcattggactaggatgaccttcagagaataatacctgctgatttacttctgccaccagattattattattattattattattattattattattattattattattattattttgagacggagtctcactgtgtcgcccaggctggagtccattggtgcagtcttggctcactgcaagctccgcctctcgggtgcacaccattctcctgcctcagcctcccgagtagctgggacaggcgcccgccaccacacctggctaatttttttgtatttttagtagagacggggtttcaccatgttaaccaggatggtctcgatctcctgacctcatgatccacccgcctcggcctcccaaagtgctgggattacaggtgtgagctaccacgcctggccctctgccaccagattatatgcatctcctgttttgaccaagtttaagttggaaccatgaagagaaggggattctgtcaagcatagttcctagcttaaccaaatggactcagtacaaacccctacagtccaccctttgtcaacctgacatctgtccacgccccttataaccttataacgatatttagcttccaaataaagacagaagtaaaagtatgcttccacctaacaaggtgtaactgtccttcataggactgaagacatgctaactaactctcaaaaaaaaaaacaaaaaaaaaacagtctactttatccatcctggattatgtttaatttctactagctgagttacactccccctttgagatcctgtcacttaaataccaagatataaggttaaccactatttaagcattttatattagattagtagttctcaactagaggcaattttactcctcggggaacatttggcaatgtttagagacatttttgattgtcacaactgggatgggggagggacacagctactgggatttggtgggtagataccaggaatgttgctaaacatccttcagtgtggggaataggcctccaaaacaaagaaatgtctagcccccaaagtcagtagtactgaggttgagaaaccctgtgttagataatgtgggaatggtagagatgagtgtattagtcttctcagacttccataacaaaatagcacaaactgggtggcctaaaaagcccacagttctggaggctaaaagtccaagattaaggtgctggtagggttgacttttggcttgttaatggctgccttcttactatgtcctcacatgacctcttgtctgtgtgtgccggaaaagagagcgcatgatcttgggtgtctcttccttttataaggacaccagtcctattggattagcccctacccttatgacctcatttaaccttagttacctccctaaaggccctgtttccatatacagttcacattaagggttgggacttcaacatatgaattggggtggggggggcacaattcaatctatagcaatgggaataaaaaaagaattaggtaatgtatggagaaatgtattattttaaagtaaagaagatatactcagatgataacatccctcatttctgtgactagtcatgtggccatagccaatatttataatttccttcccctactatgcatttcatattctctttgcctttggcaagcatctcagctggtcatggtttctagtttggtggtgtagctcaaactttcattcctgaagtctgtgccgttagcagccctggctgttttgggtcgaggtagtttccagtaacttttataacagtacatgggaatactaagagaagcttcaggagatgtgtattccaggcatattcctctttatcatccccaagcctagttgtggtagcaactcattttcttgagagtcaggattagttatccaattcagtatagcagtcccctctttgatttactggcaggggaacccaaagtggccaggtgttgcagtatcaacctccagtttaatggaaccactgtcattctctaatggaagtacttctcccttgggaactaagacctctagatcataatagcgaagttgtggggatagaatgcaaaaatttcatgtagtagatgattgaggtaatagtaaggaaccactctcatttctacctcaatttccagacttgtgaattctggctgtgggagaaacaataccatatattagtcactgatttagagcacatggagcatcctggaggacattgccccagccctgcaaggagttgccagccagctagtgctattacttctaaagcccattccagtttctgtcacccagtggcttcagggtgatggggaaaatggtaaaatcagtgaattccatgagcctgagcctatagctgcatttcatttgctgcagaataagttcactgatcagaagtaatgcttctctgtaaaataccatgatggtgaataagacatctcataagttcacacatggtggctttggcagaagcattataggcagggaagacaaatttatattcagagcaagtgcctatgccagtgagaagtaagtgctaccttttctatgatggaagtggtccagggaccacatcagtggctctgttgctatctactattggcagattgagcactcagcattagctgtagacagatcagccttggtgagtaagtccatgtcgctgatcacctccatccttgctaccataactatgttttccagttctatgtttacattgtgaaatgattatcacaatcaagttatttgatatcatatctgccacctcacatagttaccatttatgtgtatgtgatgagaacacttagatttgttatcttagcaaatttcaagtataccatacagtattattacctgtagtcaccatgctgtatattagatttctagaacttattcatcctataattgaaagtttgtaccctttgactgctatcatcccattcctgcccacccccctcccagtctgtagcaaccatcattgtactctctttttctatgagttcaacttttttagatctcacatgtaagtgagatcatacagtatttgtctttcactgtctggcttatttcacttagcacagtatcttccatgcccacccatgttgtcacaaatggcagaattttgtcctttttatggctgaataatattgcattgtgtatatatatcacattttctttatccattcatctgtcaatggacacttaacgttgttctcatgtcttggctgttgtgaataatgctgcaatgaacatgaaaatgcagatatctccttgaggtactgattttgttttctttgggtatatacccagaggaaatcatatggtagttctatttttaatttggatcatatggtagttctatttttaattttttgagaaacgtccttactgtttcctgtgatggctgtccaatttacattcccatcaatagggcattctacatcctcaccaatgcttgttttcttttgtctttttgataatagccatcctaatagatgtgagatgatatcttattgtggttttgattttcctgatgattagtgatttgaacacctttacatatatcagttggctatgtgtatatctttgaaaaaatacataaaaatacatattcaggtccttggcccccccactccccttttttttttttgagacagggtctctgtcacccaggctgaagtccagtggcatgatcatggctcactgcagcctcaaactcctgggctcaagctgtcctcttacctcagcctcccaggtagctggtattacaggcacgtgctgccatgcccggcttctttgcccatttttatttatttattttatcttattttatttatttattttttgagatggggtttcactcttgttgcccaggctggagtgcaatagcgcgatctcggctcacctcaacctctgcctcctgggttcaagcgattctcctggctcaccctcctgagtagctgggattacaggcatgtgccaccatgcccagctaattttgtatttttagtagagatggggtttctacatgttggtcgggctggttttgaactccgacctcaggtgatctacccgccttggctcccaaagtgcggggattacaggcgtgagcccctgtgcccggcctttctttgctcattttttaatcggctcatttgttcttttgctattgaattatatgagtttcttacattttttggatattaacctgttatcagatatatggtttgcaaatattttctccaattctgtaggttgtctctttattgtcatttcttttgctgtgcagaagctttttagtttgatatagtcccacttgtttatttttgcttttgttgcctgtgcttttggtgccttatatattaaaaaaaaaattgctgagaccaatgtcttccctgtgttttcttccaggagtcttagttttcaatctaaaatctttaatcttttaatctaaatatttaatccagttcaagttaatttttgtgaatggtgtaaaaaaggagtccaatttcattcttttgcatggggctatccagttttcccagcaccatttatggagactatctttacacctaatcatgtagttcatgatgccgtcaggtaaagacaggggtgcctggagaaagaggctaactaacatccacagggcaggtcatctttttctaatgattattaaaattgtccttggccaagatttctcttcagtgagcattcatatggagcttgaatatctttactctctgaaactgttttggagtggtccattcatatacctttctccagaggtcctttccctgtccatctagccaaaccattagttgttgcacatgaaacagtgtagatccatatctttggccatcagtccttctaaagtaagatgaacagctaggtgtgatgttcagaggtctgcccactgagaatattttctgcaccacagtccttcagggccactcatgagtggggctctggtgctgtggctgttcagttgtgtgtggtaccagaatattgtgcagaaccatttctaaacctggcctatattttttcttctttggtcaactggtcatagagaactccccatgggtctatagaggcaggttgataggaaggaggcaatttagcaggagtaggggccatgggaatttgaaccacttgcctcttcaacttacgtgtgccagcaggacctgtacaacccttatcttacaatttttcttaatgatggaatgctgctatatacacccaattttgtggcttgatgagtcagacaacaccacccagttaataatgggtagctcatatggtaaacttagtgacctgtggtcaagtgttcagtcaaagccagaagcactttctcaaaaggaggttagttatctgcagaggatgatataactttcctccaaaaaccctaaagttctgtgctgtgatttgcctacaggtgccttccaaaggctccataaagcatgactatctgctgtagacccttcgattaccatcagatttgccgggtcatgtgacccaggtggcaggctttccattcaaagaagaattgaaaatctgtttctgtgcctgccctcatctaagggacattttcactagagtatagcatcatatgatagaatatatacaggggcctatggcataccagtggatatatactttgtacccagagttgccattctttattttggcattttcagtaagtataattttgggttcacattcaaattggggggtccacttaccaggttgaaatagttttatgaaaagtttaaagaaattttttctttttgagacagtctcactctgttacccaggctgaagtgcagaggcacgatcttggctcactgtaacctctgcctcccagattcaagtgattgttgtgcctcagccacatgagtagctgggattacaggtgtgtctcaccacgcctggttaatttttgtatttttagtagagacagggtttcaccatgttgtccaggctagtcttgaactcctggcctcaagtgattcacccacttcagcctcccagagtgctgggattacaggtgtgagccactgcgcctggccagggatttttaaaataaatttttgcaggtaggatttgctaattaaaggtttatacattggatatggggaggggggaatctgcttcacttatgaaagagcaacagacatgcatggtttatttctttgtcttctttttatttatttatttttttaattggggactttatctctaataaaacatagggagacaaggtctccctgtgttgcccaggctggtcttgaactcctgggctcaagtgatcctcccactttggcctcccaaagtgttgggactacaggcgtgagccaccgtgccaagcctaaaagaaatttttgttgaactaatgtatcatttgatggttacctaaattttaatttggaggtaaaattaatatgttactgaatttaattattgtttcacatatagcataaaatgatttcagagacctgtgatagtttttgataatttctttcttgggaactgttgcttgagttttgaaagagaactattaggttattgcatgctggtaccattttataaattctattattatctttacatctatcataggacttatctgcattttttttgttccaagaacgaaagaactgccaatcttttgtgtaggagctgatgatttatatcacaaaaatacttctcatatttctagaatataactctagatgaacaggaaagatattaacctatttagaagaagttatttttggctgggtgcggtggctcacgcctatagtcccagctgttcgtttaggcaggagaattacttgaacccaggaggttgaggctgtagtgagccaggactgcgccatcgcactccagcctgggtaatggagcaagatcttgacagcccttttgacttcaaaggtcttaaaacagtcatggcttagtctagctaatttgaattcattatggagaagttgcatctaatttttgtaaaaactatgacatgtataactcctgaaaagaggcttaactttctagcaagggcaaaaataggatacatatagaggtgaaaatttagctcaatagagtaaggctaaacagtaaggcctggccgggcgcggtggctcacgcctgtaatcccagcactttgggaggccgaggcgggtggatcacgaggtcaggagatcgagaccatcctggctaacacggtgaaaccccgtctctactaaaaatacaaaaaattagccgggcgtggtggcgggcgcctgtagttccggctactcggaaggctgaggcaggagaatggcgtgaacccaagaggtggagcttgcagtgagccgagatcgctgccactgcactccagcctgggcaacagagtgaggctccgtctcaaaacaacaacaacaacaacaacaacaacaaaacagtaaggcctggaaagaaagaaaatgttgagacaggtgagaactctgaggcttcaaaaataggtcatctgggaagaagatctaagaataagaacagaattgctaggtgtttactctgtaagaagtaaagagatgggaattcaagtgtggtggtgaatgcgggataaatgaagtcatttaggaaatagggtgacaaattggctaaacttagtgagtaaagttaaaaataagcagatgataatcacaaaataaaatttataggaaatcataacagcctaacattagcagtctaaagctggtcactaaagcaaacgttgaacgtagtgtgtgctctcattaaatgtgcattgaatgaatgagatttctaaagtgtcctcagtttgcaaagtagatattgattaggaaggagaaattgcttggtgggtaggttacagttgcaactgggcaggattattgagtgtgaagcaaccgaagagtaacacggtaattgctcagatacaggagaagctggttgcaatacagagtttgcctttaaatgagagggttacaggcccttcgacttcagtgccagagatgttatggatataattatcaataggtaataactttaattttaaaatgattttatgtgcttatatttttaatgtaggaagttttgtctttcttgatattctgctgattgggtaaatcctcatatttgtgattggtatattgaatttttaattaatccaaattaaaagctgtggggtgggtgggggagcaaaaaaaattggtggaggctgtctaaatgacatttgcttcctcatgcagcaaatagttaagaagctccctgctaggtcctaataaacagatttgtatgtatttgtatgtatgtatttgtgtgcatgcatgtataccttactaagtatccttgctaggttgaccattattatctttacagtacaaaatttaaggtgacatcctcttacatgccactatcctaagtttctagctgccacctaaatgctaaagaacatattttgctgatacctgtattgaatatcctcttttagaaaaaattctatttctgtacctttttttcttttctatcacctgtttttcccctcttgacctattctactccactttatacaaataactgttcttttattttgcactagggagaggaaattcgatgtcagtatgttgtgacatgtgcaggactttactcagaccgtatttcagagttgagtggctgcactcctgatcctcgaattgtaccattccggggagattacctgcttttgaagccagaaaaatgttatcttgtaaaaggaaatatttatccggtaggtaatgatgcttcctacttctcatttttttcaagcaggtggtggtcataaaggagatgaaaacaactttcacttgggtcagaaataagagaaattttgaaggaccgtttttgtaagcatttcatcggtttctcttgtggttaaatccctaaatctttatccctgtatcatggttattaaattgtaattaattgcctgcaggtacatgtctccagaaagcatgagtgcactctgggaagtgctatcaagaaggaactgaattctaccttctctctggtggagggaaagggaaaactttcccttatggaagtccctgatacccaacccttttcctcagttcactatctgtaggtacagaaaagggatgtggccactctgtagtttcagggagtagaagacagaggtatttaaatgaggagttcattcttctgtctggaactaccctggaaatgaatgaatctcttaaaatatattaggtcgaaccagatgaaatagtcagtattcggctatttgatatttttgagcttgccgaaacatgaatttcatctgcttcaacctcatgtatttgtactttgcagaagcctgtgctatgaatgtgtatttttttctggcagctctgattttacttgccagtcatagacatcccttgtgaaagaccgagaatagcctgaagtaagacagttcatcttttttttttcctttacccagaaagatgcatagatggaacaatctattagtgtcagtagcatcagagtttcttttttttttttttttttttcctgagacagattctcactctgttgcccaggctggagtgcagtggcatgatcttggcttattgcaacctccatctcctgggtttaagtgattctcatgcctcagcctcccaagtagctgggatcacaggtgcacaccaccacgccaggctaatttttgtatttttagtagagatggggtttcaccatgttggccaggctggttttgaactccagatctcaaatgatcctcacgcctcagcctcccaaagtgttgagattacaggcgtgagccaccacacccagccagcatcagggtttcttgtgtgcatttctaagcagaagcatgttaatggaaaagtatatctgagtacagctcacaatacaaattaaatgcatgagaagaaagtgttttatgttaccaattgaatgtttgcatctctgataacatggaatgtgaaatgaggctgttatttactatgttaaatttataggtcccagatagccggtttcctttcctaggagttcacttcacaccaaggatggatggcagtatttggctagggcctaatgcagttcttgcctttaaacgagagggttacagaccctttgacttcagtgccacagatgttatggatataattatcaataggtaacattatttatttttaaaaatgattttatgtgcttatattttcaatgtgggaagttttgtctttcttgatactctacttattgggtaaatccccatatttgtgattggtatattgaatgttgtattaatccaaattaaaagctttggagtggatggggtagcaaacaaacaaacaaacaaacaaaaaaaaaaatgccttttggaataagtataacattttaactacttcaagaaaattctgttgagctggggttaaaaagaaaaggctggctgggcgcagtggctcatgcctgtaatcccagcactctgggaggccgaggcaggtggatcatgaggtcaggagatcaagaccatcctggctaacacgatgaagccccatctctactaaaaatacaaaaaattagctaggcgtggtggctggcacctgtagtcccagctacttgggaggctgaggcaggagaatggcatgaacccgggaggcagagcttgcagtgagctgagatcgctgccactgcactccagcctgggcgacagagcaagactccatctcaaaaaatgaataaataaataaataaataaataaataaataaataaataaataaaaataaaaagaagataaggccaagagttattcatatatctggcaatccaaatcttgtattgctaagtttccagttttatttggtgggggaggaaatagattctctcaaaatcagtagatggctattttaataaaatcattttgagccagtctccatcattttgtaagccactggagaaattactgatgaccaaagtaatttccttgtgtaggaaactaacaatacgattgtgttgacctaagatgcagattctttactattgtaagaaatactgaattaggtattttgtttggtccttttaccaatgtttctctctaaagggtttcacatgaaaatcactagattttcctgtttaaatcactagatttaaagctatacttgagtttcaccctctatggattctgaaacagaaagtttaggatggagcttcctggcacatgtagttgtaaaaatatatacatatgtgcatctaggctttgcagagtctcacttgaaaatcacaactaaagtttttttggttttttgttttgtaattttgagacaaggtctcactttgtcctcactgcagcctcaacctcctgggatcaatcagttctcccacttcagcctccaagtagctggaactacaggcagatgctaccatgcccagataatttttgtgttttctgtagagacagggtttcgccatgttacacagcctggtctcgaactcctgggctcaagcaatccacctgccttggcctcccaaagtgctgggattacaggcatgagccactacaccctgcctaaacaactaaagtattttacctctggctgactaaagaaatctagggtagatgtcccatttctttcataccctgccttttaggtgtgttgaaggcatctaatatttccattagaaagccttgatgttggcaggctttatagagttccagtttgaaaccagcactccttgggaatttgagtttagagggtgtttacctctgtatttttttttttttttgagtcaaagtttcactgttgcccaggctgaaatgcagtggcacaatcattggttactgcagcctcaaactcctgggcttaagcgagcctcccacttcagcctccctagtagctggaactacaggcacacaccaccatgcccagctctgtttacctcctgagctgatgaggttttcttctgatattggccaaaagttgattttcattgattcattgattgattggttgattgagagagggtctctctctgtcgcccaggctggagtgcagtggcacgatctcagctcactgcaacctctgcctcctgggttcaagcaattctcctgcctcagcctcttgattagctgggattacaggtgtgcaccaccacacctgtctaatttttgtatttttggtagagacagtgttttgccatgttggccaggctggtttcaaactcgtgacctcaagtattccgcccgccttgacctcccaaagtgttgggattacaggcgtgagccaccactcctggccttgattttcttttaatctgtagtttttctgactttgcctagatttttgtgatgacataaaaaaagaatctaataattataaaggtattttacgtaataaagaattcctttctctcataaagattttttttctctgttttcagtggcttgattaaactggcatcccagaatttttcctatggagttactgaaatgtataaagcatgttttcttggtgcaacagtgaagtatcttcaaaaattcatccctgaaattactatcagtgatatacttaggtaaggaaaagggataaggagtgtaaatacagtcctgacctatgtgaacttgagaggtgggtctgacttggtgattagtaagtaccatttcagagtcagtctgcatatgcactgaatttttgtttgctttctttcccaacatgttgttgaattccctttgcagtgcatttattgggcattgctacatcatggcccttagtgctggtccatttataattatctagactgccttacagctctaatctgaaatctctatgacagctttattgtgatgctaccttagcctttttgtctaactatcactcctgataaaaacaacttgcctgaatttttaaaaatctctctggccagttagtcttgtgattccaaagccttttggccttaattttgtataagattattgatcactatgttaactaattaggtaataagcacattaaaacattatattttgattgattcttaaaacttaaaaaaaaccttttaggtttggggtacatgtgaaggtttctacataggtaaacacatgtcatggggtttattgtacatattattttatcacccacatattaagcccagtacccaatagttatcttttctgcttctctccttcctccctccctccccacttaagtagactgcagtgtctgttgtttccttctttgtgttcatgtgttctcatcatttagctcccacttataagtgagaacatgtggtatttggttttctgttcttgtgttagtttgctaaggatgatagcctccagctccattaaaacctgttagaaacacactcctagacctggcatctcaccttgcttcttctctacttcttttgttctttcttggaccttactgcactcagggactctactttcaggatagaagtggaaagcagtgtggtaacaatcagagtccttgctacaggggtgtggggcaaagtaaggacaacttgcatcttttatttttatattttttctgaaatggagtttcgctcttcttgtccaggctggagtgcaatggcaccatctcagctcgctgcaacctctgcctcctgggttcaagcaattcccctgcctcagcctcctgagtagctgggattacaggcatgtgccaccacgcccggctaattttgtatttttagtagagacagggtttctcctgttagccaggcgggtctcaaactcccgacctcaggcgatccacacgcctcagcctcccaaagtgctgggattacaggcgtgagccactgcacccagccacatcttttattcttaaagataaaagactggcacggcggctcacacctgcaatcccagcacttgggaggctgaggcgggtggatcacctgaggtcaggagttcgagaccagcctgaccaaaatggagaaaccttgtctctattaaaaatacaaaattagccaggcatggtggcacatgcctgtaatcccagctatttgggaggcagaagcaggagaatggcttgaacctgggaggcagaggttgcagtgaggcaagatcacaccattgcactccagcctgggcaacaagagcaaaactccgtctcacaaaaaaaaaaaaaaaagataaaaggctttctagacttgatctgtagattattcttaataccacccaaacctatttttttcccctctttggtaatgtttttagtgttcaccttttttcctgagcaagccattcgttaggcctaatcagcagtgtactttgaggtactctcaccctccatttacaatccatccctccatgaattttcttagcactagatatctgctttctctgcaacagctgctgaactagcctggtaaaaaatgtcagcaggcttgactgtgtatctgtgtagagagcaataatcatgtcagctgtctctcttaggggagcgtcctcgtttaaatctgactgtaatgtatcattctgagaccagcatgtttgaatccttagaagattaaaactcagctaacgtttttcctcttatctctttcactcctctactcaccttctgaaatagaagggataaaaatatctagccattattttctttcactcacttataagtaagggcttttatgttttcagtgatctgctttagcaaacttgtgatgttttatatctgaaaatagactggtcaaatctggtttctattactgctattgatattccttggaaaacaaacgaggtgagcatagtgaattctgtataaaaatagttgcagtgaattcactgcctgtattcagttaccaccctttatagaagcctgaggaaaactttttagaccactggatttcatatggtagaactggacttcgggcttgtggttattagtgaactctcctgtctctgggtgtaagggtgtgaatttctgttaccaatttcattggcatgtagtagaaaagggcacagcactgcaggcaggtgcatttggggacaaattcaacccaatcacagatgagttcctctttaaagagagaaaagctaactaattcagcaattccatttgcttcgtctcttgattcctatagttattaagtgcaggaaattattaataacaaaaaggaagctgtagaagatatgtttttgggtttctcgggggaagatacgtttgataccatttgtataagttttaaaacaagtatagcaaaaccatatattgcttacggattatacatgtagtatgaaaataaaaatgagcaggggagtgataaacacctaattcaggagagtggttacctctggtgagggaagagaatgggatcttgagagttctacagaggcttctatcatatcggtaatgctttgtttcttaagctgttagataaaaaaatgggtattcattgtgttagtctctcttccttgtgatagcctgaaatattaaataataaaaataagatcaatagactttttttttttttttttgagacagagtctcggtctgttgctaggctggagtgcagtggtacaatgtcggcttactacaacctccgactccctggttcaggcgattctcctgcctcagcctcccgagtagctgggattacaggcacgtgccaccatgcccagctaatttttgtatttttaatagagacagggtttcatagagagccaggatggtctcaatctcctgacctcatgatcctcctgccttggcctcccaaagtgctgggattacaggggtgagccaatgcgcctggccaagatcaatagacttttccacagcttgaagcctaagtcctgccttgtctcctttgtcttgcaaccagtatactaaaccataaatgcccttagtattgcagtgaaagcacatcaggcattagtaaatagtaaaatatagttgaagcaacactttcagtggggtgtgtttcccaggatggtgtccttaaatttcattaaccactgaagggcacccaggttgacttctcattgcttagccagagcattttgggcaataatttactggtgaacatgagattggaatataaagttacaatctgttaaatatttgcattagataaacttctcattgttaaatgatggtctctaagactcttaatgttagctctaggccaggcacagtggctcatgcctgtaatcctagtgctttgggaggctgaggtgggaggatcgcttgagcccaggagtttgagaccagcctgggcaatatagtgagatgccatctctacaattttttttttttaattagctgggcaggtggtgcacgcctatagttgtagctactagagaggcttaagtggcaagatcccttgagcccaggatgctgaagctacagttagccattattgcactactgtcctccagcctggtggagagaacaagaccctgtctcaaatatatatatagctctaaactttaaaaatttgttctgtgattaattttgacatgttaatctaacagcagtttgtatctgttagcactgtaaagatgtaaaagacgaagacatatatgtcacaatttccccattttcaatttggaaaatgtcttctgtggggaattctagagtaaactttcaggcaagatgttttcatagcaagtgataactagagtgtgtgaaacacaaaggtgcaaaactcaaacatttctacaataaagttgtaatggcttatggtgatctagattagggtttctcagtcttgatgctattgacatattgagccaaataattatttattgtggaggagtgtccagttcattgtataattttttttttttttagacggagtctcacagtgttacctgggctgtagtgcagtggtgccatctcggctcactgcaacctctgcctcccgggttcaagcgattctcctgacttagccttctgagcagctgggattacaggcgcctgccaccacacccggctaattttttgtatttttagtagagatggggtttcaccatgttggcctggctggtctcaaagtcctgacctcaggtaatccacccgccttggcctcccaaagtgctaggattacaggtgtgagctaccgtgcccagccattgtagaatgtttaacagcatccccagcctctactcattctcctaattgtggcaaccaaaaatatgtcgacattgccagatgtcctgtagggggcaaaatctcctttggttgagaaccactagtgtagagaatttggtaaccttcacactacaaaatagtaataagagtctggaggaaatatgataaacatccttgaaatacatatagctgagagtaagggaaagtaaggggcatcccagagcaaaaaacagaaagaaaattaaaattcatactaaaaggagttggtgctgatgctgacttggagaggtggggatggtttgctaattttaataactgaggggcttgagttatatttgtaatttatgtgtgactcaacgtataaaatatgtagatcttaaatgcttagtaaatttcgataattgtacaaaccatatccaccagtcagaacaagatataggacattagggacttgtattttaattgccactcaagtgctgaaaaagaaatcttgggtctatacaaggtagaaagttggaactcagactctaatgtaaggccccctaggggctcttgaaaggctataccctcagaagaaaggaagtctggaaaaaaaatattccccttggcactgggaagtattaaggaactttgtctatcttggtcttggggatggggagtgggaggaatcttccccaaaatctagaatccctcaaagtgcttagattttgaacgtataccaccagcttggtttaggaactgtaagctaacaaattaactgaaaaagtagagccagacatttttggatcctgcttcaatcaatctctctctctctctctctctctctctgtcttcttctctctccttctttctccctccctcccctccccaccccctctaattcaagtaaattagagagactaaaaatcagataatttgaccacaaaatgactactgacactaagcaattattggtttataattatttttaagaattttttttttaagagtctcgctctgtctcccaggctggagtgcagtggcgcagtctcagctcactgcaacctctgcttcccgggttcaggtgactctcctgcctcagcctcctgagtagctgggattacaggcatgtgccaccatggctggctgatttttttttccctatttttagtagagatgggattttactatgttggccatgctggtctggactcctgacctcaagtgatctacccgccttggcctcccaaagtgctgagattacaggtgtgagccactgcacctggataatttttaagaatctttttaaaagaaatacacattgaggccgggcggggtggctcatgcctgtaatctcagcactttgagaggccgaggtgggtggattgcttgggcagccttggcaacatagtgagatcagcccaggtgacatagtgagaccccatttctgaaaaaaaaaaaaaaaaaaccgaaaaagaaaaaaaacagaaagaaaagaaaacaaatacacattgaagtgaagtggtatgccatctgggatttgctttaaaataattcagtgggggtgttgtggctcatgcatatagtcctagctacttgggaggctgaggtaggaggattgcctgagcccaggagttttaatccagcttagcaagacaacatgtctaaaaaataataaaatatggttgggctcagtggctcctgcctttaatcctagcactttgggtggctgaggcaggattgtttgacctgaggagttcaagaccattctgggcaatatgagaccttgtctctagtaaaaattaaaaaaaaaaaaaaaaaaaagagcctggcgtggtggtgcgcatatgcctgtagtcccaactactcaggaggctggggcaagagaattgcttgagcctagtggtcgaggcagcagtgagccatgataacaccactgcactccagtctggacaacagtgagaccctgtctcaaaaataaataaaattaaataaaaaattataaaatactaaaataaataggtcaggcaccatgggctcacgcctgcaatcctagcactttgggaggctgaatcaggaggattcttgaggctaggagttccaaaccagcctggacaatatagcaagaccccatctataccaaaaatttaaaaactagctgggtgtggtggcatgttcctgtagtcccacctactctggaagctgaggcaggaggattgcttgagcccaggagttaaaggctatagtgagctatgatcatgccagtgcactccagcctgggtgacagagcaagaccctgtctcaaaaaataagactgggcgtggtggctgacacctataatcccagcactttgggagactgagatgggagaattgcttgggcccaagagtttgaggccagcctgggcaatatagtgagaccttgtctctaaaaaaatatttttaaaaaacaattagctgggtgtagtggtgtccacctgtggtcccagctattcaggaggctgagaagggaggattgcttgaatctgggaggtcagggctgcagtaagttgtgattgtgccactgcactccagcctgggtgacagagtgaggcctgtctctaaaaaaaataaaataacccagtggagagacattggtgttggattggtacatagatgaaacaagattggctgtgtgtgtataattgttgcaactggataatacatacatgggagttcattatactgttggttttctttctttttcttttttttttttttttaactttttgacgtgtttaaaattttccatttaaaaaaaagtgctctcaggatagtaatagaagcaaatgtaaaaccactgcagagggacacaccctgaatccaacccctcccagatgattcccacagataaagtcgtactgaacagaaactcacaatcagaagttacaaaccaccataagtgagagtcagcagataaaataagtggcagaattagacttccaacaactatgggtaatagtaataatagaaactgtaaagtaaatatgcttcaattaatcaaaaacaaggtaatgaaaacatgaaaaaaaaaaaccaaagaaaaaagaactaggcaaattagttggaaaccacctaatgagaatttctggaaataaaaatatagtttttaaattttaaaactcaggctaggcttggtggcccacttctgtaatcccagaactttgggaggccaacgtgggaggattgtttgggtccaggagttcaagaccagcctaggcaacatagtaagatcctgtctctacaaaaagttttaaaaattaaccaggtatggtggtacacacctgtagtcccagctactctggaggccgaggagggaggatggcttgagcctaagaggtcaaggctgcagtgagctgtgattacaccactgccctccagcctgggcaacagagcaagaccctgtctcaaaaaaaaaaaaaattaaaggaaaaacctcagatgactaggttagacagctggttagacctaccttaagaggaaattatcaaattggaaggtaactcagaagaatttagaaagcaatactgcaagataaagatgtatccatagaaattaaaagacatggggttgggcacagtggctcatgcctgtaatcccagcactttgccaggccatggagggtggattacctgaggttaggagtttaagatcagcctagccaacatggcaaaaccccgtctttactaaaaatacaaaaactagctgtggtgggcacctgtaatcccagctacttgggaggctgaggcaggagaatcacttgaacctgcgaggcagaggttgcagtgagctgagatgacaccattgtaccccagcctgagtgacagagtgagactccgtctcaaaaataaaataaaataagacatggaaaagaaaactgagaagattccagcctatctctcataggtgttacagagaaattgagaagaggcaatcctttgaggagagaatacttaaaaattttctagaattgacagacctcaaattcaagatgtacagtgcatcccatctgagtaaataaaactaaatacaagatggaaatagatttccaatttagtagagaaggaaaaaaagaatatagaaaactcaataagtgaagaaagaggagatagaaaccttagaaaatcaggttagatagcataaaataatatggtagaaatcaagcatatcagtaattacagtaaatgtaaatgtatttaatagttaagacagattatcaggttggatttaaaaaaatctatgtgctagaaaaatgcttttaattttttttttttttttgtaagacaggctctcgccctgtcacccaggctagaatggagtgcagtgatgtgatcatagctcactgcagccttgaactcctgggttcaagccatcctcctgcctcaacctcccaaatagctaggacaacaggtgtgtgccaccacacctgcctagttattattattttagagacagagtctccctatattgtccaagctggtttggaactcctgggctcaagtgattctcctgcctcatcctccaaaagcattgggattataggcatgagccactatgcctggtatggacttatatatttagattagcagtggagttttataaaatactagattgtctcattgtatttggaactggctgaagatgcctgttacagcttttcgtagctgtttttccaacctgtagtgtaatgcttgacatatgacaataatgtaatacaagacttctcatgaatgtatgtatttagttacacattcagctgttcttgtttctggacatatttttttttctttttttgagacggagtctcactctgtcacccagcctggagtgcagtggtgcgatctgggttcaagtgattctcctgcctcagcctcccaagtagctgggattacaagcatgtgccatgatggctggctaattttatgtttttagttagagatgaggcttcaccatgttggccaggctggtctggaactcctgacctcaagcgatccacccctcgagcctcccaaagtgggattgggcctgagccaccctgcccaggatatatttaaaaataaaaattaaaaaaatagaaattttaaattttaacttaaagcttaaagtttctagccttattgaatgcctactatgtgcaagacacagatctgcacatttgggtgatgtaggggtgttgacaccatacttgccctcaagacatttatggtttatgttacctgagattttcttttctttttcttttcttttttttttttttttggagatggagtttcgctcttgttgcccaggctggagtgcaatggctcaatcttggctcaccgcaacctccacctcctggattcaagcgattttcctgcctcagcctcccgagtagctgggattacaggtgcctgccaccacgccccagctaatttttgtatttttagtagagacgggggtttgccatatttgccaggctgatcttgaactcctgacctcaggtgatccacccactttggcctctcgaagttctgggattacaggcgggagccacctttcctggctgagatttcaaataataatacttatttcagtttgaagtgttctgaggggaaagcatatgtaatcctacaaagaaaaaccctgaagttgccttaagtgcttgaaaagggaatgaaaaatttggtactttaaacatttcatgttaaaaacttgtttgaactaaaatgaaatcgtaggaaaaacatcattattatttatttatttatttgagacagggtctcactctgtcacccaggctggagtgcagtggtgtgatcacagctcaactgcagcctctaccgccattagctcaagggatcctcccacctctgccttccaagtagctgggactacagacactcagacactcaacaccacgcctgattgattttttttttctcgtatatatgggatttcaccatgttgcccaggctggtctcaaactcctgtgttcaagtgatccacctgctttggcctcccaaagttctaggattacaagcatgagcctctgtgcctggccagaaaaacattattattattttaaaatttggattgtagggttttcaatatgtggacaagagtataggggacattgagaacataatttttgtttgtaagaaaaataagtgtagacatttttaactgtggttaatcaattttaacctttatgtgcctagaaggagcaaagggaatgtactgactgattctctatacagcagagttttacattggacactcaacatcagtggctggtcctgatgttgaggggagaaatgctacttcgatgagttcagataaactataaatagtatacaaaataggccacataccagctgataaacatatgcgtctctaccccaagaagtttcagctttcagttccgtcccttctttttgtgttctatgtggtatatctgattctttaagattttttttttaatttttatgggtgcctagtaggtgtatatatttttggggtacataagatattttgctgcaggcatgtaatgcataataatcacattatggaaaattggttattcgtaccctcaagcatttatcctttgtcttataaacagttcaattacactcttagttatttttaaatatacaatcaaattattatttactatggtctccctgtcgtgctatcaaatactaggtcttattcatttcattctttctatttttggggggaggtatccattaaccatccccacctcccctgtaaatccccactccacactacctttcgcagcctctggttacagtcttgctctcttacctctatgcgttcaattgttttgatttttagatcccactaataagtatgaacggatgatatttgtctttccgtgcctggcttattttacttaacataatgacctccatgttgatgcaaatgacaggatctcattctttttaatggctgaatagtactccattgtgtatagataccacattttatttattcattcatctgttgatggacacctaggttgcttccaaaccttggctattgtgaatactgctgcagtaaacatggaaattcagatatctctttgatacactgatttcctttcttttgggtatatatccagcagtgggattgctggatcatgtaactctatctttagctttttgaggagcctccaaactattggccacagtggttgtactaatttacatttctattaacagtgtatgaggtttcccatttctccatatcttcaccagcattagttattgcctgtcttttgaataaaagccattttaactgaggtgagatggtatctcctggtagttttgatttgcatttctctgatgatcagtgatgttgagcaccttttcatatgcctgtttgccattggtatgtcttcttttgagaaatgtctattcagatattttgccccttttaaaattggattattaaatttttttcctatagagttgtttgagcttcttgtatattctagttgttaatcccttgtcagatgagtagtttgcatatattttctcccattctgtgggttgtctcttcactttgttgattgtttcctttgctgtgcaaaagctttttaacttgatgtgatcccattctggatcatattgtttaatttctatgtgtttatataatttccaaaattcctcttgtgattgatttgtagttttattccattgtggtcagagaagatgcttgatattattccaaattttttgaatgttttaagacttgttttgtgatctaacatatggtctatccctgagaatgatccatgtgctgaggagaaaaatgtgtattctgcagccattggatgaaatgttctgtaaataactattaggtctatttgttctgtagtgcagattaagtctgacatttctttgtcgaggttctgcctgggagatctatccaatactgaaagtggggtgtttaagtctccagctattattatattggggtctatctctttagctctaataatatttgctttgtatagctgggtactccagtgttgggtgcatatatatttacaatcattatgtcctcttgctgaattgactcctttatcattatataataatcttctttgtctcttcttacagtttttgtcttgcagtctattttgtctgatatcaatatagctattctagctattcctgctcttttttcatttccattgtcatggaatatctttttccatccctttatttttagtctctttgtatctttataggtgaagtaagtttcttttaggcaacagatcattgggtcttgttttttcatccattcagctactctatgtctttttgactgcagactttagtctatttacattcagtgttattattgataagtaaggacttactcctgccattttgttatttgttttctggtggctttacagtcttcaattccttctttgctttcttcctatcttccttttaatgaaggtgatttttctctgatggtatgttttaatttctttctttttgtttaattttttgatatccattgtatgtttttctattttaccatgaggcttgcaaatactatcttataacccactattttaaactgatgacaatactgattgcatatgcaaacaaacacacagaaagaaaactaataaaaactctacactttaactttgttccttggcttttaattttttttttttctctttatatcttattgtactgtctgtgtcttgaaaagttgttgtagttactatttttgattggttcatcatttaatctttctatgtaagatgagaagtttatacaccacaattatagtgttatactattctgtgttttttatgtgtgcttgctgttatcaggaagttttgtacctttatatgatttcttcttgctcattaacatccttttctttcagattgaagaactctctttagtatttcttgtaggacatatctagtgttgatgaaatccctcaactttgtctgggaaagtatttctccttcatgcttgaaggatattttcactggatatactattttagagtaaaagggttttttccttcagcactttaaatatgtcatgccactccctcctggcctgtaaggtttccactgaaaagtctgctgccagacatattggagcaccattgtatattatttgtttcttttttcttgctgcttttagaattctttctttatccttgacctttgggagtttgattattaaatggcttgagttagtctctggattaaatgctgttggggttctataatcttcttgtactcaaatgttgatatctttctctaggtttgggaagttctctgttatcatccctttgaataaactatttacccctatatgtttctgtacctcctcttttaggccaataactcttagatttacccttttgagaatgttttctagattttgtgggcatgcttcattgttttttattcttttttcttttgtctcatctgactatgtattttcaaatagcctgtctttcagctcacaaactcttctgcctgatcagttctgctattgagactctgatatattcttcagcatgtcagttgcatttttcatttctagaatttctgtttaattctttttaattatttcaatccctttgttaaatttatctgaaagaattgtgaattctttctgtgttgtcttgaatttctttgagtttcttcaaaacagctattttgaattctctgtcagaaaggtcgtatatctctgtttctccaggattggtctctggtgctttatttagtttatttgaggaggttatgtattcctggatggtgttgatgctagtagatgttctttggtgtctgggcattgaagagttgggtacttattgtagtcttcacagtctgagcttgtttgtgcctgtccttcttgggaaggctttccaggtattcaaagggacttgggtaacaagcccaataacattgtgtcttttgtagacttgtagaggtaccacctaagtggtcttggataagatccagaagaattctctggatcaccaggcagagactcttgttcttttcccttacttcctcccaaataaatggagtctctttctgtctgtgctaaaccccctggaactggggggtgtggtgatgcaagcactcctgtggccaccaccactgggactgcactgggtcagacctgaagccagcccagcactgggtcttgcccagggcccttcccttcagggcagtaagcttcctcaggccccaggcgtgtccagagatgctgtctggaagccacagattggggtcaaatactttagtagtttacctgatgttctgttctactgcggataactagcactcacactacaatacaaagttcttctcactcttccctcccctttccacaggcagaggggccactccctgtggctaccaccacctttggtccacagggtttctgccaggccaccaccaatattcacttaaagcccaagggctcttccatcagcttgtggtgaaagctgcctggcctgggacttacccttcagggcagtgggctcccctctggcccagggtagtgctagaaatgccgtccaagagtgttggcctgggccagacacggtggctcatgcctgtaatcccaacactttggaaggccaagacgggtggatcacctgaggtcaggagttcgagaccagcctggccaccatggcgaaaccccatctctactaaaaatacaaaaatcagctgggcgtggtggagtgcacctgtaatcccagctacttggaaggctgaggcaggagaatcgcttgagcccaggaggtggaggttgcagtgagccgaggtcacgccacttcactccagcctgggcaacagagcgagactctgtctcacaaaaaaaaaaaaaaaaaaaaaaaaaaaaaaaaaaaggagtgtaagccttgacttggggaccccaagaacctgcttgttgctctacctcactgtggctgagctggtacctaaggtgtaagacaaagtcccctttacttttatctctgcttttctcaaacagaaggagtctttcactgtagccaccacagctgggaatgtgctgggtcacacctgaagccagcacatctcagagtctcatccaaggcccatgacgcactccttgggtatcgctgctggttattcagggcccaagggctctttagtcagcaggtaatgtatcctgctaggactgggtttttccctccaaggcagtaggttcccttttggcccggggtgggtctagaaatgttgttcaggagctagggcctataatgcgggcctcacaactctgcccagtgccatatcctactgtggctgagctggaatccaagatgtaagacggtcctctttactctttgctctttgctccttaagcagaagaaaggagtcacttctattgcagctgcctttgtttgggggatggatgatgcaagcactcttttagctatgccggctggtatctccctagatcacatgccaccctagtccactgactataagcccagcctagtgctagtagctgaggagttggagtccttgtgccctagactgtatttcaagtttatctaggaccccagagcttttcagcccacggtggtgaggcttgcagggaaactcaagttctgaccactgggatggatgcttcctgtctagctggggcaggtccaaatgctccctccatgtgctggcgctggctgagcccagcccagctttattctccactgtgacagggcagcactgagttcagtgtaaaggcccccagccactgtaccctccctttcccaagtgcataggttctgtctccacaccacatggctggctgctgctagggggtgagggaggggtggcattggcgatgcaagaccatcttttctgccctcctcaatgcctctttcaaagatatgaagtcaaaaccagccactgtgattgctcacctgatttttggttcttgtgacggtgcttttctgtgtgcagatagttaaaatttggtgttctagcagccgaaccaatgtttgtaggcttcttttccaccgtcttgctccactcactcccatatctgattcttacttggaaattcttacagctaaaaaatctcttgtccagattccctgcaggattctatagggaagatcacttatctttatcatacaacctttcactcttactgttataattcttatttacctctctacgaatgaatagtatagctctgtgatttcaggcaagttacttaatctctctgtgtttctttgctgttaaatataaactgtgtcagcctcttaagagttgttttgaggattaaatgaggtaattcctagcacagagtaagcacttactaaataatagctattactattatctctcttcagccagctgaagtcttagagggcagtgccttcatagtgttctttgtatcttctgcaagtacttatctgatttgtcccagaattagtaaaaaatgtttaatattgtttcctgatttcttgagccttgctggtgtgtataagatagaatttttcacactgggcttccttggacaagtttcataagaggtgcttttttgtagttcaaaaacattggattcaaatttcatctgtaaattttaactgtttaaaaaaacaacaaaaatctgtgagctcaaatgttataaaatagaattttaagtaataaagattatcagtgtctttacagttgttcacacctataatcccatcattttgggaggctaaggtgggaggatcacttgaggccaggagtttgagaccagcctgggcaacgtagggaaaccttgtctctacaaaaaaaaattttctttaattagccaggcgaggttgtgtacacaacctgagcaacagatcaagactatctcaattaaaaaaaaaaagactctcattttattaacatgctgctaaatttatttttatgcttttcctatcatcttttgaaattgaagatgatcctgatattgaagggtaaactcttaaaaacaaactgcaaaacaagaacttgttgccatttgcaaatatttctctccataaattttaattgtgtgaattttaaaaacacaaaaataagtagaataggatacaggaatgcaactgacacataacctctgctttcattgatttgtattactcagatgaggcttattgttgccattgattgatttttataataaattcattctataaatttaaataaaaatatacctgttctaattaagtgtggatttacctactacctttggaaagagcagacattgataaataacttacttgtttttatgtatttctttgataagcgtttgttacactattgttacgtaataggttttaggctctaagctaacaatataggtttgacaggctacaactgacagcctttggttaaacataaactcattgggtttccatataattgtgcatttagaagaatactttattgctttaagactttttggaaacgctgacttgtaaagtatcctatgtctttgagtcagctgactcccatcttttacttttgcaggggcccagctggagtaagagcccaggccctggatagagatggaaatctggtagaagattttgtatttgatgcaggagttggggatattggaaatcgcattcttcatgtgagaaatgcaccttctcctgctgctacttcttccattgcaatttctggaatgattgcagatgaagtacaacaaagatttgaattataaataatgaaaggagctaggtatgcactgtaatcttcatgtcagcaacaagaatgtactaattgcattctttaatttaaaaaatggtttttaaactttagtttttaggtcaaagataaccactgcattgttaaaatgatgtaacatagaaataataattttctacaaaaattagccaggcatggtggcgcatgcctgtaatctcagctactcaggaggctgaggcaggagaatcaattgaaccgagcagacggaggtgagctgagagctgagattgcaccactgcactccagcctgggtgacagagcaagaaaataataataataataattttcaaaatgttaggctgggggccgtggccagcactttgggaagccaaggcaggtagattgtagcccaggagtttgagaacagcctgggcaacatggcaaaaccctgtttctacacaaagttagctgggtctggtgcctctgtagttccagctcctcagtaggctgaggtgagaggatcacttgagcccaggaggtctaggctgcagtgagcttatgttcatgacactgcattccaggctggatgatagagcaagatcttgtctcaaaaaaaaaaaaaaaaaaaaaaaaaatccagcctgggcaacatagtgaatgaaaccccatctctacaaaaaatacaaaaattagctgggcatgatggtgtgtgcctgtagtcccagctacttgggggctgaggcaggaggatcgcttgagcccgggagatcaaggctacagtgagctgtgttcatgccactataccccagcctgggcaacaaagtgagtccctgactcaaaaaataaaaacaacaacaaaaaataaattccatgcttatttactttgcgaataaagaggcaaggtacagttttatctgtccgaatccctgacttttatttattttttttttcagacggagtttcactcttgttgcccaggcttgagtgcaatggtacgatcttggctcactgcaacctctgcctcccgggttccagcgattctcttgcctcaacctcctgagtagctgggattacaggcgcccaccaccatgcctggctaattttttgtatttttagtagagacggggttttgccatgttggccaggctggtctcgaattcctgacctcaggtgatccacctgcctcagcctcccaaaatgctgggattacaggtgcgagccatcatgctcagccctgaatccctgactttgttaatgacctgtccttaccaaccatgacctagagaagatttggctttttaagagttttggagaaagatggcataaaaatagattatttccttaaatcaattttttagcattacgctacctaagctcgtttggtctctcatagacaagaaaatacattatattgtaggttacattcttttaattttgaagagtcacaaaactcacattatttagagcaacaatatttgtatttggaaattaaaaattcatgatttcaagaaaatacataaaatttacatttttgagtagtttgaataagtttctatcttaattataatatttgtaggaaataacaaaacaaactcaaagcctttattatttccagtctctttgtaactgatgtggtatggtatcatcatgaaatctaaacagtggtacactgagtggttgtcctgttcttcaatctctgtggctgagaactgaaataacttagaagagacagatttttatgagagcagttttagaatcctgacactgatgtatagaactccaatttaaaaaagttatttatctattatatctctgatctttagtcacactaaggctctcaaaatgttggccaagattggtaatgattcatacgtacttgatttttcagggctcctataaacttgtatagggatatttttccatttttgataaatatctaactttgaggcattcacttttgtaaaccgcgaaagtgccttacattcacctcatgagtattttaagttgatgcccagtgctgtggtatatcctgtatatatgtgttttgtggtatctatcgaaattattcttataatttagaaagttagaaaatagaaattgtaaatgaaaatgtggcgacctgactgcagaactttgagtactgaaccacatttaggtgaggcattttcatccattctctctgatttgctctctcaggattcatcttctactgtgtatgtcttctttcctcttagctctccaaagctgtatgatggatgggtgagaaggatgtgcattttggttgataggaaaaatgtttctgttttcttccttttcccctcacttcaagcattgatgattacattgattgagctacctcatccattaatttgaaaggctacacttcatcagctcatgtttaagaagtagcacatcccaggtaaacagagtaggccattattcaactcttaggatgagtatattaaaagcattcagatatcaatgacagaagaaacaagccctaatgtttctttataacagctgattcctgcaagaaatgcaaacacaggatatttttctgttccattacaagattactaagagatggaaaatattatcattctgtattttgtcagtagtacgattgcatacatactaagttgtaaacattgaattacaaaaaatgattgtcctaattgaagcagtcctcaatccatttgagtctgtacaataccctgaaaaggaaacaacaggtgctggagaggatgtggagaaataggaacacttttacactgttggtgggactgtaaactagttcaaccattgtggaagtcagtgtggcgattcctcagggatctggaactagaaataccatttgacccagccatcccattactgggtatatacccaagggactataaatcatgctgctataaagacacatgcacacgtatgtttattgtggcactattcacaatagtaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatgttctcactcatagatgggaattgaacaatgagaacacatggacacaggaaggggaacatcacactctggggactgttgtggggtggggggaggggggagggatagcattaggagatatacctaatgctaaatgacgagttaatgggtgcagcacaccagcacggcacatgtatacatatgtaactaacctgcacattgtgcacatgtaccctaaaacttaaagtataataataaacaatatatatatatatatatatataaaataccctgaaaaataaaaatgaaaaatttgttgaaagtgttttgaatatgtaggttattctgcttgtaaaacgttttatatgtatgtcaatagggtttttttgtttaatactgatataataaagttttatgtatttctgacagaagaaatgtatattaatatttaaaatattttaatgagccttggtgttgtagagaacatattttttagttccataaaaacttttatgcaaataaatttttttatgtgtaaaacataaactgtttgctttagatagatagcagccaacctttttaaaaaactcatttctgtgttagtatataatacaaaatgaggttgagtcatttatattttgggtaaaaagtggagcattttagattttaacttcagagtgtttgtgaggaactcttgatgtaccagcaagtatatttttggtgtttcatgttacgtagcttaactcttttatccatacatatatgtgtatatcaaagtccttcccttgatcctctcagcattagcactgtttggggagttgcctttactgttggcagaattccactttccctgaggccatttggaaatctacctagtagcctgtgggataaccttaactcttagaactttcttcaaaggatggtggtgagaatggggtatactgccaggccctggcctacgggagtttgtagggcctacttttggaggcaatccaaccctgatggctgtacctatgagctatccctgtaaacacaggagacatggtgtctatattgtttaaggactggctctgccctcctgggcccttaatctgtgtctagacttcttggtcagaggtttcctcatctttctgcgcatacactattatctaaagatcttgtaaacatttttgagttgtaatcgtaaagtcagtttctaagcttttctaacacactcaaagggagtttttgaaatctcttcatcagggcttaaggtagaaggacagggtgaaatggttgggaaagcaaaagctgcctcgagatgttttcaaatagtttgtactcattaaatagcttaagaatggaaataaaccctgaagccctgaagggaagaacagtgttgataccaaccaactctacttttctggcctcaaatcctagaaagtattgtgggtttgttgttgttgttgatgttgttaattgcttgtattttctgcttatgggaaggatctcacattaaagttatcttattttaagtttcttttgtccctgggataaaatgagaaaatttaccttttagatatggcaagagatggcaggtcttgggttgctcaggaagcccaattttgaatattaggaaagacctgagggacaatgataacagagggacctctctcactagagaaccttgaatttcagccaacttctgcttaaaactgtatctttagaaaaacctcttttaactttgttgctctgaagcacaatgaaatggctacagcagtggttgtttcttttacgcctttcaggtttaattttctgtaaatttgtccactgggaatataagagatgtcttttagggatatcagtttattttttaatttttatttatttttctcttttcttttctttttttgagatggggtcttgctctgtttcccaggctggagtgtagtgggaccaccttggctcactgcaacctccgcctcctggattcaagcgattctcctgcctcagcctctcgagtagctaggattacaggcacgcgccaccacacccagctaattttttatgtttttggtagagatggggtttcaccacgttggccagtctggtctggaactcctgacctcaagtgatccacccaccttggcctccgaaagtgtcgggattacaggcgtgagccaccactcccagcctttttattttttttttaagacagagtctcactctgtcacccaggacccaggctggagtgcagtggcatgatcatagctcactgtagcctcaacatccttagtagagacggggtttcaccatgttggccaggctggtctcgaactcctgacctcagggtatccaccttccttggcctcccaaaatgctgggattataggcatgagccactgcacccagcctttcttagattcttgatcagtcattccagctgggacctcctggatccttctaaatactcaagtaatcttcctgctttagccccctgaatagctgagactacaggtgtgcatctccatgcccagctaatttttttttttttttttttttgaggagacaggtttcactattttgcccaggatggtctggaactcttggcctcaagcaatcttcttgccttggcctcccaacgtgctgagattacaggcatgggtcgccacacctggctgtgatatcagtttataataatagcaggttctttagtttgtttgggtttttgttgttgttttggtctctgagtagcttcccaaatcacaggggccacgtactaattgctctttcccagaatgcctagatccttaacctttgcctatgtttttcttagatgctttttttttccctttttttttctttttgagacggaatctcactctgttgcccaggctggagtgcagtggcatgatctcagttcacttcaacctccgcctcctgggttcaagcagttctcttgcctcagcctcctgagtagttggaactacagtcacacaccacgatgcccggctaatttttgtatttttagtagagatggggtttcaccatgttggccaggctggtctcgaactcctgacctcagggtatccacctgccttggcctcccaaaatgctgcgattataggcatgagccactgcacccagcctttcttagattcttgatcagtcattccagctgggacctcctggatccttctaaatactcagaaccaagcatgttggttatgttacaggccaacagtaaaaggttgtcttctgacatccaactttgtgctttggaatttagggatataaagatgctttttgcttctactttgcatgttagaattttgtggttggtagtgaacttttgaatatacttttatttttgaattctctccagaattacttggtaagttttctggaattaaagaaaaagcctagtgttaaatgttattttaaaagagttgatgcgacattgaggatttcaaggttctaccagcatttctaattgagagaatagtagtttcctctggaaggaaacttcctatgaaagtcatatagtgatggcatttattctaagagtggatatggtaggtgagaaccacagagttgaagggaatctggagggtcattctaggctactcagcttccagaaatcacatcaatggataacaccaaagaatcacactgttttttcaagtagagagtaaatgattatatatttgggtcaaaaaactgaagtttggttatcagtgaatatagtaatcacagaacaaaacaacactttgttgtgagttagtgatataaactaacacagtagtataaacctaccccagagagagggggtttgccctgtttggtttattattttgggttcagttggaagagaatagaatccattctagctaaacaaaaataaatttattttgggccaggtgtggtgactcatgcctgttgtcccagcactttgagaggctgaggcaggaggactgcttaaggccaggagttcgagaccagcctggatggcatggcgagaccctctgtctacaaaaacaaaaacaaaaaattagccgagtgtggtggcatatggctgttagtcctagctatctttttttttttttttttaaacgtagtcttgctctgttgccgaggctggagtgcagtggcacaatcttggctcactacaacctctgcctcccaggttcaagcaactctcctgcctcagcctcctgagtagctgggattacaggcatgtgccaccatgcccggctaatttattttgtatttttagtagagatagggttttgccatgttggccaggctggtctcaaactcctaacctcaagtgatccacccgccttggcctcccaaagtgctgggattacaggcgtggtgagctaccttgcctgaccagtcctagctatctgaaaggttgagatggggatcccttgagcccaagagttcaaggctgcagggagctatgattgcaccactgcactccagcctgggtaacagtgagaccctgtctaatgataataataatacattcattcagagaatacagaatcattggaaggctaatgaagtagattctggttgagctttcaggaacaagtcccaaagccacaccacagaaccaggccactaagagagtaatttcaaaacaattatgatccacagagaactgccacaccatgagtctagccattgctgctgccacataaaactagtgactgaatggtgcttgctaacagaaatatcagagttgcggcttccaactcacttctgccttcttcttttttttttttttttttttttttgagagggagtctcgctcttgtcacccaggctgggttgcagtggtgtgatctcggctcactgcaacctccacctcctgggttcaagctattctcctgcctcagcctcctgagtcgctgggattacaggcgcccatcaccacgcccggctaatttttgtacttttagtaggcagagtttcgccatgttggccaggctggtcttgaactcctaacctcaggtgatccatccacctcagcctcccaaagtgctgggattacaggcgtgagccaccgtgcctgggctcacttctgccttctatatctcactctagtgtatctgatagactgggagctatactgaacagattacgaatacgttcgttgttgacagctcaacttcattaactgtcaggaatttgaaggattctattgcgataacataaataacaaaaatttgaatgatgctttttttcagtcactagttttatgtggcagcagcaatggctagactcatggtgtggcagttctctgtggatcataattattttgaaattactctcttagtggcctggttctgtgatgtggctttgggacttgttcctgaaagctcaaccagaatctacttcattagctttccaatgattctgtattctctgaacgaatgtattattattattattattagacagggtctcactgttacccaggctggaatgcagtggtgcaatcatagctccctgcagccttgaactcttgggctcaagggatccccatctcaacctttcagatagcttttttttttttttttttttgagacggagtcttgctcccccagactggagtgcagtgccacgatcttggctcactgcaagctccgcctccggggttcacaccattctcctgcctcagcctcccgagtagctgggactacaggcacctgccaccacgccaggctaattttttgtgttttcagtagagacagggtttcaccgtggccaggattgtctcgatctcctgactttgtgattcgaccgcctcggcctcccaaagtgctgggattacaggcgtgagccaccacgcccagcaatgctttgccctttcaccttgattataggagatggtgtttggaacagctacttcccccacgtacgatgactttccacctggtggtggtggcaatatttggatgacctcggtggcatcttcataccttggagaaccagaaaacactctttttgctcaatagcacgttgtatgtaacatataaacatacaatgccttttttgtggggagtggggaggcatacttttaaatcgatcttttggagtttcatacaaaattatagttcctcttgggaagaccttttaggtatgctgtctcttacagggggttgggcatgagcctcccataagggtcagaggacaaaggcctgtctgagggcctgcttcaacttctttcaggcaggtggctgtgagaggaccgagctggctatggcagcaacccatgaaagtgagtgataacaacatttattgtttcctgtggcgttgctttgctttgctattgactggtagcgcttgtagctttaaataaattgaggaagtatgagagagtaaatggaagaaa

SEQ ID NO: 403 - DNA, 74986 bp, Homo sapiens; identical to SEQ ID NO: 402

SEQ ID NO: 404 - DNA, 14622 bp, Homo sapiens
ctgctttctaataattgcctttagtgggaacagaagtctcctttcaagaagcttttaattcattttaagatttaattttatgttttctgaagaacaacaaaaaatatttctggaaaagactgctgagaagatttccctctttcagccagaagagcagagagaagattgtaaatcaaggaaaaggtgaagtaataaattaggagggaactttggtattccgagtatataaagactatttatttttcctgtgtctatattttctctttttgtggaggagaggaaattctaaaaatatttgatagatgttttgccattaacaccagaaaagtgtgtggggaaaaagaaaggagggaaggagtggggggttaattttgtttaattagtagaaaaagcaacataaatcaaagcagtctattgatgccagtccttaatttataatgttctgaaagtaaagtgaatttatttacaacataagtgatttgataatttcaatctgatttttgttttaaccttctattgggagaagggttgactttttaaagcctggatagtttgaaacttggctaggtaccttggactttttattgtggaagcaaatattatcatttcaatgttaaacaacttgcaagtattaaatggctcatttgtgattgactttttttttttttttttttttttttttacagatttcccccttcagatctaacgattacattagggctcctgcatctttttggaaggattctttttataaatcagaaagtgttcgaggttcaaaggttgacatttctgagtgctgatactttgtcctttcatactatccaaacaagtctaacatttagaaatccttacacattcaagggaagttgtggaaattcccagagagagagtgtgtgtgtgtgcgtgtgtgtgttttggttttgttttgctttttttctttgttagtgagaagaagccgagtcttttaaggtacggggtttacagtaatgaactgaggaaggcaggagcttctaagaaaatatgcccccccacccaacctaagcagtaaactttaactgctagctagctgcagtgaaccagtgggagccccgatgagcgagggtctcggtgacagcgtgctatttctcccaccctgggtaaaatatgtggagcatcacccggaaagtcgggcttgataaaggccacattccttgaatcatctcaagaatctaaatcacactagccttctagaaactaatgaaccctaccagcaggattgcctagaagacaaatatcccttgaatggttcccagtccactcgcgctcttttcaaaaagttagaggagccctggggagggtatccactcccgctgcaatcctttcctagatgatactacccagtaattccgagcagtctttcttccccgcccattagctttggaaagaacctcggctttcccgtcgcttctcccaggcagagcagcacataaccatagttccactgcatctgtccgctggctgcagcgactcggatacagtcttccaagaatctgtaacctgggacttttgagggggaggggacaagcaggtagggtatcagagaaaggatgggttagactcccgaccatgagtgaaaagggccgtgtgcgtgctccaggagtgtcggtccccctctgcaattcaaaagggggatctctcctgtgcgcgggttttttgggaccggctccagatgtctcccagcagttctgaaacagcaaaaagtgcaatttagatatgaaatctggaactgtttttgttcttctaagcaaaagatctccctctctctagccgatgctccccactcagttcatcccgggaatgggccagggaggaaggttctcatgcatcgccccgagctgccaggcgagcttcgggctccttaaattcacaggccaacagcccgcgtcctctccgcgcaggctcccggttgcccgcggtccccggcccagctccttggcctcctcctcgtcggtccgcccctggtggtcttggcgcccgctcgtccagctcggcgcgccggggaccgccggctgcccggggcagtccgcacgccctcggggatctcggctcccggatccgccgcgccggcaggagccggccgggcctggagggagcaagcggatgcgcccacgcccccggcacggggatggcgcgacagggcccgggctccggggtggggctcggcagagctcctgacagctccggggtcggcagcgcgggaggggggagctccgccgctcgccgctcattcccggctcggggctcccctccactcgctcgggcggcgcggggcccgttcgggccgcccgtcgccgcccccgccccccgcgcgcccgcccgccagcccgcctgcgccctcgctcgccccgcgcgcgttcctagggcgccacctctttgcgactagctcacttctccggcaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtagacagacagctatgtatatatatgtgggtttcgctacaagtggctctggaacgaaagggcctggttcgcaaagaagctgacttcagagggggaaactttcttcttttaggaggcggttagccctgttccacgaacccaggagaactgctggccagattaattagacattgctatgggagacgtgtaaacacactacttatcattgatgcatatataaaaccattttattttcgctattatttcagaggaagcgcctctgatttgtttcttttttccctttttgctctttctggctgtgtggtttggagaaagcacagttggagtagccggttgctaaataagtaagtgctgagaggctccagagaaattttttttcttttcaacttgggagatgcccttgatgttgaagaggctttttgagagcgggctaaaaagggggagcggagtagtgcggggagatggagagtccagactgacactcgggtcccattcccttctgttgcaggtcccgagcgcgagcggagacgatgcagcggagactggttcagcagtggagcgtcgcggtgttcctgctgagctacgcggtgccctcctgcgggcgctcggtggagggtctcagccgccgcctgtaagtgccccatcctccccagggcgccgggttggggaggccagggggaggggctgccaagctgggatgctgccgagggcttgcagcggtcaccgatgctccttgcccgggttagggagagggaccatcccggatacctgccggggcctgagcccgggtcctcaaacctggcaggagaactggttgatcttcaacgggagacaggcaagagagagactttatgtgtgtttccataagagggagcgtttcacagaatctcttctagggaaagatcctctgcctctagtggaaaagaaaaaaagttggggggtggtggttactgtcaggacccgggaagcttctgaaactcggaggaagctgagcggtcctggggacgtatggcctgcgcgcttgtatacatactgaatgtgggtggcggtttgcgtgtgaaaaagcaaaagccgtacatctaattttattatgaatgacataattttaagcatataaaataggaacacattacataataaaagcgtattatataataaagtagcaacaactttgcagtggcacgactccaatgttagtattgatacagttcaggaacgctagagcgcttgattccaaaatgaattttaggtgtggaaccttttttttcttggagttattgctaacagttctttaatctggagtcaaatatttgcattgtagactgaaaacttgtattttggcattctcacttggtgattcttttaatgataacttcaactttgaaataatcatacatccaagcacaccagagaaatatcactatgtcgtgtgactgaaaacttggaagagtgatagagtaacatgatcttaataatctgttggacctagcagttcactaatgtgtataacaccatagttgggtgatctttaaactgcagactcagtgttcagaatgggaaaactataaagttcgagaactgagatgcgtttgactctggagaaggaattaaggcaaatttttacactaacaataaaaatagcagtatctaatatttacagtcaggtttatggtgcttccttgtaaattcccgagggtgtacaaaaaggcaactgttttatacgtgcttgtggtctattattattagaggagaaaatccttaaatgaaattactttagacatgtcggaaccttggcatcaaaatgaaaatctattatgaatctcctaaggcaaattgtgtagaacattataccgaagataaggctgcattgtattcttcagatcaacattttaccgatgtgtttctgaaaattgtcttcagactttttgctcattttgaaacttgtcttaaattcaataatttgaaattcatacataaatagaaatgaagactgaatttttaaaagcacacttaaatactatatttatttggctaagaaatactaccttggaacagagccaattttttctttaaagttgcttaagaaatacctgttttctcttttgagaaacagcaaatgattcacgattatatacacaactatggcataaaaatactgctaagttgtcctaaaggctatttttaactctttctttgttgcaccttacaaaacacacatcagaaaccatttagcagccagcgactgttatagttttgtttgtgggtgaaatataatattgtagttaaacactcacactcagcagatggttataaaactaccacaaaacattctcatagttaatgggtaatagatcatcacattacaggcatggtttttcatggaggctgaaatcatcagtagatgaagatgtttcatcaaattatcatagccaaatggagtttttaaaaacaagtcattatttttgtcttgctgccaagtaacagtaaattttgtgtgctagacaaaacataagtctaccattatgctaaatcaagctagtttcttgaaagaaattttaacatataatcaaaccatattactccccggttttcacaccaagtattagggaaactgctttagaagtatagattttttttttaactagatgctaacttttaagggagaggaaattactataacaataagacttcctaaaccatgcaaaggaagcagttacaaattgtgagtctttttgacctgttaatcccaaagattttaattaatggagctagagcatgatcaagttggatactggaaagtgaggcctatggatgttcttgtgcagatgaacaaggcttctggcaggtggctatctctatgtttaagttagagagggaactccacagattcagaaacctaaaacgtcattggctgatttgcttaggagccagactgggtctattccatttaatgaaaagcataactttctactgagtcatttgggttggaaggaccttctggtgagtcatcttaactctaacaccctaaccctgtctcttgcatgtaccacagaacttttcttctcaaacacagagtccgtccttagaagcctagcatcagtacaagcatactgcttcttcctgtgctggaaagggaatttccatcactgtttttatgccctctgttccttgatagttccttagaaatctaagcttcttccctaaaaactcccttggagtgattttttttttaaaggagaagaactatgtttgggctgaatttagggttatctatgataagcatttccccaaaattttgcaatttttttttacaataatcaaaggagaacatgatacataacctacctgtttttccattttggagcttaggtatgtaagtgtcatgtgaaccatagtgctatgtaatgtttacagacaaattgagtaaaagactattattgaggccatatttacaacttaaatatttcagagttatctaaattgaaaacgtccttaatttgaatttattactcactacctctgtatacctagtttatactgatgccattatattcctgatcctctaatgcaactgcctagtgagagattcattcttcacaatactttaattgcagaagtttttgaaatactaagtaaagtgtctaacagcatttccaatttagcatttaagaaaacttgtgttttccaagatactaacagtttcccccaaaaggcagatgaaaagctttgtccctcgtaagcaatgtactattttaaattgaacaaagctgtgccatattgtaggctttttataaattagaaggatggaatgatcactgcatttcccaagagaactatcctgggaaaatgcagcttgagttaggaaggcactgtgactcacagttgacaggctggccaagatgacaagcacatatgcccatgagaaggggcatatgagcaatggtggcttaattagaatagaccaaccattaaaagttttggcctcaagttaagctaaaatgggctacactttatccatttggagagcaatacagaagacgagggcttctgccaggaacagagaaagaaataaaagcccccaatactataaattatcagtggttaagaactgctttttaatgtgacattttgctaaaagatacttattaaactgtagtgcttatgaaatatgcaattatatctgtcctattattttataaatgttattaaaggatataaataccttgtaccaaagcctcaaacttgtagattcttaaaagtttccagaatactaactattaccgcagagtaagtgaattttaatctagtcacatgtggcaccttctaaaagaaagagagactccttcatgcctcatttaaaccaggctcctgttaaattcctttccattaagtcatgtcttttttgaatgagctacatggcttcaagtcagtccacacactaaaatactagaaggtagctgacattctagctagaagggccagagaaatgatgactgtattttcatctcttactcttttctttgactcattcatccagtgataatccaaactcttgtagttcctaaatttgatgatgaaaatgaactttctgggcaataggcttgatcttcaaggaaactgataaatttctgtccaatctgcctattattgtggtggcttgttactctatgccccatgcatataccctgtactctccttaccgtgttgcctcaacacaggaacaggctgggacttcagcttcagcttccgcttaggcaggagaaagcgttgaggaaattgaaaaagcagtcttggctttagaatcagaagacctagtttttggagccctggctctgccagttctcattgtgtagactagggcaagtcatttaacctctctgcacctcactttccccatgaatacaatgggggcagtaataatgctatttatgattgccatatttctctgaggagttaaagacattgcaccaacaaaggcaacaaaggacccagacaccattgtttcagggaagtaagagtacatgggatgtagccctgggaaacactttgagatgcttttgaggatgggccagtttggaggactattccaatggtagaaattggagttaatgcagagttgaagcaggcatgatatgactgattaacagatgcagtccgtaaatatggttaataatatacacaaaataataaaagaatacacaatggacatttaagcaagagtttgggtgttatctaaaaggattgatagagaattagtttattctttctcacgatattttcattagagtgtcatttaaatagaaaaatcctttatattttttcctagagaattttaagacaaagagagcaagtagaaaagtgaacttctcaactaagtagtaaggatcatactctctgaagttctaaatttaaaaaaaaaacatgaagcacagaagaaatagaatgagctcatttaagcacacaaagaaacccattttaaggagaccacccactactttacagaaaaatacacatactctccctctctttctctctctctctctctctctctctgacgattggccttcaaatgtatgttcttggtagccagtagtctaaaatgttaaagttcagtctgtgaatcagatggtttcctagacaggctacactgctcacttctccttcagcctttgtttgtttttactcttacggcttgctgtttcaatattattattttcttaatggggcgtgtgtgtgtgtgtgtgagagagagagaggagagagagagagagagagagagagagagagagaatactcaggtaaaagcagctgccttttatttcccaggctgggacttctagatttattttctcagcagaactctgaaaaatgtgaagagatactccgtggtttctgtctatttctgatcataactgaatcatatgttttaaaccgggaaggaagtatagaaatcactgtctctgaccccttccttttatacagttgaagcccatgaggcccaagaatgttcatgttcccaccaaggtcacaacctagtgagtggtagaactgggaccatgagctggagccttccaactgccagctctttccttcccactggttacccttccctgcgcaatgagcttgctacccatccagcttgtgtcttacggtggaccaactagaaaactaaagagatttactcatgtctttgttgtctctatcagcaactaaaatttaactgttttcttcccctctaatattttctttcaaagcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggtaacaggcttctctggcccgtagcctcagcggggtgctctcagctgggttttggagcctcccttctgccttggcttggacaaacctagaattttctccctttatgtatctctatcgattgtgtagcaattgacagagaataactcagaatattgtctgccttaaagcagtacccccctaccacacacacccctgtcctccagcaccatagagaggcgctagagcccattcctctttctccaccgtcacccaacatcaatcctttaccactctaccaaataatttcatattcaagcttcagaagctagtgaccatcttcataatttgctggagaagtgtgtttcttccccttactctcacacctgggcaaactttcttcagtgtttttcatttcttacgttctttcacttcaagggagaatatagaagcatttgatattatctacaaacactgcagaacagcatcatgtcataaacgattctgagccattcacactttttatttaattaaatgtatttaattaaatctcaaatttattttaatgtaaagaacttaaattatgttttaaacacatgccttaaatttgtttaattaaatttaactctggtttctaccagctcatacaaaataaatggtttctgaaaatgtttaagtattaacttacaaggatataggtttttctcatgtatctttttgttcattggcaagatgaaataatttttctagggtaatgccgtaggaaaaataaaacttcacatttatgtggcttgtttatccttagctcacagattgaggtaataatgacactcctagactttgggatcaaataacttagggccaagtcttgggtctgaatttatttaagttcacaacctagggcaagttactctgcctttctaagactcacttacatcttctgtgaaatataattgtaccaacctcatagagtttggtgtcaactaaatgagattatatgtggactaaatatctgtcatatagtaaacactcaataaattgcaacatattattttggtgtttttggaactagttctgattgtaccatctacctatctataatctatttctatctatctatctatctatctatctatctaggggggtatgtttctatgaggcaaaaagtggggcaaatattaatcccattttataaaatagaaagccaaggcattccacggctaaaagacctgagtagtccttggaattgaaataggtggccccaaagctggatttatctccctgttttctgacacgtagacagtgctatgtttgccctgcttctttatcgatgcatttccattgaaatgatttttttttcttttcacttttcagtacagcacttctgtggggtttgaaaaaaaaaaaggaaaacaacagaagaacacatcatatgcaactaatgatctcattatttaagagtcccctgttacttctttagtcatttcctttgactctgctacagataggattataggatgatgcttcaaaggggaccttgaacctattcaccattatttgtctctttaagctggcaaacccatcattaaatagcacataaaatagcaatcatatgggataagtagtacagcttcagtaatcaatgggcagtggcactagaaaaatcttgagcacagtgaatgacctatcctgcaaacatctaatggatctctaaagggtaacaaaccctataaattctggcttactgcacatatttagtgtgttttaagataggatcctaactgtatatatttataactaatgtaaggaccctactttattgccaaaacctatttttatccattgtctcatatatataaacatgtcatatatataaacatatatatataaacatatatgtatatagtaaacattcaataaattgcaacatattattttggtgtttttagacctagttctgattgtatcctctacctatcatctatctatttatatctatctatctatctagggggatatgtttctatgaggcaaaaagtatatatatacgtatatatatatatatatatacgtatatatatatacgtatatatatgagttataaaaagaggtataaataacttttgatggattttatttatttcaaatttgcaatgttctttaagtatctggagaattgatgaaaattaacactcgtcaattcttacgcctggaactacccctaagttaaagtaggtctagtgaaaattagacagtggcctaatcaaatccagacctagggctgaaagaaataggaggtttctgcttttcctttctcttccctgtttgtgagggacattcatggaaagaactgtttggcagccaaatgttggcactctcccaacacaatccaacagaggttcagggaagagtgaggaagcttaggagtgtattgatgagaatgtatggggccatgcaagttttgtaatccagataaaatcttttcagaatacctaaagttttataagtgataagtcttttattaacgtcccctccttagtctttttgcattgttacatggtgaaccaagagatctgatgatatggcaagcatgaacttgattataatacatacaatagtttgaaaaacaatattctttttttttttttttttttgagacagagtcttgctctgttgcccaggctggagtgagatggtgtaatctcggctcactgcaacctccgcctcctgggttcaagagattctcctgcctcaacttcctgagtagctgggattgcaggcacccgccaccatgcctggctaatttttgtatttttagtagagatggggtttcgccatgttggccaggctggtctcgaactcctgacctcaggtgatccacctgccccaaagtgctgggattacaggcatgaaccaccacaccggccaataatacagcattcttttagaaaaaacaactgaggtaaaattgtctattttcctctcacatgaaccattcagtgaaaaatatatagctttaaattggaggaattatattttagaattttcaatgcttcaaatgtgatatccagatacagtgggactcatttgttagaaatcatatcatttttgccttggaaaatactgatttataaaaatattaaaagtccatagtaaaaagagctaggactgtaaaatgctgtcatatgcacacacatatagtaaacatacacatacacttttagatcctgttaggtgttttacttggctattccaatacatgcctctgttaaaggagaaatcaaaagaaaggagaatgagcaaacatctgagcagggtgagatacatagaagatttctccttggtcctttaacttacttctttttctttctttctgaggaaataattgttaaaaatcctcttccttccctctttgtgttattcttatactcaattcacaaaataccatttagtacaaacacatttaaaaatcagtaaagaatgcagattattgagttttgaggtcatctttttggctttattcatatcatctatccacatccatccaccaattaaaattttaatcttaaactcttcttttctttgcagttggagcgattttaacattcccaccaaaaccattggtgaagagatcaataacctaagacattaaaacacttttaaatgttcaatttgctttttctgtaagcagcatagaaaaccccaaaattgttaagaatatgctgctttgtaggtcttacacccatatatgtctgccatgtaaaactctgccacaactctgactgttaattcaatgacatagccaatcaaattccattctgtagttgtttccttgggaacaaatacatagaccacacaaagagaagagaaagggagacagaaaagcaaagaaaactccgctaacccatcttaaaatactgtcattacagtatttagatagattagaaaaggtgtcagtttctagtaacttcagaataataaaacagacatggtgatatgaaatactgatattttatacttttaaattaatttattcttaattattcccgcatttacagtagactttcccaatgctaacagaaaaatccattcaaaaaccaacagagtgagagacaaatgattctgttttagttttggctttgaaaactactacaaaatccaataatagtttcattcattagtgtttaaagacagctaaagaaatgccaaatatcatatcatcaactaagatggatatcattataccatcaactctatttaactacacatccttccaattgttcccaaagtccacacttccactatcctcaccacagcccactatgttgtgagagattgtccaaatgagcacctgaacaaaataaacaagctttggattgcctaattcaggtgtcactggggaataaacttccaagtgaattgtatttaatgatggatggtccaacgtaacctcatttccaagttcttaaatttgtcccttctcttcccaaacttgccagctggcagtcttggaaaatttttccacagtctcctttttctgacagcatgattggaaacgcaggcccttttcctttccgcacatatgggctaagtcaggttgaagaccctgcctgtaacagaggttatggagatctgggtggatcccacagatacctcttgcaggagatatttacaagaagttccctgaatctctttccattgtgattttgcattccttagcttatatcctttatattttatgttttcatttgtaaagaaaactaacctgttttctccttttctttctcttccttctttttgcaggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatattttttttttgccaaggctaatccaattattattatcacatttaccataatttattttgtccattgatgtatttattttgtaaatgtatcttggtgctgctgaatttctatattttttgtaacataatgcactttagatatacatatcaagtatgttgataaatgacacaatgaagtgtctctattttgtggttgattttaatgaatgcctaaatataattatccaaattgattttcctttgtgcatgtaaaaataacagtattttaaatttgtaaagaatgtctaataaaatataatctaattacatcatga

SEQ ID NO: 405 - DNA, 62535 bp, Homo sapiens
tcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggtaacgataattattgttattaccatgctaacaggttataaacattgactgaactaagcaccctgcatgcccgttctcatttaatttcctcgccaagccaatgtagttggtgctattcttggtccctcttgacagaaactgaggaaggaggaaggaggaggaaactgaggcccagaatctagataaatttcgagaaatgggtgatacagtagccatgccctcaggaagtgtggcgtttgatggaggaaaacagaggtagtcacaaataagtacatttcaaaactgttgtctaaaacaggaagataattagatggtgtgagaacataattgagggagagtttaagtccacttggagttgtcttctatttgggatttaaaattcattatatgttatccatatttgtccagctctctttttgtatggaatcaccagatattattccctttctcatttcctttctcaacatttatagattggaggggggaaggaaaaccaaaccaggttataatgtagaattggtttaccccctattttcttgacatataacgtctggttttccacatataattttctagtagttcagtaacatggactccccccaaatcaggcctacttaggatagaagaggatttttgactcctggattttgctttaagaccagctcttggtttacttcctgcttcacccttaccttttcttgacatcctgtggcctctctttgaatttctctcactcatcaaatgttgtcaaaaataggactacttgctgctgtagtaaggatattcttgtattgtggccttagtgtattacatcacccccacgtcagacttgagtccccctggttggtttgggtgagtcagttcagtattaagctggcattcttggatcaaaattatgtggctgtcagctaactcagccatttagttgacctttgagggtactgtgctcagattggcatgagatattatgggtgtacagatatatgatgtactcaaacgttttttggtatgtttggggacaaaaacatggtttgaaattggcaagtgagaatcagagcaagataggacaccatctgggtgctctactgttttgtattctaggtgtctggacaatttagaggtgagggagttcaagagccagtttgtgtttctgtgcttcacaaagccacccttgtctaattcttgataaccagagtttggttagacagggactgaaacaatcctagtgcataggaatcacccactaaatacctgttgaattgagtaggcaggaaggcactatctgaattgactacaaaattgcgggtatgaaaaactggattgtattcaactaggttggtaaatttgtttagactttcaaattatctgaatagggtttatttggccaaccttatgcataaatctgtgtattccaaccttgataaaattaatttattgcaattaagtttgtccaggattatgtgagagagtccttcatttcatttctttagttaccaggagatgttcagggctcatctacatctcctggttaattttccttcagctttttctgtgtctcttccctaattctctttgagttcctgggagaaagaggagggatatttaaatgccctttgacatacttaattttctttgctatgggcaaagttaggaagcaaaattgactatagagttgttttttttgtttttgtttttgttttttttttttgagacggagtctcactctgtcgcccaggctggagtgcagtggcgcgatttcagctcactgcaacttctgcctcccctgttcaagcaattctcctacctcagtctcttgagtagctgggattatagggatctgccaccacacccggctaatttttgtattttttttttgagatggcatctcactttgttacctaggctggagtgcaatggtgcgctctcggctcactgcaacctccgcctcctgggttcaagcaattctcctgcctcagcctcccaagtagctgggactacaggcgcatgccaccacacccggctagtttttttgtatttttaatagagatggggtttcaccatgttagccaggatggtctcaatctcctgacctcgtaatctgcctgcctcggcctcccaaagtgctgggattacaggtgtgagccactgtgcctggcctaatttttgtatttttagtagatacagggtttcaccacgttggccaggctagtctcaaactccttatctcaggtgatccacctgcctcggcctcccaaagtgctgggattacaggtgtgagccaccttgcctggccttagagagatttcataacccaagcgattctgtgaatagatctgtatttgagacagagatgtagagatcagcagcccaaggtactctgtgaaaaaaggatagataactgcggagggcttccgtttttgtttgtgtagggaaacttggtaaaaggggaataaagaacagtgagaaaagtataaaattgtatctagaggttactttggaaattaaaaataatgttatttgtacttagtaaaacaaagtagtaaaagtttgctctttttttttttttttttttgagacagtctcactgtgttgctcaggctggagtgcactggctggcgcaatcttggctcactgaagcttccgcttcccaggttcaagcgattctcctgcctcagtgtcccgagtagctgggattgcaggcgtgcaccaccatgcctggctaatttttgtatttttagtagagatggggtttcaccatgttggccaggctggtcttgaactcctgacctcaagtgatccacctgccttggcctcccaaagtgctgggattataggcgtgagccactgctcccggcctgttaacccttttttactacagagaacttggaacctgtttcatcacttttctgcttcttccaggttcttgatacatatttgccagacttcaagatttcagaaaaggggtgaaagagaagattgcaactttgagtcagacctgtaggcctgatagactgattaaaccacaggtaaggcagtgaccataggaataaggaacattaatatatcagcttcataagtgtttaaatgactaatgtaattttataaagtaacacatattttggaaggaaatttatttattatgaaaagcaaaaagaaaataaaatcacccactatcccacctctcagataaaccatggttagccttttgatagatttctttataatttttttctatgtctatatagtcattccttgatatccatggggaattggttctaagaccttcccaggatatcaaaattctcatatgcggccggttactgtggcttatgtctgtaatcccagcactttgggaggctgaggcaggcggatcacctgaggtcaagagtttgaaaccggctggccaacatggcaaaaccccatctctactaaaaatacaaaaattagctgggtgtggtggtgcgcatctgtaatctcagctacttgggagactgaggcaggagaatcccttgaacccgggaggcagaggctgcaagtgagccaagatctcatcactgcactccagccagcaagactctgtctcaaaacaaacaaaacaaaattctcagatgctcaagccctggtataaaatgatgtgtagtatttgcatatagcttatgtacatactcccacatactttaaattatctctagattacttataatacttaatacaatgtaaatgctatgtaaatagttgttatactgtattgtttagggaataatgacaagaaaaaaagtctaggctgggtacagtggctcaggcctgtaatcccaccactttgggagacttaaataggaggattgcttgaggccaggagttcgcgaccagcctgggcaacatagtggcaccgtgtctctacaaaaaaaataaaacataaaaaaatttaaccgggcgtggtggcacctacttgtagtcccagctacttggggggccaaggtgaagggtcacttaagccaaggagtttgaggttacggtgagctgagggcaccactgcactccaacctgggtggcagaaagagaccctgtctcaaaaaaagtctgtacatatgcagtacagatgcagtttttttttttttttttgaggcagagtttcgctcttgttgcccaggctggagtgcaatggtgcaatctcagcttaccgtaacctccgcctcccaggttcaggcgattctcctgtctcagcctcccgagtagctgggactacaggcatgccacacctggctaattttgtatttttaacagagatggggtttctccatgttggtcaggctggtctcgaactcctgacttcaggtgatctgcccgcctctgcctcccaaagtgctaggattacaggcgtgagccaccgtgcctggccttgcagttttttttcccccaaatatttttgatctgcagttgattgaatccacagatatggaactcatagatacggacagccaactgtatttcatttttaaaaaaatcatacactaaaaacttttgttaatttttttaacttttttttttttttttttttgagtcggagtctcactctgtcgcccgggttggagtgcaatggcgcgatctctggctcaatgcaacctccgcctcccaggttcaagcaattctcctgcctcagcctcccgagtagctgggattacaggcacccgcaaccacacccggctatttttgtgtttttagtagagacggtttcaccatattggccaggctggtctcaaactcctgacctcatgatctgcccacctcggcctcccaaagtgctgggattgaggcttgagccaccacgcccggcctctaatttttttaacttaataatcaggctatgaatattttcccgtgtcattaataaattttcttctcttttcttttttgttttttttgagacagggtcttgctctgtcacccaggctggagtgtgcacttcagtggcgtgatcacagctcactgcagcctccatctcctgggctcaagtgatcttcctgccttagcctctcgagttgctgaaactacaggtgcatgccactgtacctggccaaatttttctacaacataattttaatggctatatggtattccattatttggttctttatattacttttaccagtgaaattgctggtctaaaagaatgcgtatttttggccgggcgcggtggctcacgcctgtaatcccagcactctgaggaggctgaggcgggcagatcacctgaggtcaggagttcaagaccagcctggctaacatggtgaaaccctgtctctactaaaaatacacaaattagccaggcatgatgacgggtgcctgtaatcccacttactcgggaggctgaggtggaagaatcacttgaacctgggaggtggaggttgcagtgagccgagatcgcgccattgcactactgcagcctaggcaacagcgagactccatctcaaaaaacaaacaaacaaaacatatttttaaaaacttttgacatgtaacaccaaattgccttgtaggaagattatgctgatttacctaaaacagtatatattcacataggcataaatgtataacttaaaataggtaatatatttgcatggtgcaaaaatcaaaagaatataaaaagcttcatggtttaaaatcttcctccagccttgttacttcttcactctcaccatccataggtaaacacttttttttttttttttttggagacagagtctcactctgtcaaccaggctggaatacagtggcacaatctcagcttactgcaacctctgcctccctggttcaagtgattctcctgcctcagcctcccgagtagctaggattacaggcacgccaccacacctggctaatttttgtatttttattagagatggggttttgccatattggccaggctggtcttgaactcctgacctcaggtgatccacctgccttggcctcccagagtgctgggattacaggcatgagccatctaataaacacttttattaggttcttgggtttgagtgtttgtgtgttattccccaaaccagataccttttgaagggaataaatctctataaaatgaaatgactgctatttgactaggattgtaatctgcagccacactgtcaaccattacaaactttttcagcttcatactattggaatatcagattactttgggtttctactaagatttccttttagtattttacaaagctctctgtcattatctgtcctagtagtaaacagcatcattgatttccatctaggtcctattagtcataggtggattatggtttgttgagttctatggataaattatagcaaaactgagtttgtaatccttaaaaaagggcaatatgaaacatacaagtttgggagagaaatgataggaaatatatttgcttgaagtttctggacagtgatgaattagaacaagtgtccatgtgtcctgtgctgacttctgagtgttggacagtgagggattgtcattggattttaaattgacccaattttggaagcttcatagatctgtttctgtaaacagatccaatttcaacatagaagttagcaaacataaatgtggaaacacaaagtccattaaacttccttcagacttagtttgtgactttgattaacagttaaaattgcatgctggattatgttgccatttactgactgctgctaatcccttatatacaagaaaaaaatgtaggtgttttctctctgggtaagatgaaagtaactccactctattttacttgtggtaatgtaacaggatctcttatcccttgtgaaagtaggagaggatgtccctggagaaatggcactgcctgggatgggaccatcttaactaactatacttctaatgaagtcttgtcttactctgtttattctattatattaccagtttaactcatgactttctctttaatagaaataggcaagtcatatctcactgactggatagcaaggtgtttgagagcatctgtcacaccaaagtctttgttttgctcaggagctggtagtcccctatttcaccctgcttagaatgcaccctcttgcagctttccccaacccggtctgaacctgcaccttttgatttatagagcttgtcaagactagttatttttggtttgagagtgaagaaagatgggaggcaatgggaggttaatttcagatgaatgtgggaacaggttacattgctttgtctgcaatcttcctaatttgtatttgtcttccccttccatttatctcttaccctagaaaaagtcaacgttcattcttagcttgtagaactccgcaggtctgtctgtatcttttaagtattttttacatcaggaaaccatctctgatcctcttttatgctgttctccttctctgcacttccagagcgctctctgttaatgccctcttgcagcaaggatagccctatattgtaattgtttgcattcccccattcaattgtgcgttcttggagggaagagatttttttttgttgttgttgtttgagaaggagtctcgctctgtcccaggctggagtgcagcggtgcaatctcggctcactgcagcctccacctcctgggttcaagctattttcctgcctcagcctcccgagtagctgggattaaaggcacgtacccaccacgcccgctaatttttgtatttttagtagagacgggtttcaccatgttggcctggctgatctcgaactcctgacttcgtgatccgcctgccttggcctcccaaagtactgggattacaggcataagtcactgtgcccggccgagattttatatctctatctctgtctgtctgtctgtctgtctgtctatctatctatctatctatcgttttagtcttcgctttttggaaacaaaaatgggctataagacacgatggatggcattgaataggcagtttttagaggaacctaattggttcatagcatacaggataggctttttccttgggtctttgtaggaatattggtcattaatagctatttttccatgcagaatatttctagttttgcaagaatctgaagctgtggtagattcagataattttgaaatgtgaagctgattctcttgcttggcaacttgatttgtttgggggaatgtggttgacgcatgtgccttttttttttttttttttttggtgagacctgttgacagaaattcaatcttgattaagggacgcaggaaggcatccagttcccaccatgcctggggctctctcatttaaacagctgcctttggctctggcctgttccatttcccactaggccctgtggactttaattttggaagatttcacatcctcatatttattatttctgggggaggtagtgtcgtgaaaccgaaattacccagtagttagcttttcgttttcttgatgtacttgtcctatcagccttaattgaagagagtcagacttctcaatggatatgtatttatttattctctttttccagggagaggggatggtctcctgagttggccattctagaccaaaatatagcttaaaagaagcttttttaaagaacaggtcatgttaggaaaataatattttgtttttaaaatttcacctaaagattaagtgtacttaggtttgcacccctcgccgtttgttccccactaatcaaatgtagtcttagacctcagaggacagcctttcttctgctgcttgaaccctcttcatagtctctttactctagaatatcactgaggttttcactaaccaccatcttatatagaggaaaaacttcatatggaaaagtatacttaaaaaaagaggaatcaatggattttttaaaaaatttatgggaagattcagatcagagctttccaaatatatttataacaggatttgtaatttgctaaagttttctttatgagcatatcagggatgcttagttttcataaagggcaggatttgtctttgttgaacaggatcttatgatttgattacctacctcctttttgaagcaatgtttataggaaaacttgtgcattagagagaccccagattttggaatcctgcagacttgttcttttaaaactcaacactgctatgtattagtttggtgatcttggaatagtgtaacttctctgagcttgtttccttgtttataaaatggtgatggtagcatttatttataaagacatctatctattgtctatattgttaatgcagtttaaacgagatgatttatgtgaagtgtctggtaaggtgcctggcctacagtagacagtatttggaagttattatctcttgctccatgacatttgttatttatctatttaaatgtgaatttttttttttttttttgagacagagtcttgctttgttgcccaggctggagtgcagtggcgcgatctcggctcactgcaacctccgcctcctgggttcacgccattctcctgcctcagcctcccgagtagctgggactacaggcatccaccaccacgcctggctaatttttttgtatttttagtagagacggggtttcactgtgttagccaggatggtctcaatctcttgacctcatgatccacccgcctcggcctcccaaagtgctgggattacaggcgtgagccaccgcgcccagcttaaatgtctatttttaaataaataggcagtggataagaacaccaccttcggtgtctattccatttggaatcctggctttactgcttcttagctgcatgactgtgaataagtagtaaatctctctgtgcctcaagtccctcagtatagaatgaagataataacagtacctactttataggattattgtgaggatttagtgagttaatacatgtaagacactgtcaacagtgtctggcatgtcataagtgctcattaagtaatagctgttggccgggcacggtggcttacgctagtaatcccagcagtttgggaggctgaggcgggtggatcacttgaggtcaggagttcaagaccagcctggccaacatggtgaaaccccgtctactaaaaatacaaaaaattagttgggcatggtggcaggtgcctgtaatcccagctactcaggaggctgaggcaggagaatcacatgaacccgtgagccagaggttgcagtgagccaagattgtgccactgcattccagcctgggcgacaagagtgaaactctgtctcaaaaaaaaagaaaaaagttaatagctgtttttatttttaactttttcaaatttatatacccttttattaagtcaatgccccaggaatcatttttagttctatatagaaatcttattatttgtttatttttaattttttaaattaattattattatatttttgagatggagtcttactctgttgccaggctggagtgcagtggcacgatcttggctcactggaacctcctcctcccgggttcaagctattctcctgcctctgcctcccgagtagctgggactacaggcgcatgccacgatgcccagctaattttgtgtttttagtagagacagggtttcaccatgttggccaggatggtctcgatttcttttttttttttgagacggagtttcgctcttgttgccccggctggagtgcgatggtgcgatcttggctcactgcaacctccaccccccaggttcaagcaattctcctgcctcagtctcccaagtagctgggattacaggcatgcaccaccacacctggctaattttatatttttagtagagacagggtttctccattttgaggctggtctcgaactcctgacctcaggcgatccgcccgccttggcctcccaaagtgctgggattacaggtgtgagccaccgtgcccggctatttatttatttatttatttatttatttatttatttatttatgagacggagtctcacactggagtgcagtggcatgatctcggctcactgcaacctctgcctcctgcattcaagcgattctcctgcctcagcctcccgagtagctgggattacaggcatgtgccaccaaactcagctaatttttgtatttttagtagaaagatggggtttcaccatgttggccaggttggtagttctatatagaaatattagaaagagaatatgtaacatttgggtaagttaatagtcaatttataggccacgtaaatgggaaggattatttccttaaatcaagagattagacaatcattgcttgtcatgaatatttaataaaaatttgagaaagctcagtttcttttgggctgcaaacatagatctagggaaataaatactgcttaactattttgttgttgttgttgttgttgtcttttaagagacagagtctcactctgttgcccacgttagagtgcagtggtgcaatcgtgggtcactgtggcctcaaactcctggactcaaatgatcctcccacctcagcctcctgattagctgggactacaggcacacaccaccatgcccagctacttaggaggggttgaggagggaggatcctttgggcccaggagttcgagtctagcctgagcaacaggctagattctttaaaaaacagagatgaaaaagaaagaaaaaaaggatgtgaagggttaaatttgaacactttccaggtagttttcagcatcatgctttggtggaatcatggttttgaggctaagtggggttgctgcatgttacattcctgcctcttccttcccccagctttagtcgtcttcattacattcatgcctgggaagccttcccagtgacctgagttaggcattaagatcatgggaatccaagattttcccatgtcttctagcatatttgttcacaagaaaaggaaaatttcctccttgcagcaaggggtttttaaccactgtcagtaccatggaatctttcactaaaaatcctttgaatagaaatgtggtcaaggagaggaaaggtatcagcagtgataataccttacaatagtgtatttcatagcacttgaagtagcttcttatttgattatggtaagaaggtaggcagagaattagtgacttgcctattgtcatatacatgtggtaaatgccagagagggcattctggacttctgttagttggaattgcttttgactacaggtgacagaaaatgtggctataatggtttatacaataattattattattttctgagatgaagtctcactcttgtcacccaggctggagtgcaatggcgcaatctcagctcactgcaaccttcgcctcctgggttcaagtgattctcctgcctcagcctcccgagtagctgggattacaggcacctgccaccacacctggctaatttttatatttttattagagacagggtttcaccatgttggtgaggctggtctcgaactcctgacctcaggtgatccgcctgccttggccttccaaagtgttgggattacaggtgtgagctaccgtgcctggcctatttttttttagtataagaagtctttttagcaggtcatggaaaattgtaaaaaacaccagaagtctagaggtatatagtagctgatatttgatctttaatagtcattagctcattgatgttaagccctatgtttattgttctcttggccatctactcatgtataccagatgactgccatagctccagcttgccttcaaggcaagaagaaggataaagggaaagggcaggaataagggctatagctgttttcaggaaagaaaattttttcctaggaatccctcagcagattcttacttagttctcattggccagaactgtcccatggctaccccaagcttggaaagtggctatcaggaggtaacttccattttaatgtacttgctactgttttggtcatggtcaatgaaaaatatttaatcgtaccttgacttcagccatgttaatttctaattctctatacttagagttcatactgtataatttaaacaaactgtcttatttattgtgtatgataggaccttagcgtctatgtagatgttaagttcctttgtgttcaggactacatctacttttttttctttttttttgagacggagtctcgcactgttgcccaggctggatgcggtggcgtgatctcggctcactgcaagctctgcctcccgggttcacaccattctcctgccttagcctcctgagtagctaggactataggtgaccgccaccatgcctggctaattctttttgtatttttagtagagacggggtttcaccatgttagccaggatggtctcaatctcctcaccctgtgatccacctgtctcggcctcccaaagtgctgaggttacaggtgcgagccactgagcctggccgcttagatctactttttgtgtgaagatatagagtgtcatccttgaatgttactgagaaacattcaagggcacacagcttatggcccctagcaagtacacactattgtgaaccactgacaaaaagcttattgagttaagcttaataatgaaagtagaaatggaggagagaggaaaatttagactggggataccaaagaacccctattccagacagaagactatggagaatggatttacttggaaataaatacagtattcttttctatgcaaatagcttaacttcatgaacacccttctttaattcacaaggtaagagggcagaaggatgtagaaagaacattgtgctgaagtcacgagcctcaggtccagatctggctctgtttttacgtaactgtgtgatactgggcaagtcatttaatctttctgatcttcagcttctaggttgggaataattgctgctttacaggattgttttgcatatcagaaagaatacatatttagtatatcatggcacctggcatgtaatgaacacctctggtaactgtttttaccatgatccttaggatttttgttgtgtgatcttggagaacccctttttgctttaagttaatatcttatagactgcaaaggttaggtgttaatcaaagtttcctcccaattctaaaatatcatgtttctacactaagtacctcaattagagcattgttataaagatacttgtggaattctggctgcagtgagcataggagagaccatgggaagatgatgttctctggggtctagattgatgtcactgtataaatgaaatatttgttataacagatgtttctggccgggtgcggttgctcatgcctgtaatcccagcactttgggtggccgaggcaggcagatcacctgaggtcaggagttcaagaccagcctggccaacatggtgaaaccccatctctactaaaaatagaaaaattagccaggcgtggtggcgcacgcttgtaaccccagctacttgggaggctgagggaagagaatcgcttgaacccaggaggtggaggttgcagtgaaccaagatcatgccactgcactccagcctgggcgacagagcaagacaccatctcaaacaaaacaaaacaaaaacaacaacaataacagatgtttctgagacactataaggaccagaagtacattatttttatttattttattttttgagacagagtctcgctctgtctcccaggctggagtgcagtggtgcggtcttggctcactgcagcctcccgggttgaagtgattctcaccgagtagctggaactacaggtgcagccaccaccccaggctaatttttgtattttcagtagagatggagtttcaccatgttggccaggctgttctcgaattcctgacctcaagtgatcctcccgccgcgtcctcccaaagtgctgggattacaggcatgagccaccactctcagcccctagtccattttgaattgccctagtccactgagagaagctgtgaaatgctggccaaaccactgaacggctatgtaggttgggagtaactaatctcatgattcatctcagtggatagcttatgtggtatagtttagagaaaatgagtgctgcagtgcccagagttggggagagtttggggaactggcacactcctggtaatgtaagtgggtgtttttttcttctgagggacattttcacagtatgtgtcaagagcttttgacccagcagttccacctcttaagatttatcttaagggaagaattatggatgtgtacagaaatttagctacaaggatgatgctttagcagtatctttaaagtgaaaatattggaaaaaggctgaaaatcaaggataagtaattatggaacagatacagccattaattgatatgtctatatttattgacatacaagaatattcataatatgtgaagcagattcaaactgtcaatgattcatttaaaaaaataatagtttgtatatatatgagggagaagacatctggaatagtgtagcattataggtttatttatttatttatttttgagccggagtctcgctcttgtcacccaggctggagtagagtggcgtgatcttggctcactgcaacctccgctgcctgcgttcaagggattcttatgcctcagcctcctgagtagctgggattacaggtgcccaccactgcgcctggctaattttttgtatttttagtagagacagggtttcaccattttagccatgatggttttgatctcctgacctcgtgatccacccgccttggcctcccaaagtgctgggattacaggcgtgagccaccgtgcccggccgcttttttgtatttttagtagagatggggtttcaccatgttggccaggctggtctcaaactcctgacctcaggtgatccatccgccctggcctctcaaagtgctgggattacaggcatgagccactgcgccacactagaaaggtattaatttaaataaacatttattcaagtgattactggcatctacctcccttctaagatacagatacttttaagtacatgtcgttccctggataaaaacaaatggctggccgggcgcggtggctcacacttgggaggccgaggtgggtggatcacttgaggtcaggagtttgagaccagcctggccaacatggtgaaatcccgtctctactgaaaacaaaaaattagcaaggtgtggctgtgggcgcctgtaattccagctactagagactgaggcaggagaattgcttgaacccggaaggcagaggttgtggtgagctgggatcatgccactgcactccagcctgggggacagagtgagactccgtctcaaaaaaaaaaaaaagacaaatggctcattgggtttcattggcaaattattggccactgagtgtggcctttaggctatttatcagattactttcagctattttattaactagattaggcttgagtaggagctgactttaaaccttcacaggtttccacaagatagagtgcaaaacttcgtacgcaggagtagggaggggcctatttaacttgttcccttatccttgcttctgttcctatgctgcatgttgtgactcttacgtgtatttcaaagttgtcgtctttatactcagaaatagtattttttgagaatatttctaagaaaagacaacttatatttgacaaaactgtgttgaactcttactatgtataatgcactgtgttaagcaccttgatggttggatggatggatggatggatgaggtatacacaagtgagtaaaatctatctttgtttttaggaacttcgagtctactgggagagacatttacatagttaatataaaattggatgataagtgttacagtggagatataaacaaagcacaattggctttggagaggcaacaattttgtatgataggtggaaattgggaaagagttcatagagatttgacctggactttgaatgatggataagattttggttggtaggcataaaaattagtggtgtattttagaaattgggttattcagggcagagagagaataaattgggctagaggaggctagaaatgagaaaatggtaaattgagggaaaataatgacatggtgaatgtaaaacacctagcacagtgtagatacttatcaaactttgcctcttttaaaaaacatttagaaaatttatttatttattttatttttatttattattattttttttgagacagagttttgctcttcttgcccaggctggaatgcaatggcgcgatctcgactcactgcaactttcacctcccaggttcaagcgattctcctgcctcaccctcccgagtagctagaattacaggcgcctgccaccatgcccagctaattttttgtattttttaagtacagaagaggttttgccatgttggtcgggctgatcttgaactcctgacctcaggtgatccacccgcctcagcctctcgaagtgctgggattacaggcgtgagccactgctcctggcctaaaatttatttttaatttcaattttttctttttggtttttctttatatttgctgattacttaaagataatttttatttttttagagatagggtcaactacttacagataatttttatctttttagagacagggtcaactgttatacttagagataattttaatttatttagagacagggtctgtctatgttttgtaggctggacttggactcctggtctcatgtggtcctccctcctcccaaaatgctgggattacagacgtgagccactgtgtctggcccacttctttctaattccaaacatatctacctcaaggagtatctttaagttacctgaaaaactaatgtttaggttgattggacaaagtaaggctattttcagtaaattctaggtggtttgcaaaattacaaacgtggtagtaaaaccaaagtaatgatgggaatttacttagatttatgtgcaaccatttctttcctcagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttggtaagtgcctgctttctctggctattttaaggattagtggcttgctttgtgctgaagacctttcaataatagaaggggttgcaagaaaagaactaaaatatcaacttctttctgcaccaagacattctgtcatccatgatattatgggaataattgaaatgcccagtatttggggaatggattgtaagtacaaagcatatgttgttttgtagttcagaatggcagatttaagctttagggacctatgggaaagttcagatgaaccagtgttcaacaaaactccatgctcaaatatgtctgtagtgatggcagccacataaaaactttgtctactatcattagggatagattatatcacagctaggatattgacattcatacaatctaccagttttactcagatttctccagttttacttgtatgtgtattaagttctctgtggttttatcacctgtgttggtttatgtgtctaccatcacagtcaagatcttttataattaccctcacctccctcctgccacccctccctcaattcattttttttttttttttttttgaggctgtagtctcgctctgttgcccaggctggagtgcagtggtacaatctcagctcactgtaacctccgccactcttgttcaagcggttctgcctcagccgcccaagtagctgggattacaggcgcccaccagcatgcctaactaatttttgtatttttagtagagacagtgttttgccatgttggccaggctagtcttgaacccctgacctcaggtgatccacccacctcagcctcccaaagtgctgggattacaggcgtgagccactgcgcctggccctcaattcatttttaaatggaaggattatgctactaagaacccattcccagaaacagtattgcttggccaatggtaagtaagaatgtggttacatttttacattactttgaaataatatctgagactagttgttgaggcccctttgattctttctctcatgtctccatcctccttatcgggagaaatcactatgaatatgtggtggggaacagaagtgagtccattgcagctgtacttatccgtatagtgcactgtccaaatgtgttgacaggtgccattttttggaaaaggactttaatggcatctagtggggatcctgagaggagtcgtctgttggaagtggtgtgggaggaagggtaaataaatacaagggccagctgtcctgcggggatcttccccatgcccttgcttcactggaactgtaaggaaatggctgggctgtctgaggatttctttttctaagcttttctttaaaataaaaaagaaaagaaaagattagcctaagaatactgttaaatacaatttggaagaaaaaaaatgaccccactatttttccaaaactaccttagttttaaaacatttttatttttttttctttttgtttttgccagagttcttttggctaacaaaactacctcagttttaatatattactttccaatttctttcccaaataaatagtcacatctttctacacagttgcaatcagaatgtacatgcacagggtagttattgctgtgtctcactgcattcctgaaactatcagtaggctgttggtagaacagacccttcactgctttgtactgacttctgggcacagtagaatctaagataaaatttcttgagagaacctagctctgctctaccctcacacaccccttattcctcccaccaccccactgaggaggaaactctgtaagactatacagtatctcttgtaagccctacagtttttgatggttacagttttctttcgttttttttttttttttttttttgagatggagtcttgctctgtcgccaggctgtagtgcagtggtgcggtctcagcttactgcaaattccaccttccaggttcaagcgattcccctgcctcagcttctcaagtagctgggattaaaggcatgtgccaccacgcctggctaattttttgtattttagtagagacggggtttcaccatgttggccaagacagtctcgatctcctgacctcatgacccacccgcctcggcctcccaaagtgctgggattacaggtgtgagccatcgctcccggctggttacagttttctttaagaggaacatgatatatttagggagtagataaagccagttcatatttgtatgaccctaaatgtgtaccaaacaaagataaggagttattcacaatgcagaatctgtacttttccttttttataatacattgttcaatgttgccagtttttagtgattgttcttatagtctatctcggatgtgtaatgtgtactttttcttttgattgctagaactttgcttgtacttgccacatgagttggaagtgtactggtagggagctttagtttgcattttaaatgcgtgatagtgatttgttttgcttccttgctgatcagacaatgatgatcttcccttttcacagaggagaaggccaatttggagaataagttactggggaagaatggaactggagggctttttcagggcaaaactcctttgagaaaggctaatcttcagcaagctattgtcacacctttgaaaccaggtaagaaaacatcttagaaaaaagctccttgatagaatggtgggacagtgttttagaagcctgaggttctgggaaaattacctaaatgctctatctctttgtttattattggtgaaatgggctaattcatttcatgataaatgtaaaactaatgatgtgctacacttaaaaaaaaatctcttggagcttaagctaacatagaatttttttttttttttctttaagatggggtctggttctgtcacccaggctggtggagtacagtggcacagtcatagctcactgcagcctcaaactcctgagctcttagtaactgggactacaggtgctcaacaccatgcctgactgatttttaaaaaattttagtagaggagtctttgctagccaagctggtcttgacctccgggcttcaagtgatcttcctgcctcaggggcttcccaaagtgctgggattataggtgtgagctactgttcccgggggctaacatagaattttattgccagatacgtaactgttatctttttgtgacaagatttaatgtaacctaacctgggtctgggtgggaaataaaacagcaagaaagaagactgtactgcttgccattgtacaagaattctttgagttatgtatctgattttaaaagatgatggatcgcttctcggccttttggctaagatcaagtgtaaaagatgattgacatttaaactggtgggtactggatctgcagaatattgtctgtttggttagaacataagaagcattctttaagaggtcataaaatccttcttgaaattgattcttttgaaaaaaacagctgtatttagatttaactcacacatcatatgattcacttaagataaacatttcagtgtttttaagtatattcacagagttgtgcaaccatcatcctatcagtttagaacatttgaaaagtattatgtgggtaaatctgaaactggtctccatcacaccatatgactactctcacctccctcctgtcacccctccttcaattaatttttttttttttttttttttgagactggcgtctcaccctgttgtccaggcaggagtgcagtggtatagtctcggctcactgtaacctccaccacctgggttcaagtgattctcctgcctcagctgcccaagtagctgggattacaggcgcccaccagcatgcccggctaatttttgtatttttagtagagacagggtttcaccatattggccaggctggtctcaaactcctgaccttgtgatccgcccacctcggcctcccaaagtgctgggattacaggcgtgagccactgcacccggtcaatatttatctttctatgcctgacttacttcacttaacataatgtccttcaggttcatccatgttgccatgaatgacagaatttcattcttttttatggctaaatagtattccattgtatatatatatgccacattttatctgttcatctgttgatggatacttcagttgattccatatcttgactattgtgaatagtgctgtaataaacataggagtgcacatagatatctcttcgatgtactgatttccttctttttggatatatacccagtagggggattgctggatcatatggtaattatatttttaattttttgaggagcctccatactgttttccataatagctgtactaattgactttactactaacaatatataagagttctcctttctctgcatcctcagggatgcagagaaatttttaatatttttcatagtgtccattctaactgggatgaaaggatatctcattgtgatttttaatttgcatttccctgatgattagtgatgttgagcattttttcacatacctgtttgccatttgtatgtgttcttttgagagatgtctgttcagctcatttgtccggctgttgagttatttgagttccttgtgtattctggatattagtcccttcttgaatgaatagttagcacgtattttctcccattctttagttgtctcttcactctgttgattgtttcctctgctgtgcagaaagttttaaatttaatataatcccatttgtctacttttgcttttgttgcctatacttttgaggtcatgttcataggatctttgcccagaaccgtgtcctaaagtatttcacctatgtttttattttattactttatttatttatttttgagacagagtctcactctgttgcccaggctggagtgcagtagtacgatctcggctcactgcaacctccgcctcccgggttcaagtgatcctcctgccccaacctcccaagtagttgtgactacaggcgcgcaccaccacacccagctaatttttgtatttttagtagagatggggtttcgtgatgtcggtcaggctggtcttgaactcctgacttcaagtgatcctcccacctcggcctcccaaagtgctgggattagagtcatgaaccaccgccctcggcctcccctatgtttttagttgtttcatagtttaaggtcttacatattagtctttaatccattttgagttgatttttgtatatggtaagaaatagatgtctagtttcatttttctgcatttaaatatctagtttgatcagcaccattttttgatttttcaaatttaaattttattttagagatgaggtcttactctattgcctaggcttgtctcagaattcctgggcttaaacaatcctaccacttcagcctcccaaagctagcaccatttattgaaaagactgtccctccaccaaggaatgttcttggtgctgttgtcaaaaatcagttggctataaatacgtggattttttcctgggttctctatcctattccatttgtctgtgtgtctgtttttatgccagtaccatgctgttatggttactatagctttgtaatgtattttgaaggctggtaatttgatgccttcagctttgttctctttgcataggattggtttggctatatggggtcttttgtggttccatgtgaattttaggttttttttcttgagacagagtctcactcttgttgcccaggctggagtgcagtggtgcgatcttggcttactgcaacctccgccccccgggttcaagtgattctcctgcctcagcctctggagtagctgggattacaggcatctgccaccacccctagataatttttgtatttttaatagagatggagtttcaccattttggccaggctggtctcgaactcctgacctcaggtgatctacctgcctcggcctctgaaagtgctgggattacaggcgtgagctactgcgcctgtcctgcttatacattatttatggctgttgtattcttactaatttttctttccatttgttccatcaattagagagagaggtagtgaaatctcagactgtaattatggatttgtctctttatctttataatttttgcttcatatagtttgaagctactattagatgcataaatgtttaggattgttatgtcacgttgatgaattggccactttaatttaatttaaatttaatttaatttaaatttaattttttttttttttttggctggacgtgatacctcatgcctgtaatcccagcactttgggaggctgaggtgggcggatcacaaggtcaggagttcgagaccagcctggccaatatggtgaaaccctgtctctactgaaaaatacaaaaattagccgggtgtggtggtgcgcacctgtagtcccagctactcgggaggctgaggtaggagaatcgctgaaacctgggaggcggaggctgcagtgagccaagatcatgccactgtactccagcctgggcgatagagcaagactccatctcaaaaacaaaaaattatatacatatatatacacacacacatacacacatatatatacacacaagcatatatatatgtacatacatctaatatacatgtatgtgtgtatatatgtacatatacatgtatgtgtacatacatgtacacatacatgtatatgtatatatttttgagacagggtctcactctgtcacccaggctggactgcagtggagcaatcacgcctcactgcagcctctacctcctgggcacaggtgatcctcttacctcagcctcttgagtagctgggaccacagatgccactaccatgcctagctagtttttgtattttttgtagagacagaattttgccatgttgcctaggctggttttgaactcctgggctcaagtgctccacccacctcagccttccaaagttctgggattacaggttgagccactgtgcctggccccactttaacagtttgaaatgatcttctttatccccattgaaattctgtgctctgaaacctactttgcctgatattaatatagccactctagttttcttttgattggttttagcatggtatgtctatatttaaagtgcatttttttgtagacagcatataattgggtcttgctttattatttaatattattgttgctgcattttaattggaataaatgcatctattttagccttgacatgctatgctattattttgtgtgtgcgtgtgagtctctctgccccaaaaatatttctttaggagatgaaccaaatgattgttctctgaaatgaataatgcctaaactatgttttcatggcctatcttttcttccctgtcatcttgttgcagtttaattcctttatcaggagtcagttcatatgctatgtgattaagtgctgtttcttccatgaagcctttacttgtttcttattctgttttgtttttttgtttttgtttttttttttgcagacagggtctcagtgtgtcaccccatctatagagcagtggcatgatcacagctccctgcagccttgacctcctgggctcaagtgatcctcttgcctcagcctcctgagtaactgggactacaggcacattccaccatgtctggctaactttctcagtgttcccataacactttttttctatttcgttaaaaatgtttatcaaggctgggcttgtagttcatgcctgtaatcccagtactttgggaggccaaaatgagaggattgattgaggccaggagtttgagaccagcctgggcaatatactgagacccccatctctatttatataatattgaaaagcaaaaaaaaaaaaaaaaaacgtttatcaaaataaaacatggccatggtaacatggctaacaatacttagagtttatgttaaaataacccctttctcttcccatccctaccccctgtcctttttctcaaactcatattggttttgttgttgttgttgttgtttgtttttatattttgttttacaggtgggatctcactgtgttgcccaagctggtctcaaaatcctgggctcaagtgatcttcctgcctccgtcttcccagtagctgttttaactcactattttaacttgtgctgtggttacattcataatgcctgatagtatgattatatcagcagtatttacaatgttatgattatataaatattgttcaatgccagatcaataactgtgatgcagttgcatcccttcttggtactctttggctatctttggttgtattgtcacaacccctgagccacataaagatgattctgacatcaggagatcagtggatttgcttttctttaaactttatcaatttcttaaatttctgccacactttatcttgcttcatattggacaatgatccttggaagttattactacttttttgggagagcattattatttttactatctttgctgccttgtttcctggaccttataactttcttctggatatactccttcattatgtgggagtgcatcctcaggaaactttcttaaattagtgcaggagagaaaaactttgagttctcacatatttgaaaatggcattgtttcacttttatatacaattgaaagtttatcttaatacagcattatagattgcaaattattttttatcactactctaaagacattgttcctttatcttctatttttatgtattgctgatgaaaaattcagtgcttatctaattttccttactttgtaagtgattttttttcttctttatggaagctttcagaattttatctttaccagtgtcctgaaatgtcatgagattgtgtttgggatgctttttttaaaggtagtaccttaggctggcaaataggcaagccctggatacatcatttctgtttcaaccaaagtagcttttataaactggtcttctgtataagatttaactggaactaaggtttctgtggcttagacagggtgtgtgtgtgtgtgtgtgtgtgtgtgtgtgtgtgtgtgtgtctcatctccaattattttccttggcctttgagtgctgactagcttttggtcttccgcagttgacaacacttactacaaagaggcagaaaaagaaaatcttgtggaacaatccattccgtcaaatgcttgttcttccctggaagttgaggcagccatatcaagaaaaactccagcccagcctcagaggtaagactttggaatctcaaagtggtggttatgataataatgttcaaaggatagttactggacagaacatctattatgtgtctatactgtgtttatggacacctttatgttactttttttttttttttttttttgagacggagtgtttcgctcttttgcccaggctggagtgaagtggcatgatcttggctcactgcaacctctgccccaccgtgttcaagcaattctcctgcctcagcctcctgagtagctgggattataggcacctgccaccacacccggctaatttttgtatttttagtagagatagggttttgccatgttggccaggctggtctcaaactcctgacctcaggtgacccacccgcctcagcctcccaaactgctaggattacaggcgtgagctactgcgcccagctatgttacctttaaaaatcctcataatatgggtttgtgtggttggtataaattaaaaaaaatctgtataacatttatgagttgtaggtaatatgcttaattaatttatagataaggtctcagagatactaagttgcttgcttaaggcaagtttatttcagagccaagattcaaactcttatcaatctgtttccaaaggccttgtatggatataattgttacatcttcctgatgtcaaatatctttgttcttctgtattactttagctctctttttcttttttttctttgagacagggtcttgttctgtcacccaggctggagctggagtgcagtggcacatagttcactgcagactcgaactcctgggttcaagtgatcctcctgcctcagcctcccaaagtgctgagactatataggcataaaccaccgcatccagccaatagacaaatttttattttatttatttttgagacagagtcttgctcagttacccaggctggagtgcagtggcatgatcatggctcactgtagccacaacctcctgggctcaagcagtcttcccacctcaacctcctgcgtagctgggactacaggcacaagccactgtgctcagctaatatttttgtatttcttgtacagacaaggttttacgatgttgcctaggctggtcacaaactcgagctcaagcaatccacccacctatgcctcccaaagtgttaggattacaggcatgagccactgcacccaggccagagtagagtttataatcagagtttagtgtttaccctctctgtggttttcttgcttctgaaattttgcctcaaaaatttcatcttttttttttttttgagagagggtcttgctctgttgcccaggctggagtgcaatggcatgatcttggctcactgcagcctcgacctctcaggtgtaagcaatccttctgccttagcctcctgagtagtggagactacaggtgcagggcaccaggtggccagctaattttcgtattttttgtagagatagtgtctttccatgttgtccaggctggtcttgatctcctgagctcaagcgatctgcccacctatgcctcctagagtgctgagattacaggcgtgagccaccatgcccgacacatgccatccttttttttttttcagacgagtctcgctctgtcgcccaggctggagtgcagtgggcgatcttggctcactgcaacctccgcctcccgggttcaagtgattctcctgcctcagcctcctgagtagctgggactacaggcgcccgccactacgcgcggctaattttttttttttttttgtatttttagtagagacggggtttcaccgtgttagccaggatggtctcaatctcctgaccttgtaatccgcccaccgtggcctcctaaagtgctgggattacaggcgtgagccactgtgcccggccggaaagatttcttaaacaggacacacacagaaaagcactgaccataatgggggtggaagaggttgataaattcaggcacatttatctaattaaaagataaagagatgaaaagccaacccctagagtaggagaaactatttgtaacccatgaatcctacaaagggcttatatccagagtatacaaagaattacaaatcaattagtaaagaattgacaagccagtagaaaacaggcaaacgacttaaactagcacttacgaaaagggacaaccaaatggccgatacacatgtgaaaatgtactcagtttcactgatcatcagagaaaagcacattaatttcctatgacccagcaatcttattttttttagaatagttaaaatgaggagataacccatcaatagtagactgaataaatagttgcacatccctacaatgaatattatacagcaatgaaagtcagtgaattagagctgtgtgaattgtcgtggttgaatctcacatacataaagttgagtgagataagccagacagaaaagaatacttgtagtagtgtggttacattatacaaaatttttgggtgcagcacaccagcatggcacatgtatacatatgtaactaacctgcccattgtgcacatgtaccctaaaacttaaagtataataataaaaaaaaaaaaccacaaaattttttgtttttcttcgaaactaacataccatgtttacgtaatacgtgcttatttggtaaaacaataaggaaattatctaatgatcacgctttttttttttttttttcaaggcggagtctcgctctgttgcctaggctggagtgcagtggtgcgatctcggttcactgcaagctccgcctcccgggttcacgccattctcctgcctcagcctctcaagtagctgggactacaggcgcccgccgccacgcctggctaattttttttttctgtatttttagtagagacggggtttcaccatgttatccaggatggtctcgatctcctgacctggtgatccgcctgcctcggcctcccaaagtgctgggattacaggcgtgagccaccgcgcccagcctatctaatgatcactcttaaaatcaaggtagcagtggttgtcagtgttctgtattttggcctaggtggtgatttcataaggtcttccactttgtagtcatttaagtatttttgttttgtgcactttttggtatgtattagatctgtcattatgctctttgttttgtattcatcttattgatttatttatttttagacagagtcttactctgttgcccaggctggcatgcagtggcacgctcatggcttactgcagccttgacctcctgggctcatgtgattcttccgccccagcttcctaagtatctagcaccacagatgcgcaccagcacgtagggctaatttttaaaaaattttttgtagagacagggtcttgatatgttgcccatgctggtctgaactcctggcctcaagcagtcctcctgccgcagctttccaaagtgctaggatggcaagcatgagctaccaggcccagccaagtttttctttttaatcattttattgaggtcacatttatagacaccggtgtatttaagaactaaaatgttatggttgaatttcaaaaactatcaacaagagagattagatttttagagcagagataatagcactccattttattgccctttgtagtttgacatcctttcacatttctcaggaacatttggatatctgtagtatatatatttattatatattttgtcaatttctctaccatagaagatctcttaggctttctgctcagaaggatttggaacagaaagaaaagcatcatgtaaaaatgaaagccaagagatgtgccactcctgtaatcatcgatgaaattctaccctctaagaaaatgaaagtgtgagtagccacaacttcttactgccaagggcagacatattgtaccttgtataccacttgtaagtttcttttctgaatttacactttagattgaatagattaaaattaaaaatggtacatctgtaatatgtttggtgtacctcaagcttgagaaatgcctaaaactgtgaccatggtgaggtgaattgttacgtgtgtcctggagggcactcacatcttagttggcataggttttacctctttttgtttttacggctaataacaagctgcatacatgatgtttgtttatatttttattagttaagaatgtattttgctgcaagtaatagtcttcaactggagtggtttaaagaataatgaattatttgtttcacagaggtctaaaagtagtttgctgctggctttggttcagtggctgatttttagctttttttttttttttttcgtacttgttcttcaagatgctgctctgtgtttcttagattttttcttttgcttgttgtctcactggcacaagatggctggtgtatctctaggtgttatatttatgtttaagagaagaagaagagtacagtaaaggaaaaagggcagcatctatatcaggaaacttaagtctttcgcagcaacccttaaatttcatttcattcgcctagacttgtgtcacttggattccctagttgcagtagaggctgttgaggcaagtacaatacttacttgtagcttagtgcgttgctgctcctcccgaaattggggttttgttaatgagaaagagacagaatagatattgggatggcaattaactctgccatttgatcatttgatggtgagcagttagagtccctccttactcttccaaaccaccactagataactcttatcttgatagcggttggctttctcaaagtttactcattgaagccattaatatatatgatctaatgatactgttggaagaatcatgtggtcgaagcatgcttgttatcctatagaatgagaaaatttaatccatatgcagtagatttggggaggagggtacaggctatgcttcagggaattgaaaacatattttttgtccttttgaactcaagttctaacaacaaaaagaagccagaggaagaaggcagtgctcatcaagatactgctgaaaagaatgcatcttccccagagaaagccaagggtagacatactgtgccttgtatgccacctgcaaagtaagtttctttcctgaatttaaactttagaatgaatggtataaaattacagatttacatctacaacctgtttggtgtacctggaggttggcaaactcctgaagctttgaccatggtgaggtgaattgttacatgtgtcctgatgggtgctcagatttttaaatttttatttaattaattaattttaaagacagggcctcattctgttgcctaggttggtgtgcagtgatgcaatcatggctcactgcatccttgacctcctgggcttacgtgatcctcccacctcagcctcccaagtagctgggactataggcatgcactatcatgcctggctaactttttttttttttttttttgagacagaggctcactctgtttcccaggctggagtgcagtggcatgatcttggcttactgcaacctctgcctcccgagttcaaacaattctcctgcctcagcctcccgagtagcccggattacaggtgtgcaccaccacacccggctaatttttgtatttttagtagagatggggtttcaccatgttggccaggctggtctcgaattcctgactttaagttatctgcccaccttggcctcccacagtgctgggattacaggtgtgagccactgtgcccagcctacctggctaacttttacatgtttttgtagagatgggatttcactatgttgcccaggctctcaaactcctggcctcaagcagtcctcttgccttggtctcccaaagtgctgggattacagatttgagccacagtgctggctggtgctcagatcttgaacagtcagaaaaatatactgttgaagcaaatttaaaagaaatataaaaggaaaaagttagcaacagttcttaccacgtagattgaacattttttatttttccaacctccctgctggattttacccaagccagcatacatattttcacaatcagttaatacaaaaccttgggttctgctttattgacttgccatgagattatttcagattttgtttctgtgctgctacaaaattttcacatttatccttttttgatagattgttaatattctatcaaaatatatttaactattttctgttgaaaatgtagtttccagcttttcatgattataagtactcagtcaacaactttataggcagaaccatttctttgagtgatcttctcagaataaggaaggagaaattccccacagggtatgaccagttttgtcagtgttgatatttattgccaattttacttctgaaatggaagtaccaatttatagtgccatcggctttttttttttttttttttttttgagatggagtctcaccctgtcacccaggttggagtacagtggcgcaatcttggctcactgcaacctccgcctcctgggttcaagtgattctcctacctcagcctcctgagtagctgggattataggcatgcatcaccacacccggctaattttttttttttttttttttttttgtgagacggagtctcgctctgttgcccaggctggaatgcagtggcacgatttcggctcactgcaacctctgcctcccacgttcaagcaattcttctgcctcagtctcccatgtggctgggattacaggcacctgccaccacacctggctcattttttatttttagtagagatggagtttcaccatgttggccaggctggtcttgaattcctgacctcaagggatctgtctgcctcagcctcccaaagtgctgggattacaggtgtgagccaccatgcctggccccggctaatttttgtatttttagtagagatggggtttcatgatgttagccaggctggtctcgaactcctgacctcaagtgatctgcccgcctcagcctctcaaagtgctgggtataggtgtgagccaccatgcctggcctgaagtgccattggctttgaatgaatatttttattttcttattatctcatctgcattgtttattaacttataaaattgtttctttttttaaattcatatagatggcatgaaattattattttaaaaatttaattgtaaattgataatttatagttgtatatatttatacagtacaaagtgatgttatgattcatgactacaatttggaataattaaatctagctaattaacatatctgtcacctcaaatacttaccactttttgtagtgagaacatttggatttttttttttttttatcgagatggagtttctctcttgttgttcaggctggagtgcagtggtgagatctcagcttactgcaacctccgcttcccgtgttcaagtgattctcctccctcagcctcccgagtagctgggattactggcacttgccactatacccagctaatttttgtatgtttagtagagatggggttttaccacgttggccaggctggtctcaaactcctgacaggtgatccacctgcctcagcctcccaaagtgctgggattacaggcatgagccaccgcgcctggctggaatttattctcttagtgtattacgattactaatgatatcctccaccctgtgcagtagagcaaaagaaaaatctttttcctcttgtctgagatttgttgtactctttaatcgtcatctccccatttcccccaacccccagcatcaaattattttaatttttatgtatttgctgacaagattgtattactgctactattgtaaacatttttccatatttcctcttgggtgaattatctgtttcctttttattttttttcttattggtaaccttatttgcctataagtgtccttggtgatattttccttactaagaatggatactctgtgttgaacattaccatgtgtcaagcacttcagagacatcatctgattgaacagtcataaataggatgtgaacatgagtatttacactcccatttcacagtggggaaaactgaggctcagggaagttaaatagttttctcaagatcattataggcagcaaatgaaatgacagggttgggatttagtcggctttacttctgagtttcttccttctgttacatgtgttttatgtgtattaaccctaggttgtagatactttcctcattctactggtctttttttgtttttgtttttgagacagggccttgctgtgttgcctaggctggtcttgaactcttgggctcaagcaatatttttgcctcagccttccaagtagctgggattacaagggcatgccattgcactaggcttctactggtcttttagtttttcttgtggcttacaacctaatcttttttgttgttgttgctgttgttgtttttggagatggagtctcactctgttgcccaggctggagtacagtggcgtgatcttagctcactgcaacctccacctcccgggttctagcgattctcctgcctcagcctcccgagtagctaggattacaggtgcctgccactacatctggctaatttttgtatttttagtaagatggggtttcaccatgttggccaggttggtctcgaactcctgacctcaggtcatccacccgcctcggcctcccaaagtgctgggttacaggcatgagccactgcacccagtccaatctcatcgtttatgatcatatttatggatattttgtaatatattttaatctattttagttattttcttctgaaattttttcagtattttggtataaagtgtgcattttcttgtctttatttatttattttttttgagatggagtctcgctctgtggccaggctggagtgcagtggcgtgatcttggctccctgcaacctccccctcccaggttcaagcaattctcttgcctcagcctccccagtagctagaattacaggtgtgtgccatcacacctgcctaatttttgtatttgtagtagagacaggattttaccatgttggccaggatggtcttgaactcctgacctcaggtgatctgcccaccttggcctcccaaagtgctgggattatagacatgagccaccatgcctggccaaagtgtgcatttttatttattttcatggtgttatctaattaagttagcatctatttattagatgatattttttggttttgatgattatcttatcacaggttaaaaatattatataatgcctgtagattcttttgagtcactgggtgcctttctcctctcctctcttctcatttactgattttctctttaggcagaagtttctaaaaagtactgaggagcaagagctggagaagagtatgaaaatgcagcaagaggtggtggagatgcggaaaaagaatgaagaattcaagaaacttgctctggctggaataggtgagcttggctgtggttgagtctgattcatgaggggtggttcttaacactcttggtaggtgtttttttttttttttttttttttttttttttttttttttttgagacggagtctcgctctgtcgcccaggccggactgcggactgcagtggcgcaatctcggctcactgcaagctccgcttcccaggttcacgccattctcctgcctcagcctcccgagtagctgggactacaggcgcccgccaccgcgcccggctaattttttgtatttttagtagagacggggtttcaccttgttagccaggatggtctccatctcctgacctcatgatccacccgcctcggcctcccaaagtgctgggattacaggcgtgagccaccgcacccggccagtaggtgtttttgaagtctctgaagtaaataaaaaggctttctcatttagtagtcagcataaaaaagatgtgtttattccttagcactttctacatatattggtattttacatatattggtacttaaatatatcggtactttctttctttttttttttttctgagacagagttttgctcttgttgcccaggctggagtgcagtggcgtgatctccgctcaacacaacctctgcctcccgggttcaagcaattctcctgtttcagcctcctgagtagctgggattacaggggtccaccaccacgtctggctagttctttgtagttttagtagagatgggatttcatcatgttggccaggctggtctcgagctcctggcgtcaggtgatccgcccacctcagcctcccagagtgctgggattacaggcatgagccaccgtgcctggctcactggtactttcttaaaagtctgttcttggtcttagggaaaaaaaggaacttggattgagacagaagataaagtaattgggcagaccagtttgttgttttcctatttttttctaaaggcaaaggaaaagaaaacagtcaaatccaattcacctgtggaggaaaaatatgactgagagagctgaaggggtcacagttctgctttgctcgggcatagagttgttattggtggagtcataactataaagttctccttactggattgaaaaagcacccctggagtttataggattttcctcttagagatgctgagttaactgtgctttcaaagtcaatccatagcttttcttatcaaaagtattccagttattctttttctccatagctatgaccacacctaggagatgggattcttctaccctgtgctactacttttttttagtttgcatctgactgaaaggcctcaaacctaatagtactcagtgaatatgacacatatattagtgtccctgaggactacttcaagttttgggttacaggtagatagtaagcaaagttagatccatggtgacagaaatagcaaaaggactggagtaaaggggatttactggtgttccctatcttaatgttgtctgtatgttttactgtgttcatctctcagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgtaagttgatggactaaatgaacatttctgttactaatattcatttaggattttacgtgtagcatttgtggtcactgtttataatagtataattgagaaaaaaaaccttgtgtctataaagttgtgtaaaatataacagatctttttttttttttgagatggagtttcacttttgtcgcccaggctggagtgcaatggcacgatttcggctcactgtaacctccgcctcccgggttcaagtaattctcctgcctcagcctcccaagtagctgagattacaggcgcctgccaccactcccagctaatttttgtattttgtagagacagggtatccccatgttagccaggctggtctcaaactcctgacctcaggcgatccacctgcctcagcctcccaaagtgctgggattacaagtgtgagccatcatgcctggccaatataacagatcttataggaaaaatagggttggggcagaccagtcaaatctcatgcagttttgttaccagagcaccaacaaaatcagtaataatcgttaagtaaaaatgctagtactaataatctccacttgcatttgtagtcagtatcatcattttttgaaattagttatttgcattcttaaaccctgaggttatgcttctttctttgagatacaggtccttgaagggttttgcttccaattagagaccagttttatcaaaattactggtccaaggaataggaataggcttcttcatcagtctctttaggggatgtatggagagattccactgattcaggaagctgcctgacctgatgcatacccagaggcccaatcaatttttttttttaaagtggagttgagggtgagatttctttgcagtgctttttgtcttcaattctaagatagcttactctggattccttcaaaacattgacatggttggggggaaattacctatgtactattccagaacataagatttgttaagtgctagatcctttcttccatttttaattttttttaatgagaacagattagttataacccttgctcaaggactgacaaacttcagaataataatcttggttttacacaggccttttttattgatcctctgtgccgaatatgtggcttatggtagatgtgagctcttccgtgacatttcatttggggaacaacttttctctttacaggcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattagtaagtttcctaccagtatcacagttggatggaacctctcctacattccctctgcttacatcttaggcacagatttgtctttagctgaaatcctagtttttcaattaaagtatggcgtgtgactatgcagacaacaaatgtatccttcagaatttttcaaaccacccagctgtctgtcttatacccatcaaccgtcttgatcctcctcatcaataattggccaaggggaatgagttaaggtaacctgagatgtcattacacatccttaacggacatttttttgccatgtgtcaaagtgtcacattgcatttagttacctatagaaaatgaaggcatttcattcattcaaggctatgtgctttttattcagtggtccaccaaaatttttactactactaaccaggcacactgtgttaggtatatagaggtaaataaaatagacttggtgctactcaacatcaggtttctaattcaagtttcaaaactcgacatcaagtttcaaaagcctttaccataatttgtagtgacctatttatctctgtcattagagatacactaattagttctttgcattcttaaactgtcattagataaacaggtcactacaaattatggcaggggattttgaggaggagggaggtgcaagagtcaaaggaggtgggagatagggagagcatgtctgaatgttgagaagtctcgtcagagataaagaagctgaaggtacgagagagaggagataactaatggattaagtccctgagcaggcaggtattggagggatacttagcacaggtggagtgagtgttctttaaaaggaggatggaagagtgggaggaatgggtgcaaatactgggggagtttgtagatttggtggtgagcagatgagcggattctaatgtaatagtttctatctttatggaaataatttctgcaagaaggaagatgaaatctgaagggtggaggtggtattaaatagttgttgggagtatagggatagtattctggataaagcagaatgtggttgttttacctttgaggatctctaaattttttatatccttgcataggcattttttttgagacagagtctcgttctgggtgtcatcacccaggctggagtgcagtggcgcgatctcgactcactgcaacgtccacctcttgggtgcaagagattctcgtgcctcagcttcccgagtagctgggattacaggtgtgtgccaccatgcccagctactttttggattttaagtagagaccaagttttgctctgttggccaggctggtcttgaactcctggcctcaagtgatccgcccgcctcaacctcccaaagtgctgtgattacaggtgtgagccactgcgcctggccaagtacagcattttttaatattattattatgttctagtggccaaaatgattttgttagattttatagtatgaaaataatgaaatattcttctttattctaatggaaatttaaatattaagcataacttttcaaataatatatgactcagagtctgatatgtcctgctttcagaatactagtcctggcaaaaggaaagagaaattatattatgcaatttttatttaaaactttgtacagttacagctaaataatggttacatgtatctttgaaacatggcttatttctaaaatagatttggttttgatctaccactgttatgtgacaagacctaaattgaaagattcattctatattagttatgaaaattgacaaggtttcactggccaggtaaattaatattttcaatgagtggtggtgatgtcttaatattgatgctttaacatagtttttaactttctccatttgattttctgtaagatgtggtcttgatgcttttatattgatttcataaaattgggagttttcacttggtcttcttttgttatttatttatttatttattttccttcttgttttgctttttagagacagggtcttgctccgtcacccaggctggagtgcagtggcgtgatcatggctcacttcagtgtccaactcctgggctcaagcaatcctcctgccttagccttccaagtaattgggactatatataggtgcatgccaccatgcttacctaatttttatattttcttaggagacagggtctcattatgttgcccaggctggtcttgagctcctggcctcaagcagttctcctgctttggccttctaaattgctagaattacaggtttgagccattctgttcaggctttacttggtctttaggaaggccttatatctttttttttttttttttttttgagacagagtctcgctctgtcgcctaggccagagtgcagtggcgctcatttggctcacttggctcactgcatgctccgccttccaggttcatgccattctcctgcctcagcctcccgagtagctgagactacaggcgcctgccaccacgcccggttaattttttgtatttttaatagagacgggatttcaccgtgttagccaggatggtctcgatctcctgacctcgtgatccccctgcctcggcctcccaaagtgctgggattacaggcgtgagccactgtgaccggccaggaaggccttatatcttaaagctggaataagcaaaaattttttgtgttaataacaagcaaaataattggcattgtcaatagaaagtataggcctggccaggcacagtggcttaacgcctataatcccagcactttgggaggctgaggtgggtggattgcttgagcccagtagttcaagaccagcctgggcaacatagtgaaaccctgtctctacaaagaatataaaaattagctgggcatggtggtgcatgcctgtaatcccagctgcttgggaggctgaggtgggaagatcacctgagtccagggaggttggatttgtagtgagcctttatgcccctgcactctagcctgggcaacagagtgagaccctgtctcaaaaaaaagaaagtcagtctaggcccgtgcagtgataaggaacctgtcagacatggatggattttcagttcagaagatgacagtagagtttacccaaaggctaccttagtcatacccctcaataaaagaggaataggggagaagtaactgaatgttggttggtttgaccaatgtaagctgagctgactgttgtgggcccaccactctgtggttggtttatccctctctgggctacataggtgaatcaccacttacaagtaaactgggtcttgcggatctagatgaacatctgtcatctctgtttacagacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacagtaagtcccactggcagtatctgaggaagagttccacgaacctgcctactttattttcagttctgttagggtgacagttgctatttttctttccgtaaaaatttatggcatttgagtagtaggctctgcaggctacgcccctgcctatatgatttaaggactatagtgggaatatggagatgttctggagtataaactggtaaaaattgaatccaggctgggtgtggtggttcacacctgtaatcccagtaccttgggaggccgaggcaagaggatcacttgagtccaggagtttgagaccagcctgggcaacatggtgaaaccccatctctacaacaaataccaaaaaaaaattagctgggcatggtggcatgcgtctgtagtcccacctactagggggcagcctgaacccaggaggtcaatgcttcagtgagccaagatcacgccaatatactccagcttgggtgacaaagcgagactgtcttgcacatacacacatacacacacacacacacacacacacacacacacacacacacacaaaatctaatccagaggttgcagtagaagaacttacttaggatttcaattaaggaatgccctctaaggttaagttaggtagatcccacccttttgtgactccccaagggattgttacagctattattagtggagggaaatggaaacttagtgtgattcgtagcattggagtttatttcctgtatccttcttccattcctttttgtgcttcttttgaggagggggagcttcttctgtgaagtgaagcctcaattcttaagtggtagggatgttaggactgtctgatttattctttcttcttttattcttttattattttttatttatttattttttttgagatggagtttcgctcttgttgctcaggctggagtgcagtggtgcctctaagctcactgcaacctccgcctcctgggttcaagagattctcctgcctcagcctccctagtagctgggattacaggtgtgcaccaccacgcccagctaatttttgtatttttagtagagatggggtttcactgtgttggccaggctggtcttgaactcctgacctcaaattatctgctcaccttggcttcccaaagtgctgggattacgggcatgagccaccgtgcctggcccattgtttttcgtttttatttattttattctgttgtccagtcaatgggagcataatcttaatgattactattctttgtggttggcttactttgtttgtgaagttttcattttattaaaattttttttgtggttatttaaattttcaccttacagatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtggtaaggttgaggctatgtgtgctggcagaagtgtactgctcatgaccagatatccacccattcacacaaaagtttgggtagatattatgagcagggcatcatattaggaactgcaggtgataaagagacttatcggaagtggattttgcttttagttaactcaaagtctggtatgggagacaatatatgtgtgaataatagaaaatggacagaagtgttctgagagagatgacagttaaaataggaattcagaggagaaaatggtttcttccagatagaaagttcagggtgtgctttgtagagaggcacatttgacctgagccttgacgatgtactgtagtaatagttattgtgttgctattgttgtcataatagctgacaattttactgtgtgccaggactgctctaagcccttttcatatattagcccattagttttgacaacaacccctttaggtgggttattttatcacctgtttcagatgaggtaaccgaggcacacagaggttatgtagtattcctagagcactcagctagtacatggtggagcaagtaagagttcagacactctagctacagagtctgtgatcctaatacctcattatatgcctctccattacatgatagaattttgacttgcagaaatgcaaatggactggattggcagaacattccaggcagtaggaattacatgataaaaagcctgacggtgggaaacaagaagcttctactgggagctgttagtgggtcagttaagctggagaaaagtttatcaagagccactggaaactgtttcagagaagtgagttgtagtttgataataggctcacaaccacaagtttagagaaaatgtgcaatcaggaagcaaggctacagtcagagaataagcaatggagttaagcacctgcataaatgcgaaagcggcttttagttacatttcagtgcagatgaggacctcacccgccgccactggtttggattgcctggattgatgcaggtccgggataactctagaagcactctgttttcctatcttctttctttttgcttgctttagagtcaccatgcttttaggggaaactgcaccaatgtattacctttgactgagtacctagttttgtttattgtattttcttagcactaaatcagaagcaacttgaagttatattttccaggctttacaaaaatcatgattatgcttagaaatggttctcctccctgatacctacttttgattgagagctttttgcgtgacttctgttcacgatgcttttttttccctgccatgatgcatatgtactatatgccaagctctgttacaataaactgttaagaaatcttcccccacccaagtgattaatctccaagggctgtgccttctttgtctttacccattgaggaaacagtgttgtgaatacaacaagggaaaagtaggttatatgcaaacctcagagttgtagagccagaagggctcaacgtttagttttacatacaagataatggagccccagataagagaaattatttcttcagggtttctataacactcttttggcaccttgcttttggttttttgttttgttttttttttttgagttggagtttagctcttgttgcccaggctggagtgcaatggcgtgatctcggctcatggcaacctccgcctcccgggtttaagcgattctcccaccttagcctcccgagtagttgggattacaggcgcatgccaccacgcctggctaattttcgtatttatagtagagacggggtttcgccttgttagcccggctggtctcgaactcctgacctcaggtgatccacccgccttggcctcccagagtgctgggattacaggcgtgagccaccgtgcctggctggcaccttgcttttaataacatattttcctccaagcttttccccctacctaagtttttgtttttatttatgtaccactctctcaatttgtcctatatccttgtaccttacataccaatattattattttaaaaatcaactcactttgtaacctaacgtaaatttaaagggaacttttaaataaatatgtaaatggaaaaccagtaccttttgccacaaataacacagcaataatagctaatacttatataatgcttattacatgccaggtctttattctaagctttttacatttatataataatgcacttaattctcacaacaaccctatgaggtaagcactgtaggtacttaatccattttacagttaggaaacatagaggttaaataacttgcccaaaatcacaaactagtgagcggcagagctagcatacgaatcttaggtgatatgattccagggtccatgctgttatataaaaatagaggttaccttttaaaatagaaggttcttaggaagtatgtgcttatttaaaaaaaaaaaaaacaacagtctacacctcacctaagatcctttctcatagcatcagtcacacctgaactactgtttttttttttttttgagacaatctcactctgttgcccaggctagagtgcagaaatgtagtggtgtaatctcagctcactgcaacctctgcttcccaggttcaaccaattctcatgcctcagcctcctgagtagctgggaatacaggcacacaccaccatgcccagctaagttttgtatttttagtaatgactgggtttcgccatgttgcccaggctggtcttgagctcgtggtctcaagcaatccacctgccttggcctcccaaagtgctaggatagtaggcgtgagccactgcacccagctgaactacatttttgaaaacactgattaggaaattggtttgtcagttgtgtgtactctagaaatgctagggtgaagtagtaagtagggaagggtgaccagagttcattaggagttagttgagatcttagagtagttgggtaccaggttatacctgtgaaaattctgtgtaaacagatctgcaaagcactaggtaaggtgtgaccgaattgatacgatttgcggaatggaagtgtttgccaaatccagctggttctcagaatcctctggggctcttattacataaacagatttgttgggtacatcacagagggagcccagataaagcactgagtatggtgcctgacacgcagtaagcaggggtattattaatagtaattgtcattttattgagtgcttacattgtcctgagtactttatgtagattgtcttatttatgtctgattacacttctaagaggtggagtctatacttatccctatttttcagacaagggaataaacactgagaggtatctagtatgcagaaccagaatctgagcccatcatctccttaaacactgtattattgtaccctacaatgcttactgttatcatatttattttggcaaatgaggtttctgagtttgacactggctgtttgcaggtttccctactaaaatttccagtgatttgacttcaactcttggtttctagagaagcatagcataggaagagatgttagatgtgttttcttctacccgcttcacttttcagaaagggaggttttgaaaggggtgcaaaccaaaaagtatgagacaggtctcaatcaatttagaagtttattttgctaaggttaaggatgcatgcctgggagacaggtctgtacctttctccaaagatgattttgagggcttcatattttaaggggaaagggtggatagtggggaaaggggaagagattttgaaaaggtatgggtaggtaagaggcaaatggttgcattctttgttcacatgtgagagggggtagaggaatagttacttatgcattcatctagttcagtgaatctgcatttttacataagataattagggcagaggaagcaatcagatacgcatttctcaggtgagccaagggatgactttgagttctgtcctttgtcctgtacctgtgaagataagctatcaatttatattgtcagggtgaaattcaacagaactgttttagggtgaagaacttggggcccccaaggaattttcaagtgggcaaattgtgagggaggtatgtacctttttcatctttgaatgggaggcaggtttgcatgttgaagttcctagcttgacttttctccttggcttactgattttgggggtcccaagatttattttcctttcacaggggattatagcttgcctatggaaacatttaaaagaaacatttataagagagtaagtcggccaggcgcggtggctcacgcctgtaatcccaacactttgggaagccaaggtgggctgatcacctgaggtcaggagttggagaccagcctgcccaacatggtgaaaccctgtctctactaaatacaaaaaaaattagccgggcgtggtggcaggcacctgtactcctagctactcaggaggctgaggcaggagaattgcatgaacccaggaggtggaggttgcagtgagctgagattgcaccactgcactccatcctgggcaacagagcgagactctgtctcaaaaaaaaaaaaaaaaaaaaaagtctttgaacttctagtgttggacttttacagcagaatttaagagcccaccttccagagcctgatgcagcttgtctgtctgatgcttttgttccccatccacgtcccccccagtgctgaagctgtttcgtgtgtccttacagtgtttcctctgcacttccacttgtggttgataagtggcagggggacaataaatagagttgatgaaagatgggcttgggcagcagtgggcccaagtgaggcagaaatgagaaaaggactcctggggcagaggtggagtgacaaagccttgagcacgagggtgtgaaatgtgaacttggtgctgacctctattgggcagccggggcaccacggaggtggatgtggtgtcagtgagaccagtgagtaattttagcagagatactttagggatgacttggggagggcagcaggcttttttaaaatatatatacttcccaaaataacattgcttcagagtagtttcctaactgccctgggacaggcctgagatcctgtcccagggtacttggggggcacatcctgtcttagggagaggtattcacctccccattcccatccccagtcctggctgcttttcctaaatgcatcatttatccacccacattgccccattctaaccacatatcacctctttagagataccttccccttcattgagggagcatccctctaataaccattagctccatattctgctgggtttctttagagcacttgtgaaaatttggaagtatttaatttgttaaatcttcattgtctctttcctccattagaatgtgagctccctgagaacagggaccgtgtgtatctatattattcactctgtatccctagcccctagcatagtgaccaccacagcacaagcactctgatatcggataactgagtgagtaatagtagaagctgacatgcacctagacactaggaattcaaagatggtataagacacggcccttgtcctcaaagctttcatagtctggtagagcatatagatgtgtaaatgagtaaatatggtaatattaaccaacatatgttcattgaacagttactacggggtcttctagtaggtgatatgggaagacaaaagaatgcaaatgacaatattccagtcctcaaggagcttataatttaaaaaacttaaaatagcaaaaacaaaaaaaaacaaaaaaaaactttctttgtttctgtaaacccaattttcttttcattatttctaatcgagcccctagttaactttgatggaaggggggctggggtgtgagtggatagttgctgcaaagatgattttcataaatcatcttttcctctcccccaactaattaagagattgagctcactcatacatatctccttcatggcctacttattagaggtttcccttgcttctcttttaaaatgcagacatttctgttgggtgaatgcagagagagggaattatttcagaactaaatgaatcctcaattacttatttcaattactttattttattaaaaaaccccaaggcctagaaggatatctgatgtgtttaaggttatacagattggaagcagagctgggctggaacagacagacccgtggcttcttgctcactatttgtctctcttccacttgcccctggtgcattcaagcaagatgctagtgtccacatgtctatagaagagcagattttgttgttgttgctgttttatggtaaacatcatttgacaacccatttcttggagttttgtcactctgaatacaagatctgctatattggatttcactatgctaatgattctagcattctttagaaaacatataagaaatttcacagcagaatgagcattctcagtggtcaccttgagagactgtaaatcccttccaatgattgtgatactgcaaaaagcattttggaaaagccatgcatcttgaatcctgagatgagcctttgggatccctcccaggatgacaaatcttcacgtgtattttaaacattaatttgcttttaggatctagtctaaggttatttggaactaaaacttctgagtagtccaagataatagaggtgtaaactatttgttaaatgaatagtaaagattgagcaactgtcttgcatggtccagaaagtgcctttgaaagccactccaagaaagacattccaaacatgtttcgaacggttgcagcattgttgggattaaggagaaggctcccaaggtatcctcctagagtccaaggtataaattctgttactcatgtgttcattcattcttactgcattcattcaacaaacatttactgagtgctttatacttgccaaggtctatgttaggtacttgggtctgatggagtaaaatagtctccatcctcgaagcactcaggctagcagggggaaatgaacatctaaataaataagtgcaattaagttttgtatggactgtgataaaaccatatacaatgggataaaggggtcagttctgtaggtcctgggagtggagagatctattgaaaggctttataaaagaggaaaggctttataaaagtggaggcttgaaaagatgaattgggtgctttcaagcagccggggcatttcagacagagaaagcacaagcaaaggtaatgagataggaaccatttggggagcgatcagtagttcgttgtggttgcaacgtgatatgtaaggaggggtgagaggtaaggcgggagagtcaggagggtaccagattaatgctactactaaggaggccatgaaggcgatatttatgagtgagattcaagcaagtgccttgtgtttcacgaaaaggaatttgttatgctgttgtaggtaagcaataggagccattaaagaattaatttttttttctttgagacggagtcttgctctgtcgcccaggctggagtgcagtggtgcgatcttggctcactgcaagctccgcctcctgggttcacgccagtctcctgcctcagcctcccgagtagctgggactacaggcacccgccaccatgcccggctaatttttttgtatttttagtagagacggggtttcaccgtgttagccaggatagtctcgatctcctgacctcgtgatccacccacctctgcctcccaaagtgctgggattacagacatgagccactgcacctggcctaaagaattttaagtcaggaagtaatgtgatcaaatgtgttttagagtaataatgtggactacatgcagacaatgaattggaggaatgagttgtggagctgaaagactgttaggagactagcagaatggcacaggcaatagctgaagtaggtctggcaatgaaactttagggaagagcagaatagagagctgatgggggcaggatgtggacacgagtgtaacaagaaattactgaggttttgttttgttcttaatcgatctggccgtacacttcattcaaaacagcagccaagagataccattttgcagttaggattaattgccagatttgtgatagaatataaactctgtgtgaatcaaaaaatgctgtggaacaactctctaaaatgtgttagttttaaattatgtgcacaatatgatacatgtcatttattccacaacgatttgaaatgttagcagtgttttaaaatcattaaggaaaaatcttcagggtagttgaatgtgttggaattatgagatataaggctgggtacagtggttcacgtccgtaatcctcacactttgggaggccaaggcaggagattgcttgaggccaggaatttgagacccatctctacaaaaaatgattagctgggcaaagtggtgcgcgcttgtagtcccagctactcaggaggctgaggtgggaggatcacttgagcccaggaggcagaggttacagtgagccgagattgccccattgcactccagcctgggcaacagggtgagactctgtctcaaaacaaacaaacaaataaaaggattatgagatgtagaaaattaaatttctctcttaattcaccctcaaagagatatgagagttgacaatttggtgttctttcccttttatgttcttttattttctgtgcttagattaattatattttaaaaactcaaaaatatcattctaggccatgtgcagtggctcacacctgtaatcccagcactttgcgaggccaaggcaggaagattgcctgagcccaggagtttgagaccagctgggcaacatagtgagaccctgtctctacccaaaggggaaaaaaggatttaatcttctcatacagcttagtggagatcattttgtgatatctaattgagttgcttactcctttcagggtgttcctgaaaagaaggtacttccaatcaccgtccccaagtcaccagcctttgcattgaagaacagaattcgaatgcccaccaaagaagatgaggtgattccctgggagtaggggggttctttttccttctatatagtcagtcaatctaagccttatcatttattaatcttaatggagttcaaaggcaaccactcttttttggacttgtctttaagaatgggtatgaacatttgttcattttttttgttcctccaagaacaaagtaattggtaagggtatgaattttctgctcttagtgataactagttacaatttatggaaacagtaaggagcagttaagcattggaggcttgtctgctgtagcattgaaaatcagctgctctttgtaacatggatcaaaagttgcactttattttgccttagattgtcactattcagtgatggactttgaaaattcatactaagcaattacatccaccttgtcctatctccgttaacccagaggagttgcaaaggtgactgtggtgatcgtttatggaattgtaatatataaactgtcattggtcaggccagtttcttgttacatctcccattttatctataaatatccagagttagggtaattttatagcagattgcaagcataagcctttttataggttcatttgaaactaaaatacgcagtaatcttgtgttaccagcttgaacccaaacaacttgggtttggcaatcctattctgggtttggcaaccattaagtcccagtcacatgttttaatgaagtctagaggctgggtcaaagaagagactaaggtatatgcttggttgggaccgatcttctgatgttcattttattcataatgttagatcttatttagtttttacaacattcctgtggaaaactagatcttttaagagtaattgtgttagcccttggtggtagatgacttacctaagtcatcatccttcttggatagaaaaggaagctaagacttcctttaattttgttttaattaatgccacatattaatataatgtcttctgactccacattctggggaagttggagagagtgaggagtcttatttctaaactgcaattttttccctaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtaggtgtttccatttctgcaagtagtgtaatactattctttgatccctcaaagacagttttttctgtagcacttttaactataaaatcactgacttcttttgatctttctaagaaccctataaaatataaatgggacaagtaatttaaataatccttctggcacaaggaggttaagtgacttgcctctgatcacactgctggttataggcaatattaggaggaaagcctagatttccttttgaacccattattcattctttcatgctgctttgaaaggtttccttccttatttttcagattcttccagatattctggagcagctattgctttccagctagtctttatcttaaacctcatgttttcttttctgttaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccaggtaggggatggggagagcagccaaaatgttaattgcttggttggttgattgtacaggcagacccaccatactgaaatcacctgggttaacatgctacattgtttcaggggctctcactgtaaatcaggggtcagcacattatttctgtaaagggccagataagaaatattttaggttttgtaggttacatatggtctctgtcgcatagtgtgtgtgtgtgtgtgtgtgtgtgtgtgtgtgtgtatgtgtgtgtgtacgcacacattttgttgttgttgttgttgttttttgagacagagccttgctgtgttgcccaggctggagtgcagtggcacaatctcggctcactgcaagctccgcctcctgggttcacgccagtctcctgcctcagcctcctgagtagctgggactacagacgcccaccaccaagcctggctaatttttttatatttttagtagggatggggtttcaccgtgttagccaggatggtctcaatttcctgacctcgtgatctgtccgcctcggcttcccgaagtgctgggattacaggtgtgagccaccacacccagctacatgttttcaactctttttttgtttggtttgagacagagtgtcgctctgtcacccaggctggagtgcagtagtgcgatctcggctcactgcaacctccgtctcccaggttcaagtgattctcccacctcagcctcccgagtagctgggattacaggcgcgtgccaccacgcccagctaatttttgtgtttttagtagagacaaggttttgccatgttggccaggctggtctcaaactcctgatctcaagtgatctgcccaccgtggcctcccaaagtgctgggattacaagcatgagctgctgtgcccaatcaactctttaaaaatgtaaaaaccattcttagctcaagcgctgtcctaaaacaggttgcaagctggatttggcctgtaggccagagtttgctgacccctgctctaagtgatcacctgggaatgtcccctgctccaagtgatcacccggggaatgtgggaaccgacaggcttttctggagttgggagtttctttaagatcttatctattccatctattagactcattcattgtgtttattcctttctgttgatgcattggtaagaaacagtatgggagaatagattgaaatatacaatgctgttttctcagcatgatgtgctatttgctctttataaatgacaggtgatttaaaacaattaattggttatttgctgatttaattgggatctaattctacgtggctggaaaaaatttcccctgaatttctaagttttttggatttttatgtcatcattaatcttggattctttccaaaaggagctctaggctattgtttgtttgtaggaattacccctcctgaagcccgagagttgtaatggcttacatgactgaacgttggtcccctgttagtgtggttctctaagaaaccttaggactgttgccttggaaatagtgaattttcccctctcaatgaccaagacacagaatgtctgtgtagggcattttctgcaaagaacaacaacaaaaacaattgttttaaaaagcttttcagaaatataaaagtagggtgaatagtataatgaattttcatgaacccatcacctggttctatagtgatcaaaacatgaaaagtcttgtttcatcccaacttctacccacttatcttacactggatacttctacctgtgtaagattactttgaaacaaattctatgtaacatcccttttcatccaaaaatacttcagtgtatatatttaaaatataaagacttataaccacaataatattctcacacttaaaaagattaaaaataatcaaatatctgcacatttctcataattttttaaacagttgaattgttaaaatcaatatccatatatagtctacatagtgcctttgtttgctaaatctccgaatcttctttcaatctataggctcctctctttgcattttatttgttgaataaactggattgtttgtactgtagattttccacaatctggattttgctgattgcgttcccacacagttgtctaacatgttcctctgttgcttgtatttcctataaatgagtagtaagatctggaggcttgattcaattctggttagatttttttttttttttggaggtgggaagaatactttataggtgatactgtatagttcctaatgaatcatgtgtgaaggcagaaaatgtctagttgtttatttttatgatataaagataggtcttaaaagtacctttaaaattttttgttttttttaattgacaaataatagttgtacatattcttggggtacatagtgatgtttcaatatgtataatgtgtaatgatctgatcagggtaattagcatatccataatctcaaacatttatcatttctttgtgtttggaatctttttttttttaatttaaaagtaaactttagcacaccaacatggcacatgtatacatatgtaacaaacctgcacattgtgcacatgtaccctaaaacttaaagtataataataagaaaaataaatgtgaacataaactaaaaagaaaaaaaaaagtaaactttaatgtcgaaaatgcaaacttgggaatcttaaaagtatcttaaaaatgctttctagttctcagtgagttcaaatgttgtcagactgatctgttcattgtaaagtttgtgtgaaagatttttactagggtttatattaaatctgctatttttattgatgaagcagttcagacattagaacttaagttattgaggtagtggtcatagaaaggtgagacattgctcatctgactgactttctctctaatagctggaagaagaactgagacagcagaaagaagcagcttgtttcaaggctcgtccaaacaccgtcatctctcaggagccctttgttcccaagaaagagaagaaatcagttgctggtagtattatatgtactctgatgggactcgggcagaattgtcagacttcccagtgggatgctggaattcagtgtgtcagtacaatgctgtgtcaactagaagcatttgactttagcagatggtagcttttcttcccctagacccagttttttgcctttattgaacccagcagctatgttgagttgcaggatgtgttagggccagattcatttaacatgaaccttggcagaagcagctggcatttcaacaacaatgataggttttccccatccacagagaaacaagtaaatgagggagggagagccagtatggctttctggaattcaccctgaagcaaactttagatataaaacatttgattccttaaacactgggcagtgtgctagaatactgggattccaccgggtgtggtggctcatgcctgtagtcccagcactttgggaggcccggacaggaggatcacttgagcccagggatttgagaccagcatgggcaacatagcaagaccccatctctttttcaaaaaaatctttccaaaaagggaaaaaaagaatattgggatctttcttctatgtctgcctcaaaatcaatcactatatagttttgtgcaagctactttatgtctttgcctttttcccaattacaccagacgatttccaggggccctttgaactcttaaaattctaaaactttttgtatttagttggctctacctttctcccaatggggcttgtttagagcacagtcttcctgttagtgtgcatgtctgtgccacttgctcattccagggggcgtaggtttatgcaagtcctgcttgtgcaccaatattttttctgtttctgtacttagagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtaactgggagcatgagcactgacgaacacaaacatgcctctgttttattttacctgtaccttaccttgtaccagacaggatctaaggtagcccgcaaggctgtaccaaagacaatgagtgaaagggggaattgcacaaactgagggtggtgatgaagttgagttgtgaatgaagctaacgatgtgtacattgtgatctaagtaggagctgtaattttggccctttttaggaaccaacctgtcagttacaaaactcgcagtgttcatgagacataagacagttgttcaaaaaatacatttatccctttgatagtgaatttttagacagaatttcttccggaagttttcataaggaggacaacatgtggtataaccatgatgcctttcctaggactgttttttatttatttgtttattttatttatgtaacttattatttcctctggggttaagaagcaccactgagttttgtaattagacaagaatacatagcgaaggacatgggaattaaatggcaactgtatttttgttttaatactgagcccaaactccttggagttacagtgttcgtcgctccaggtaatcctctactaacataattatttagatgttggttatccaaaaagaaacctgaactccacattaaggaccaatctgctaggagggcagcaagttgtgttaactgtgttaatgaagaagcagacagttttagatggaacttcgtatgataaataaaaaaagaaagggtcatggggagatgttggtaaaaggttacttagttacagttagatgggaggagtaaatttcaagagatctatcatataacaaggtgactgtagttaatgatatattgtattcttgaaaactgtaaagaaagtggatgttatgtgctcacactacaataagtggatgttatgtgctcacactacaatgttaattagcatcttgctaattaacaaatgcattatctcacatagtaaccattccataatgtatgtctactttaaaacatcagcggtacacaataaaaatatacagtgttatctgtcaattaaaaagaaagaaggccaggaatggtggctcacacctgtaatcccagcactatgggaggcccaggtgggtggatcacttgaggtcaggagttggagaccagcctggccaaaatggcgaaactctgtctctactaaaaatacaaaaattagccgggcatggtggcacgcacctgtaatcccagctactcgggaggctgaggcaggagaattgcttgaacctgggaggcccaggttgcagtgagccgattgtgccactgcagtccagcctgggggtgacagagcgagactgtctcaaaaaaaaaaaaaaaaaaaaaaaagaagtgtaagttgttgaggttttgtctaaaagtgctatactacagctggatgtggcagctcacacctgtaatcctcacactttgggaggccaaggtgggaggattgcgtgagcccaggagttcaagaaaagcgtgggcaacatagcaaagtcccatctctattttaaataaataaataaaatgctagactagcagttgaaacagctattggcagctattggcataggtgattatgcccataggaaggttccacggacacactatttaggagaccagcctcttggtaaaatctagactaccatttgctgagtgaatgagaaaatagtataatccccactctatatacactcatacaatcagccttttttcccggcctcaactttgatttttctttagcatttggtacctgcctcttgtgtttgtccccattatagaactgcttcttgcagcaattctcaacataactgatggcaacattgtaaagcacaattcagtcaatgctggttaactctctactaatctggcttgatttaggattgattttagactaccctaaaggatggatgggaccatgccttctttagccacccttcctggtatggttgttgtgttttgtttttgctttttccccaggattcaggcttttggtgaatatttatagtcagtaaacttaagactgtactctgggaaattcttagcttgtaacttctctgctatacttgagtacagccctattataccctagtaaatcacacaggacataggtttggcattctttagtgaaagctgagggacttgaggagactgtggcctaaaggaaagctgggggacccaatagagacctgaatagaaacccttttgggctccaaagcacatacacttttccatcataccgtgttgccccccaggccccactccccacacctgaaactagtgactgggacctgtaaaactctacaaacattttctcaaaaagaaaaaaataaaagcaattataagcgtagttctctgacatccctctcactggtaacttttccttactttgcaggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttccctccctga

SEQ ID NO: 406 - DNA, 11697 bp, Homo sapiens
acttaagcttcgacgcaggaggcggggctgctcagtcctccaggcgtcggtactcagcggtgttggaacttcgttgcttgcttgcctgtgcgcgcgtgcgcggacatggcctcaaacggtaggtaagggcgcgaggcgacggcggcggcgcacccggccgaggcctcccagctgggcttttcgttttcagtgggaccggggcggcgatcccgtgtgggattttttggcgcccctgtggcgggaagccgcggagaagagtaactggaggaggctggtgtcgccattttgtttcgctcctctggccctcgcgcgcggggcgggaagtcttttctttgcagtccgtttgcttggggtgggcgttgggagggacgcttcttaggggtttgaagcgtcaggtgagggtggaaaacgcccattctccgtggcctcgcctcccccaactcccggccccgcgctcgagcccgctttgtcgcagtgctgcatccgggcactcgcggcgcgcacgcgctctgcgggcccctcccccttcgcggcgcgggtaccccttccccgcctcgtgttggttcagctttctgtcgcgagacccttcgcggaagactcggcggcgcgcgtccggtgtgagccttgtccctcagtggtccttcgcgaatgggcgggatcgctccgttcccgcctgggttgccacgcggctgggggcggaggctcgggatcggggccgccctctagcttaacggtttggcggcggtggtcagggttcgaccaacggacttggggacggcccgagagtttttcccgcctaaatttctttctttttttttttggagacacggtcttcctctgtcgcccaggctggagtgcagtggtgcgatctcagatcactgcaacgtccacctcctgggttcaagtgattcttctgcctcagcctcctgagtagttgggattataggcgcccgccaccacagcccggctaatttttgtgtttcttagtaggggcggggtttcaccatgttggtcaggctggtctcgaactgctgacctcaggtgatccgcccgcctgggcctcccgaagtgtcgggattacagacgtaagccaaccacgcctggtctaaatttcttttttctgagatagggacggagaagaacggccgcccgaggccacaccctctcctggtcctctttcccttttcctgcgggggaagcgccgcgtttcctgtgctgggaggatgagttgatcttgttcgtgtatcttaagtggggcttttcaaaagcgcttttgttgctttttgttcgctgggggaaggcagggtaggtgagaaaacggaaccatctggagtcccagggctggggactcgagtacctgttgactttcgcctcctaaggcgagcagttgcatgatctctgtcatttggggtccaagggctcttttgattctctggctttgcactaaaaagcccacttcatctccgggattggtcaaagagtgaagaatggccttttttgagactttcttattctgtgggtctgggctgagagagcagaggccacaatctgaacactgttcgaattcaaacctgtgccactttggtagttctgcgacgttgggagagttagtctcttgactcctggcgataatggctttctcatagagtggatgaaacgaatgcgcgatgttttagagcaatcactgacatgaattgggcttgcagaaaattgtggatgtccaccaagaccttggtttttccaatggttaaggcttctgggactctgtagaaacttgcattttcttcactttttctttattgtaagaacacttggctgataacgccagtttgttcctcttctcaaccagtgtctcatggaggaattttatgccctttgttgcaacatggtcctatttttatttttttttttgagatggagtcttgctctgttgccaggctggagtgcaatggctcactgcaacctctgcctcccgggttcaagcgattctcctgcttcacctcccgagtagctgggattacaggcgtgcgccaccatgcccggctaattttttgtatttttattagagatggggcttcaccatgttggtcaggccagtctcgaattcctgacctcaagtgatccacccacctcggcctcccaaactgctgggattacaggcatgatccaccgtgcctggcctacgtggtcctttttattcatcagtgcttgagttaaggaatttagctttaattcaactctttcagagtggcagctgaagataatgtgattgtatttttcttttgcagattatacccaacaagcaacccaaaggtgagtgctatttttgggcttccagagtttgtagagggcaagggtggtcacgccatgttttctgatcacgctggttttccttttatttagctatggggcctaccccacccagcccgggcagggctattcccagcagagcagtcagccctacggacagcagagttacagtggttatagccagtccacggacacttcaggctatggccagagcagctattcttcttatggccagagccagaacagtgagtctttctcagcgggtcacctcttcctactctttctgaatattgcttttctttttcttgttttttggagacggagtctggtcctgttgcccaggctggagtgcagtggtgctgtctcagctcactgcaacatcagcctaccgggttcaaacgattctcctgcctcagcctcctgagtagctgggattacaggtacctgctaccacgcctggctaattttgtgtttttagtagagatggggtttcaccgtgttggacaggctggtctggaactcctgacctcctgcctgccttgacctgccaaagtgctgggattacaggcgtcagccacaatgccctgaatgttgcttttcttaaacctgagcagcactgagatgttgaaactgttccatatttcttttccgtgaaacagtgtataagtcttaaaactttttgggatctgagtcctttacagggcattgtggcacacctgtagtcccagctactgaggaggctgaggcgggaggatcccttgaattcaggagtttggggctgcagtgagctatgatggtgcctgtgaacagccactgcattccagcctgggcagtgtgttgaggccccatctcaaaaacataaaaaaaaaaacaaaaaacaaaaatgtttattggtttgtgattctgtttccatttattttctttggcttttaatttttttgactcttcttattttccatcagcatgaaagagagcatattttctaaaggaagaaccagttttaggccaattctgaaatggagaaaatggttttgtttgaaaatgtatgaaatcatgtgatacataaggaggtgggatttgccccaaggtcctgaagtgtaactaagaaaggtggttgtcctgtagatactgcacgcacagctgcatattacagtgctgttaacagggatccttgggcctgggtttagagggtggtgctggagatggtgttgggattggcggggtgaaattggaactgtactaaagagttggtagaagttgaagcattaaatttaggctttgaaaggagggtaactatctttgcctatgagttgcaacatcactaacagcttctgagaggctggctttatgagtataggtattatgttttctttaacccattccttacattttctctttcctggtggcttttgtgactccctttttcttatcctggtagcaggctatggaactcagtcaactccccagggatatggctcgactggcggctatggcagtagccagagctcccaatcgtcttacgggcagcagtcctcctaccctggctatggccagcagccagctcccagcagcacctcgggaaggtacggtggtgttgatgtcggggaaggcttgaaaagaggggtgaattgatgaggaatgataaagggaccagcagtaggagcagttcagaggtgtaattggggtaggggagcctgtgttgggtacagagaatggactccactaaaagtgaaaggaaattgggggctatgctgggattgtgattgtgttttttgtttgttttccctagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtgagatgtcttcagctttgtctgcagcccattttctttttctttttttttttttttttgagacggagtcttgctctgtctctgttgctgaggctggagtgcagtggcacaatctcggctcactgcaagctccgccttccgggttcgcgccagtctcctgcctcagcctcccgagtagctgggactacaggcatccgccaccacgcccggctaattttttgtatttttagtagagacggggtttcaccatgttagccaggatggtttcgatctcctgaccttgtgatccgcccgccttggcctcccaaagtgctgggattacaggcgtgagccactgtgcctggtgtctgcagcccattttctataaggatttgtattctcctgttttagcttaaaagagggttcctgtcttgtttcctagctgtctttttactttcttttgtccttcattgcctggcacttgtcaaaccttttcaaaccttttagtgctactttacaatctttttgttttttttttttaatcattctttcttttctcacaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatggggtaggtgtctcatgagccagggagtatctttggtggggagtgtggaggattgcatgaatctccctgaagccagtccctagtgcatggtttagtattcttgttgtctagggatctgtgagggctttgatttgggggcagtgactttctttttacatccccattttatttttgtgagaacttgggagcctgaactcccatccataccactgaatagagattttgagtaatgatacttgtttccaaaaaaaaagaaaccatacatagatacgtatggattggagtcattaatatcctaggcaagaaacatggaagtgaagacttctttctctgcaagggaaaccgatgatcccactcctgggaaatagtagggaaacttggtatgtgtattcccatgtgtcctctagggagttggtaatggttaacctgacttcagcttccaggaattggctactcttcccgttttctatagtcatttgaatccacgagcttgatttgcactaatttgaccgacattgattttgtgtgtgacttggtttatggggccagctgactgaagtaagcagaccttttgggcaaaaatatgctttgacagtggtctcccacctatttgttccactgtctgccttcccctggttacttaaaattcatcagcttgtccaactggaccttctttccttcctgctgaagttgatttgaagtaaaaccttagatttgatgttaaaacagttgtcaaatctgttggtaaataagatttgaaggaccctactctgtctcccttgaaaaaggggaggaatgtcagtgttactgtttttggaaaaagtagatttttaaaccgagtttggaaatggtaagtatgcagaggtgggtgggggcaatctcaaaaacgtgcaaaaatgaggaaaacaaaaatgaggaaatgtgtgcgtgtgtttaatgcaaaactttaaaaagaaaaacaactgttatgtgactgttaacttgctctgcattttatgtgccacaggtatgaaaggtgacattgcaaaatactccgctcttctcgcagtgtagaaggggtgaccccgggggttgggggagatcaaaaacagctcagtagttaggacagagcttagctaagtttgtcttgctttaaggggaagttgcctttggttttgactttttatggaatggggttgggtctgcttgctgctttcaaagcaaaaaccacaaaaatgtgttcaaggctaccccagcctggtgtgaaatgtcttctgggtaaattggggtagggtttttaaaccaactacttggttgtcaaccacttgcgacaagaggaaaaaaaaacatctgctccatcggaagaacgaccaaggaaaatgggttattttttttccagaggaaatagataacgtaaccttttaaagcaaaatctttataaactgtgtctgagaaattgcacacgtgtgtgtgacatgctcaaaggtcagacaaggggtggtcaggaagggatgtattttagtagccacttgtatctttttccaaaaacacctacccatgtttggggaatgttaaacaaaatcaaaaaacaaccttttgtagccgttggaagcttcatgtcctttcttctaacttgtcttctccagcggaagtgaccgtggtggcttcaataaatttggtggtaagtgaacagagtttccaaaattcccaactcccagcaatgctttgtctgattgttcatttgcagatgtcttagcgtgttaatttaaatgtcaaaggttttgaggtgtccagaaccacctccagaaaggggtagggtagaatgccacctgttgcctggtgtgtgctaacctggagcaggtaggggtaagactcaatagtcatcttttaccaaatgggtttgccccaggttaataagaggggtctagtaggccttggactgggccgttgccacacctggcacttagtgaccatcatcatgagaaactggagagtgcgtgctggaacacgtggtgccatcttggctttaggatccttttgatcgttgtgtccaaggcttgtgtgtgtgtgagtgtgtgggagacaactccgaatgtttaattctggaagagggatgtaacattgccctgaggatggtgaagttggtatacatttataaagtacggaatggtgtcaatgaatgcaattctatgtatatggacttaactgagatgggcaaatagaaactagctctgggaaggaacatgtgcactacttcaagaaagattggaagcatgtgtggctcatgggaaataaccaggtcttaaacagcacaaactgaattcgtggaccaggaaggtcttaaacagcacaaactgaattcatggaaaaatgacaaatttgagaagtctcccagtaagctggaacttttctggtttggttaacaaaaggtttcttgatttgtttcaagatttaaagccaaaggtgtgggttcatgacttaggtgtcattgcgtgtgggtacaatatttatatatggcgaattcagataaacattggtcaaagatggtctctggaaaaacaaaatagaggctgcattacggaaataagatttctggtctgttccctgggacatgcttaaaaaatacaatagctattatgtatggtttttattttcatgtggtttcggggaaacaacacggttttaaggatggtttctaaagatgaaattaaaaattgttccacaagggttaagtgtctggtggtaaagttgggagaaactggatggatgcacatcgcatggctggtggcgagcccatctctcttctctcgggtgagagaaccgggccaagctgagttggtttgttcactttaatgggtctccgtttcccctgccacctgtgctgaggacatttcccagcctgagctgggggaggcagcatttgctgaagtgtggagttgtctctgtggagactcaagttacagatcttaaggggcctgcctagaattttctcctctgggcaggcgacccaggaaagggtttggagtgaggctgtgagcacttacttgatattttacaagtttggatttggtgttaatttttttccttgtccgttttttcctgttgactaacggctcatcttttccttgtttttgttttttttttgttctttttttccatgtcactaaaggccctcgggaccaaggatcacgtcatgactccggtgagttcacacgtggtggcatgaaaagagtggctaaagtggtatcaagactgcctggatgttctttgaaactattataaaaaggaaactgaaaaaaatggggatagagaaggaagggagttaggtgtgtccttagttagcagtgagaagtatttgttacgaagtatttctcagaaatacctggcttgtgggttccacccccagtgatttaggtctgagaggaccctgaaaatctacctttctaacaagtccccagtgatgctgatgcgtctggaccacactcagatggtttacagcagtggttctttcaaaatgtggatcatgtccaagttggtgaacaaaactagtgaaagacctgaccacatgaagtaaagcattgaactcctgtttaggttgtattgatgtttgtgtactagatttgaatgtaaaatgggtttcttatttaattcggggaccttcaactgaaagttgataaatactgatggacttttctgtgtggtcttgttgggcatttcactcctgagccctggtttccatactgtatactgggtgttaacatgtttcaaaggataattgtcaaactgaatctgaaatttatcagcatggctggcatatagggactcaaaagggatgtggatttctttttagttgtcttccataaaccaaatgataccagttgcttgatggatactaggtgctttaggttttttcctgtgttttttattttaccttttcacatttgcattttctctgttcaacaagcagaacaggataattcagacaacaacaccatctttgtgcaaggcctgggtgagaatgttacaattgagtctgtggctgattacttcaagcagattggtattattaaggtacttgtggagaggagtgggagctttctgtcagtgttgtaggcttgtggatttcacacattagtaaaagcaagtctttaatggttgccagcagtaaaaacaagtcttagtggttgttgccagcttaatttgttgaggaaagagccttagttactgttttctaaaagagaagttctatcttaacacaaaaagtataacttatcagagtaccctaaactcttgagatttgtactctatagtaacttttagttttatctttcaatattggagtgagagacagttttctttaatggaggtttacatgtgaggtaggaagaagtaactgggaagaggggagctgaagtttgggaattataaacctcatgttctagaggaagaagatggaaagggagtactgtagcctttaaaattgatgttacctcattttgctttcttcagacaaacaagaaaacgggacagcccatgattaatttgtacacagacagggaaactggcaagctgaagggagaggcaacggtctcttttgatgacccaccttcagctaaagcagctattgactggtttgatggtatgtatgagaaggctggcagaggtggggctggggatatagggcagcaagccttaggaaacaagccatagtttgagggttcttttgagtcttccaacacttactttagctgcggtttcaggtagtctcatttttgcttatgtgtcagcagattataaaccatttgagaaaggcacgcttctcttgtattttcggattaatgtgtcttgcatttaaagtctgttgatgattttttgtttctctaggtaaagaattctccggaaatcctatcaaggtctcatttgctactcgccgggcagactttaatcggggtggtggcaatggtcgtggaggccgagggcgaggaggtgaggagctacctgctagtggtgcagaggggtaatggggagagtgcagaagatggtaaaggcttgcatggaatgggttagatttaccaaacttggagagggagcagacccatacttggtctatctgcattaggacccatgggccgtggaggctatggaggtggtggcagtggtggtggtggccgaggaggatttcccagtggaggtggtggcggtggaggacagcagcgagctggtgactggaagtgtcctaatccgtgagtgaaacttaatttttttcttagttctcttgcatgcgtgctctttgatatattggtactgaggtatgtgcgtgttttccaaagaagtaaatgtcaaggccacactgttggggtcagatttagccaaaagcttacctaggtaaggttgatgtaatgggaaaggtaatggattgggttcagtaatactgatttttgttcctgactctgagaagcaagccgttttgtctttctgaagcttcagtttcctcactgtatctctaaagtcaccgtagtttcttcctagttctaggtcttgcctattccccatcgctccagactgattgtcttcctttctccttagcacctgtgagaatatgaacttctcttggaggaatgaatgcaaccagtgtaaggcccctaaaccagatggcccaggagggggaccaggtggctctcacatgggtaagaaaggcagacctggtgctagggagctgggaccaaagaatccttaatttttcagcggggaggctcggggaacataggggaatgggaatatgatagatcttgtttcttttgtcctagggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggtaagactttaaatcagaataaaaaagtagagcagttgaacagaggccataggataacagggttttgttgagaaagtggtttcattttgagggctaggtggaaagacctgaggttgtaaccagtagtggagagggaaggaaaattaactcagggggagtgaatctgtagacccacttgagataagatactcgctgggttaggtaggaggggcagataggatatctaggcttggagaggctggtaactcaaatataatggatacttaatttttttttttttttttgcaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaattttgttcctcttcccccttttcactttcctggaagatcgatgtcccgatcaggaaggtagagagttttcctgttcagattaccctgcccagcaggaactggaatacagtgttcggggagaaggccaaatgatatccttgagagcagagattaaacttttctgtcatggggaaagttggtgtataaatgagaaatgaagaa

SEQ ID NO: 407 - DNA, 15154 bp, Homo sapiens
acaccctccgcctggacgcagcagccaccgccgcgtccctctctccacgaggctgccggcttaggacccccagctccgacgtaagtccctctcgtgcgccacctccatccgctgcccctctgcccacgggccgggctcaggtgggtaggggtttgaccccttccgctcctctccgccccccatccacgcccacatctctctgcctcctctcctgggctacagtgggccgctctgcctcgctcccgcccgcctgcctcagtctccccagctctctgccacccccctcggaccagtgcctcttaggtctctccagcgcgccatccctgcaaggcggcccctgacaccaactcactttttcctctgagcgcgggaggcgttactcactcttcctccttcccctcctcgccgactcccgggctctgggcccctgggggagggaagaggcctcctatctactcctctgccccagtcccctccttgcgtcagtcccagtgagggataagcgcctggcggaaggcgcagggaggtgtttctctgcttcaggagtgcccgccggcccttgcagctgctggaagacccatttatctcatgcttcttgttttctttggggacctgcaggggaaggaagcagggtgacggtttggtatccccacctaagaccctcccctttcccctgaggccagccgtcagcccctggcagggggtcttggaagccagaggtttttgctcagggcagggaaagggctgcaggatccccgggggctgccggaggtcggtctcactgacatcatggctgaccccagcatcgcctggtcccacagatgtcgccctctggtcgcctgtgtcttctcaccatcgttggcctgattctccccaccagaggtaagacccatctctggcctccaccctgccccagagcccccagccaggccagccccacgtgtgctgcggggtgggtggttggcccgtgtgaacgttgtcctgccctgtcaccctcccgctgagccggcaccaggaagtggggatccctatggcggggcgacgttacaccctctttggacacctcagacccgggtggctgcttccagtgagtctggccagggcctgtcctgctgagcatcctccaatttcacctccaagaagaactcactgagtttcatttggcggggagattggtgtcggttttctactcagcagccaggaaacctaggctcccagagtccccaggcattacacagttaggcaaagctgttgagctggggttagtccaaagagttggcaacatctcagccttgcctggaaagtgtctcctgaaagatgggaaccacaggggggtattgatcgttctttctgtgtggcaggtgtggtgtgtgttaggtcagttaggctttgcctctgacagtcagtcacacctgttgtcttgcccattttactgatgaggaaactgaggctcagcgaagggaagtgccctgtgtcagaggagaatgggtggaggagctgagaaaacaactgtcctgcctgcccccagaacccagggtgcatgccccactgaaggcgccctcatttctccttcataaaatgattttcatatactcgttcagtcatttgacaaatatttattgagcacctactatgtgctagatattctgtgcactggggaaacagcactgaataaaacaagaggtcacactctagtggagagagacaagttagtaaattatatcgtgtgctaggaggtgatacgtgcttgcagaaaagtagaggtaatgaggattgtttaaactgggtggtcagggagggcctcactgaggaggtgacatttggaccaacaaacacttggaggaaatgagggaatgagctttgcaggtgtctgggggctgagtgttgtctggtgtgttttaagaatagcaggcaggtggggtggctgggttgggatgagaaggggcagagtgggatgacgagaggacagagaagtgatgggaccagatggaggaggacttacgggccacgtgagggctttgcttttatgtggagtgaagtgcagccagggcagggctctgaaccaggcgggccccgacctgactcaggtggtcccaggctccctctggctgcaggttggaacagactgtgggggcggagacaggagcagggagcccaagaaggaggctgctgggatgtccaggctggagggtacagaggcaggaccaggatgggggcagtggagttatccagcactgaccacatggtaagccgtgtgggagaccctttccctgctctgtgtcatttcaccctatctacagccctgtgaagtagattcagttattatccctgctttgcagatgaagcaactgaggctcagagaaaggacttcacttgttccaggtcacacagcaagaaagttgttgggggcaggatttgaaaccagggcccaggctcaccctagcacctgggctcactagactaaactgactttcccatcccacagggatgggcggggagggggactagaagaagggttcccaggcattggcatagctgaaaacactttcagaattatggattgatgcagccaaagctgagtgattccaccagcagacaggacccctaaggtttcaccagggaggcgagggcgggggtggtgagaggagggggaccaggctccctcctgacttctcatccttgattccccaggacagacgttgaaagataccacgtccagttcttcagcagactcaactatcatggacattcaggtcccgacacgagccccaggtgaggaaagggacacatctatcaagatcctgtcattgcaaataacaacagcaacaaaaatcccaaacttggaccaaacaagggaatttatggatttatgtaacgaaaaagtccaggtacagaccttcaggcatggcttgatctaggtgctcaaatgatgctatcagaacctctctccacctcttggttctgttttctctgtgttggcttcattttcaggaagagtctcctctcatggggccaagatgatcccttgaagcctggggctgtcatcctgtctgctaagaatcccagcaagagaatttcctttccccagtccagcaaatgtcccagaactgagttatctttggccaggctcaggtcgtatccctgagctggccactgtggccacaggcatagaaagctgattggccaggcctgggttccatgtccaacctccaccagggctggtgtcagccccgctgaataaagtggaccaagagtcagggaaggatggtccctaaaggaagttctgggggcttttatcagagcaggtgcatttgggaagctgagttaaacatgtttttttaggcagcacttctcagagtcttgagaaagacaatttgcagccagcatctcgaagaaggagctgtagtgtggcatctgtgggacgtaaggtcccaaagaaggggacatattggttacacatttcggcagttagcaaatggctggattaattaagccatttctattacattaaagttgagttgctacgggaatctctggcatctccacccatagaccttgcccacttctttttctctctccttttctctccgtgactccttgtttctggactccagatgcagtctacacagaactccagcccacctctccaaccccaacctggcctgctgatggtgagtagtgcaggggcaggcggcggggacaggaccaagacaaacaaagtttcccctcttcctctgacactataggtctttggttgcccatttcagtccctactcccagctctgaatgccctggtttactctgggtggggacagccaactccattcaattctttagaaaaagaaaaccaaaacgcttttgaaattgtgaaattaacatgcatatagaaaaatacaaaacccataaatttacagtgtaataacttactctaaattgaatccctatgtaactaccaaccgggtcaaggagcagaactttgcaaacacccccagaaagtctctgtgtgccagtcccatttatttcttcctttcatctcttttttctctgatcccttttttgaattttttgaacaatttttggacgttttcttgaagtataattcaaaaagtgctcccggccaggcacagtggctcatgcctataatcccagcactttgagaggccaaggtggatggatcacttgagctcaggagttctagaccagcctgggcaacacagtgagactccatctctacagaaaaatacaaaaattagccgagtgcgttggcgtgctcctgtagtcccagctactcgaaaggctgaggcaggagaatcacttaagcccagaggcagaggttgcagtgagccaagatcttgccactgcactccagcctgggcaacagagcgaaaccctgtctcaaaaaaaaaaaaaagtgctccctgattttttcaatcgatgtttaaagacacagtagtacaaaaacacattctgcctggaaagaataaaatgattgtaggcaaaactaaacccctttgtcacctcccctccccaatcctcgttctctccctctgtctctgagaggtccccactgtcagcattggggtaggtccccagtgataccacatcccatgtatattacttggagaaaatgcactgactgtgtgctgtgtttgtgtgagcttaaggagaccttatgattgttctgcagcttgctttgtttcttcgtgcagtcgtatgtttggaagttcttctcacatcactgcataaagacttgttttgttttctctcctgcctggtattccacaaggcgcctatatcacagcttatggagtcacacacttcttgatgaacatgttggctgtttccagctttttctgtctacacacagcaccacaatgagcaactttgtcccttcctccttgagcaaacgcacttggaatatgtactgactatgtgctggtcatggttctaaatattttgcgtatgttaactcattcaaccttcacgcaaaccctaagaggcagaaattaccattgtccccattttacagacaaggaaacagaggctgtgagtaactggttcaaggtctcacaacaagtcagggacgcagctggaatcgaagtccaggaatctggcaccagagcctgtgcttttatccaagacaatacagggcaaaggacatgcatgcttaatgttttaaaatttgccctcctgccgcccaggcacagtggctcatgcctgtcatcccagcacttttggaggctgaggcgggtggatcgcttgagcccaggaatttgagaccagcctggacaacacagcaaaacctattctctacaaaaagtacaaaatgattagctgggcatggtggcatgtgcctgtagtcccagctacctgggaggctaaggcgggagaatcacttgagcccaagagttcaaggctacagtgagctatgattgcaccactgcactccagctcaggtgatagagtgagaccctgtctcaaaaataaataaaagtaaaaataaaagttcccctcccaagtgactgtacccatttcctaacccaccagcagtgtgcaggagtgtcccccttcccaaccctacagtgacacttggtatactgacattttcaggttttgccagcctcttaggttttttctgagatggagttttgctcttgttgcccaggtcgctgtgcaatggtgcaatctcggctcaccacaacctctgcctcccaggttcaagcaattctccctcagcctcccgagtagctgagattagaggcatgagcgaccacgcccagctaattttgtatttttagtagagacagggtttctccatgttggtcaggctggtctcgaactcccgacctaaggtaatctgcccgcctcggcctcccaaagtgctgggaatacagacataagccaccgcgcccggccccaattctctttccccagtgactctttcttatccttccctccttgctctcctgacctgaatagaaacaccacaaccccagacccagacccagcaactggaaggaacggatgggcctctagtgacagatccagagacacacaagagcaccaaagcaggtatagcatgggactgagagcagcagcctacgatttttgtttaattctctatctaggtcaacatttccctcagtacgtttctcagtgcccctgtttggggaattgttaatacatttaaaaaaaatgtttttggtttgtggtcaaagttatttggggaaccctgagttaaagttaaccatgtttctttgtggcaggacttctgagagtcttcattaagctaattttcagcaaaggatccccaaggggcagcgtgcagtatgcagtgtttccctaactgatagactttggaactttctttctgtcagttcccctcggagggctggggctatagaatgtgcctgtggatatttcttttttgtacatctccttaatgttagagcaggagcttttcagttgcaaaatatagaaaattcaccttaaacacacacacacacacacacacacacaaaagaatgattggctatataagttctggaaagtccagaagtagccaacttcaggcatagctggatcaaggcgagtaagcactgtcatgagtgctttgttccctctcttggttctgttgtcttcattctctactaacttctcccctcttgatggcagagatggtcccatagttctaactttaggtcacatacgtggtggctagagaacaaaatctttcccattatttctagcctgaggcctagaattgactctcattggttcagctggagtcacatgctcatgtctgaaccaatgagagcctgagaaatgagctgctctcattggtcaggcctgagtcttgtgccccaccctggggctagagaagaggctcagccagccatgcctgaaccacatagaccaagagtcagggaagaggggattttcctttggacaagtgagttagtattaccagaaggtgtgggaaaggagactgagctgagataaggcaacagatcgcctctaatgcctgcgtgatgatccttatttgaggggcagccccacactggaaagtgttgtagagtaggccactcccagagagacatgtacagttgtgcagactgggtactgaacgagagcaccacctctcgggcaatgccattccctttgtcggtctttataattgttccagttttctagtgatagcagcaaagcatctcattcttacagaatctatctattaaaacaatcctacaatggatggaaataaagtgctttacagaagggaacttttctagtttgtacaaaagtgcacctgtaggggtgggggatagcagctgtgtccacacttatcaatgataaagcattctcacatcactgcattaatttactgagtctttgctgacctgagttgctctatgtattggtccatgttcctggatatatgtgacagaaattcatcaaggacaaatggctgtcactgctgagcctctgggttgcctagaggctgggcatgaaagcccccagggcctctcttcctcctctatctttgcttctcttccacctaggaaggaaatggctcatgttatttgagcctcctagctcaaaacttccagacttcacctagggttttaatctgctcaggttacgataacaaaataccacagactggatggcttaaacaataggaattcatttctcccggttctggagatgggaagtccaagatcaaggtgccagaagggttggtgtctgtcgagggctccccttgggtcacagacagccattctcttgctctgtcttcaccatgtcctctccatgtgtgggtgggcttgtgagcttgaaagcaagctctctggtgtcttcttataagggcactaatcccatcatgagggccccaccctcatgatcctatctaaccctaattacctcccaaaggccctcgctccaaaataccatcacatggaatttggtggggtggatagaattcagtctatagtacctagctgtcactcaatatccctacttgggatttcaaaggtctcagggaaggaccagactgaggtcacaagcttccttttgtagcctgggttataactggggaagggagggcaatgtcttcccacaaagaaagggagagctgttccagaaggaggaagagtgctgagcagacagtaatagcaatggctgacttttgctgagagcttgttcatgctgggcactgtgctaagcttctgtgtattcagtcatttgatgcttgtgatcatcctgtgtggtgggaactgtcattactcccattttacaggaaaaggaactgaggcccagagaggttactcagcttgccctaggcaatacagccaagagtggcagaaccggaatttgagtccagactgtctcaccccagggtgcatgagcaccacacaccagtatggctgtccttcgcattcctgtggtctctgccgtggatctggcttataccttcctctgggcaatgcattccctgaatatcttgtaatccttggttgccagttcctatttagggtgtggggcactgagataattccagggaacttgggtttcacgagggagcttctctgtctgctggcttcttgttgaggcctccgatgtggtgtgggggcacttctcagtgcttgggggaggccttttctttggaggtactgatttttttttttttttcaagagaagaatcctttggtattttcggtctgggggcagaggtgatattcagaatagttttgttgttgttgttgtttttgagacagagtgttgctctgttgcccagactggagtgcagtggcgaaatcttggctcactgcaatctccacctcccgagttcaggcaattctcctgcctcagcctcccaagtatctgggattacaggtgtgtgccaccaggcccagttaatttttgtatttttagtagaggcggggtttcaccatgttggccagactggtcttgagctcttggcttcaggtgatctgcccgcctcagtctcccaaagtgctggggtttacagacatgagccactgcacccagccaatattcagaatgttttacaagtttctccagactatgtagctgggtcagagtccttggcaggtgttgccctttcgttcctttatctcctggattatagtgtgggccagaaggtcctaggagaggggtctggagtccctcggggattgaggcagatcagatagtcgcaaccggggctatgtgcttatttcagcatttcaatgcctgtcattacttattgcctctaggtgtggagtaggggggatgcctgaccctgcacaccagctgtgtagatgtgggagaggggtttcttccagatgcagactctcagtaatatcccttgtttctgcctccatggctcactcctgccctccactgatctggccactctctcagctcatcccactgatgacaccacgacgctctctgagagaccatccccaagcacagacgtccagacagacccccagaccctcaagccatctggttagtaactgcctccccagactggaaacaggctattttctgttcactgtgtatttccagcacctggagtacagcccagcacagaatagttctcagtaaagacgtgatgggaaagtaaatgacttcaagccaggcagagggtgggcacatgataaatgtctgaatagataagtgaatgcataaattattgctgcatacaaaccacctaaaaactcagtggcttaaaaggataaccatttatttagctctcatttctgcaatttggaaatctagggtgtgctcagctggctggttcttctggtttcagctggacttactcatgcgtctgaggtcagttgtgggtcagcaaggacctctgtttctaggggcaatttgattctttccctggtgatcttatccaccacttcctgcccagtcagccccccagtgaatgaatggaaatgatacgcccatgggtcacatagagagcccattcatccattcattcaacaaatagtcactgagtacttgtgtgctaggctagttctaggggacagagatagagtggtgaacaagccagaaaaaatctctgccctcatggaactactattctagtggtaagagaaacacaacaagaaataatcataattatgtatcagttgatttcaacttgctatcaagaaaagtaaagtagggttagagagtgactggggagtacaggttgagtattccttatccaaaatgctttggaccaggagactttcagatttcagattttagaatatttgcattatacttaccagttcaactttcctgacccaaaaatctgaagtccaaaatgttccagtgggcatttcctttcggtgtcatgtcagactgttactggaaaggggttccgatccagaccccaagaaagggctgttggatcttgcacaaaaaaagaattcagagagtccatagagtttatttagaaagtaaaggaataaagaatggctactctataggcagagcagccccacaggctgctggttgcctgtttttatggttgtttcttcgttatatgctaaacaaggggtggattattcatgagttttctgggaaaggggtgggcaattcccagaactgaggattcctcccctttttatactgtatagggtaacttcctgatgttgccatggcatttgaaactgtcatggtgctggtaggagtgccttttagcatgctaatgtattataactaatgtataatgagctgtgaggatgaccagaggtcactgtcattgccatcttggttttggtgggttttaactggcttctttactgcaacctgttttatcagcaaggcctttatgacctgtatctcgtgccgacctcctatctcatcctgtgactaacaatgtctaacctctggggaatacagcccagtaggtctcagccttattttaccctattcgagatggagttgctctggttcaaacacccctgacatgacatcaaaaagtgtcagatttggggacattttggattttggatttggggattagggatagtcaacctgtatttcatatacaaaaccagggagggccccactgggaagggagtgaaggagggagccatgcggatgtctagggaaagtgtgttccaggcagaggaaacagccagtgcaaaggccctgaggtgagaaggtgtctgcatgttcaacagcagggaggccagtagggctggagtgcagggagtgagggggataggaaggaaatgagattagaggaataatgggagccagattgtgtgccatggtgaagattttgggttttgttctaagggtacccaggtatccccctttcctgactttgccattcacgtattcacttcacaaacctttgctgaaccctgacttgctctttgtctgcctctccaggttttcatgaggatgaccccttcttctatggtaagttatccacaggaagatgtgggggaaggaaaggtgaggtccgtctgactctaccccttcatttttctctctgcagatgaacacaccctccggaaacgggggctgttggtcgcagctgtgctgttcatcacaggcatcatcatcctcaccagtgagaactggggttgggtgggaaggacaccaagaccaggagggggacttatgacggagggctgggttctcaaaggtccctgggcaattttgttttaaatgaggtatctattagctgcatatacatacaaaccaccacagaattcagtggtttaaaataatgaccatttattgagctctcaataccacagtttggaaacataggctgggctcagctgggtgattcttctggtctcaactggatttactcttgcatctgagttcagttgtgggtcagcaggaaactttgtttctggggtgccttggctctttgccacatcatcttatccttcactaagctagcctgggcttgttcgcatggtggtggcagggatctaagatagagtgaatgcatgcaggctcagaactggccattatcacttctgcctcattccataggtcaaagcaagtcatgaggctgggtttcattcaaggaaatagactccacctcttgatgggaagataggcaaagtcacatggcaaaggacatggatactgacagggaggggtagagactaagggccatttggcggtcagcataccaccccagcagtcacaagcccactgcacccaggcctggcagggaacaagggctgaaaaaggctgtgtcaggaggagataactgaggattaaatgcctcatggaacaaccccacccactcaatccagcaagaatagaggcttgaagcagccagagtaactactcttttaagagcttaatgtttctgtaaaatcttttggtactcaaatgttgacagctgtgttgatcagggtcatggcaggtggcagaaggacctgcaaacgattaactggagaaagtttaatagagtgatatctctggaggtacaggcagggcaatgagatggtgcagtgccctaggactagcaaggatggggacctgttatcccccagcctgagggacaagaggaggcactggctttgcaggaggcctggtgagagatggaactggaggtggggctgctggcaggagctgtggcctcagaaagagggttccagccactgcctcacttgtgaccaaaccaggagggagcaggggtggtggggatcagatacctaaacctccctctcctcccacccccctgtctcctgccaatgcttaaccagagggcaaggggcccagggccccatgcagggagaggaagttgtggggaaaggcagaataacaagcagagaaactaattttttaaaaaggtttttaaaatgttgtgggtgaaataaaacacgagctatcagttaatctgtataaccaatgccaagtttcattacctctcttgtccaacttcctcatcaagaaaatgagcatagccacatctttttttgccttaaggggagaggcagaattctaacaatcataagacatgattcctgatgtgtgcgtgatccccactgaatctgagagtcaagcactgttgcctcggtcatacaacatgtatgtgttgatcctgactttgcaccaggtcctattctcaccccagtggagaagttaaggctcagagagttaaggagtttgcctaaggtcacacagcacagaagagtcagtaaattcatttgctggcgggacacggtggctcactcctgtaatcccagtactttgggaggccaaggtgggaggatggcttgagcccaggggttcaagaccagcatgggcaaaatagcaagaccctatctctacacaaataattttttttacttaaaaaaaaaaaagaatcagtgaaggattggacccaggtttgtgtgagagcagagcctgaacgttagctctggggccatgtatttttccaacagcaaatatttgtgggctcctagtctgtgccaaacctgtgctgggtgatgctgggggcatggtggtgacaagcagccctggtccctgtcctcaggagctcacatctggtcgaagatgataagcaaataaatgcatgaatgagtggatacagagaaagatatttgccaaataaagcagagtgacagggaagagaggggtggggagagaagccctccctggagtggtgaaattggaactgatccctgatgatgagatgaatcaccaggtagagagagcagcaagtgccaagccctggaggcaggaatgagctgcgcccattgctatagcagcagaggaggcaaagtagccaggacagggtaggttgggggagaggagaagacgaggccagagagctgaggggctggaggaggcaagggtggcaggtgttttctaaagtacccttggcttctaagttccccctccctcactctggagcagccacagatgagtctctggaacccatctgtgtcctcgtacctcaaggcctttgcgctgctgttccctctgcctgtaacacccttcctccaggtgtctcccttacgtccttcagacctttgttcaaatgtcacctccttggcaggccacagtggttcacgtatgtaatcccaggactttgggaggctgaggcaggtggatcccttgaggccaggagttcaagaccagcttggccaacatggtgaaaccctgtctttactaaaaatacaaaaattagctgggcttggtggcacatgcctgtcatcccagctactcgggaggctgaggcgggagaatcgcttgaatccaggaggtgggggttgcagtgagctgagattgtgccactgcattccagcctgggtgacacagcaagactctgtctcaaaaaaaaaaaaaaaaagtaacctcctcattgaagccccagtagccatccctgtgaggatgagcccagctcctgggcctccatgcctccttcctggccttatttccctttgtaggacttaacaccctcccacttagcaccttcatacatttgattttgtaatttttctccttgttggtctttccccatagaaagacaactctgccagggcagggatttttttctttgtcctcaactgtgttcttagtgcctgaatgaatgaataagtgagatacaaaataatgggagtttccaaacggctcatctgtgagcctgtgtgggaagggcctctcgcagggccccagcactggctgttctcggtgtgtttctccatcatttgtttatggagttgcctttgagtttcccgaggggcagggttgatcaatctggttccccagccccacaacacacgataagaatcaatatcactctagctcgtgactgaatcatttccttcacccacaggtggcaagtgcaggcagctgtcccggttatgccggaatcgttgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgctaagacaaaaagtaaagcactgtggtctttgccc

SEQ ID NO: 408 - DNA, 11451 bp, Homo sapiens
cgcctctactcccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcgggtgagactgcccggcctcctggggtcccccacgcccgccttgccctgtccctagcgaggccactgtgactgggcctcgggggtacaagccgccctcccctccccgtcctgtccccagcgaggccactgtggctgggccccttgggtccaggccggcctcccctccctgctttgtccccatcgaggcctttgtggctgggcctcggggttccgggctgccacgtccactcacgagctgtgctgtcccttgcagatggccgaggctggcttcatccactgccccactgagaacgagccagacttggcccagtgtttcttctgcttcaaggagctggaaggctgggagccagatgacgaccccatgtaagtcttctctggccagcctcgatgggctttgttttgaactgagttgtcaaaagatttgagttgcaaagacacttagtatgggagggttgctttccaccctcattgcttcttaaacagctgttgtgaacggatacctctctatatgctggtgccttggtgatgcttacaacctaattaaatctcatttgaccaaaatgccttggggtggacgtaagatgcctgatgcctttcatgttcaacagaatacatcagcagaccctgttgttgtgaactcccaggaacgtccaagtgctttttttgagattttttaaaaaacagtttaattgaaatataacctacacagcacaaaaattaccctttgaaagtgtgcacttcacactttcggaggctgaggcgggcggatcacctgaggtcaggagttcaagacctgcctggccaacttggcgaaaccccgtctctactaaaaatacaaaaattagccgggcatggtagcgcacgcccgtaatcccagctactcgggaggctaaggcaggagaatcgcttgaacctgggaggcggaggttgcagtgagccgagattgtgccaatgcactccagcctcggcgacagagcgagactccgtcataaaaataaaaaattgaaaaaaaaaaaagaaagaaagcatatacttcagtgttgttctggatttttttcttcaagatgcctagttaatgacaatgaaattctgtactcggatggtatctgtctttccacactgtaatgccatattcttttctcacctttttttctgtcggattcagttgcttccacagctttaatttttttcccctggagaatcaccccagttgtttttctttttggccagaagagagtagctgttttttttcttagtatgtttgctatggtggttatactgcatccccgtaatcactgggaaaagatcagtggtattcttcttgaaaatgaataagtgttatgatattttcagattagagttacaactggctgtctttttggactttgtgtggccatgttttcattgtaatgcagttctggtaacggtgatagtcagttatacagggagactcccctagcagaaaatgagagtgtgagctagggggtcccttggggaacccggggcaataatgcccttctctgcccttaatccttacagtgggccgggcacggtggcttacgcctgtaataccagcactttgggaggccgaggcgggcggatcacgaggtcaggagatcgagaccatcttggctaatacggtgaaaccccgtctccactaaaaatacaaaaaattagccgggcgtggtggtgggcgcctgtagtcccagctactcgggaggctgaggcaggagaatggcgtgaacccaggaggcggagcttgcagtgagccgagattgcaccactgcactccagcctgggcgacagaatgagactccgtctcaaaaaaaaaaaaaaaagaaaaaaatctttacagtggattacataacaattccagtgaaatgaaattacttcaaacagttccttgagaatgttggagggatttgacatgtaattcctttggacatataccatgtaacacttttccaactaattgctaaggaagtccagataaaatagatacattagccacacagatgtggggggagatgtccacagggagagagaaggtgctaagaggtgccatatgggaatgtggcttgggcaaagcactgatgccatcaacttcagacttgacgtcttactcctgaggcagagcagggtgtgcctgtggagggcgtggggaggtggcccgtggggagtggactgccgctttaatcccttcagctgcctttccgctgttgttttgatttttctagagaggaacataaaaagcattcgtccggttgcgctttcctttctgtcaagaagcagtttgaagaattaacccttggtgaatttttgaaactggacagagaaagagccaagaacaaaattgtatgtattgggaataagaactgctcaaaccctgttcaatgtctttagcactaaactacctagtccctcaaagggactctgtgttttcctcaggaagcattttttttttttttctgagatagagtttcactcttgttgcccaggctggagtgcaatggtgcaatcttggctcactgcaacctctgcctctcgggttcaagtgattctcctgcctcagcctcccaagtaactgggattacagggaagtgccaccacacccagctaatttttgtatttttagtagagatggggtttcaccacattgcccaggctggtcttgaactcctgacctcgtgattcgcccaccttggcctcccaaagtgctgggattacaggcgtgaaccaccacgcctggcttttttttttttgttctgagacacagtttcactctgttacccaggctggagtggggtggcctgatctcggatcactgcaacctccgcctcctgggctcaagtgatttgcctgcttcagcctcccaagtagccgagattacaggcatgtgccaccacacccaggtaatttttgtatttttggtagagacgaggtttcaccatgttggccaggctggtcttgaactcctgacctcaggtgatccacccgcctcagcctcccaaagtgctgagattataggtgtgagccaccacacctggcctcaggaagtatttttatttttaaatttatttatttatttgagatggagtcttgctctgtcgcccaggctagagtgcagcgacgggatctcggctcactgcaagctccgccccccaggttcaagccattctcctgcctcagcctcccgagtagctgggactacaggcgcccgccaccacacccggctaatttttttgtatttttagtagagacgggttttcaccgtgttagccaggagggtctcgatctcctgacctcgtgatctgcctgcctcggcctcccaaagtgctgggattacaggtgtgagccaccacacccggctatttttatttttttgagacagggactcactctgtcacctgggctgcagtgcagtggtacaccatagctcactgcagcctcgaactcctgagctcaagtgatcctcccacctcatcctcccaagtaattgggactacaggcgcaccccaccatgcccaccttatttatttatttatttatttatttatttattttcatagagatgagggttccctgtgttgtccaggctggtcttgaactcctgagctcaagggatccttttgcctgggcctcccaaagtgctgagattacaggcatgagccaccgtgcccagctaggaatcatttttaaagcccctaggatgtctgtgtgattttaaagctcctggagtgtggccggtataagtatataccggtataagtaaatcccacattttgtgtcagtatttactagaaacttagtcatttatctgaagttgaaatgtaactgggctttatttatttatttatttatttatttatttttaatttttttttttgagacgagtctcactttgtcacccaggctggagtgcagtggcacgatctcggctcactgcaacctctgcctcccggggtcaagcgattctcctgccttagcctcccgagtagctgggactacaggcacgcaccaccatgcctggctaatttttgtatttttagtagacggggtttcaccatgctggccaagctggtctcaaactcctgaccttgtgatctgcccgctttagcctcccagagtgctgggattacaggcatgagccaccatgcgtggtctttttaaaattttttgattttttttttttttgagacagagccttgctctgtcgcccaggctggagtgcagtggcacgatctcagctcactacaagctccgcctcccgggttcacgccattcttctgcctcagcctcctgagtagctgggactacaggtgcccaccaccacgcctggctaattttttttggtatttttattagagacaaggtttcatcatgttggccaggctggtctcaaactcctgacctcaagtgatctgcctgcctcggcctcccaaagcgctgagattacaggtgtgatctactgcaccaggcctgggcgtcatatattcttatttgctaagtctggcagccccacacagaataagtactgggggattccatatccttgtagcaaagccctgggtggagagtcaggagatgttgtagttctgtctctgccacttgcagactttgagtttaagccagtcgtgctcatgctttccttgctaaatagaggttagaccccctatcccatggtttctcaggttgcttttcagcttgaaaattgtattcctttgtagagatcagcgtaaaataattctgtccttatatgtggctttattttaatttgagacagagtgtcactcagtcgcccaggctggagtgtggtggtgcgatcttggctcactgcgacctccacctcccaggttcaagcgattctcgtgcctcaggctcccaagtagctgagattataggtgtgtgccaccaggcccagctaacttttgtatttttagtagagacagggttttgccatgttggctaagctggtctcgaactcctggcctcaagtgatctgcccgccttggcatcccaaagtgctgggattacaggtgtgaaccaccacacctggcctcaatatagtggcttttaagtgctaaggactgagattgtgttttgtcaggaagaggccagttgtgggtgaagcatgctgtgagagagcttgtcacctggttgaggttgtgggagctgcagcgtgggaactggaaagtgggctggggatcatctttttccaggtcaggggtcagccagcttttctgcagcgtgccatagaccatctcttagccctcgtgggtcagagtctctgttgcatattgtcttttgttgtttttcacaaccttttagaaacataaaaagcattcttagcccgtgggctggacaaaaaaaggccatgacgggctgtatggatttggcccagcaggcccttgcttgccaagccctgttttagacaaggagcagcttgtgtgcctggaaccatcatgggcacaggggaggagcagagtggatgtggaggtgtgagctggaaaccaggtcccagagcgctgagaaagacagagggtttttgcccttgcaaatagagcaactgaaatctgacaccatccagttccagaaagccctgaagtgctggtggacgctgcggggtgctccgctctagggttacagggatgaagatgcagtctggtagggggagtccactcacctgttggaagatgtgattaagaaaagtagactttcagggccgggcatggtggctcacgcctgtaatcccagcactttgggaggccgaggcgggtggatcacgaggtcaggagatcgagaccatcctggctaacatggtgaaaccccgtctttactaaaaatacaaaaaattagctgggcgtggtggcgggcgcctgtagtcccagctactcgggaggctgaggcaggagaatggcgtgaacctgggaggtggagcttgcagtgagccgagatcgcgccactgcactccagcctgggcgacagagcgagactccgtctcaaaaaaaaaaaaaaaaagtaggctttcatgatgtgtgagctgaaggcgcagtaggcagaagtagaggcctcagtccctgcaggagacctctcggtctctatctcctgatagtcagacccagccacactggaaagaggggagacattacagcctgcaagaaaagtagggagatttaaaaactgcttggcttttattttgaactgttttttttgtttgtttgttttccccaattcagaatacagaatacttttatggatttgtttttattactttaattttgaaacaatataatcttttttttgttgtttttttgagacggggtcttactctgtcacccaggctgagtgcagtggtgtgatcttggctcacctcagcctcgaccccctgggctcaaatgattctcccacctcagcttcccaagtagctgggaccacaggtgcgtgtgttgcgctatacaaatcctgaagacaaggatgctgttgctggtgatgctggggattcccaagatcccagatttgatggcaggatgcccctgtctgctgccttgccagggtgccaggagggcgctgctgtggaagctgaggcccggccatccagggcgatgcattgggcgctgattcttgttcctgctgctgcctcggtgcttagcttttgaaacaatgaaataaattagaaccagtgtgaaaatcgatcaggaaataaatttaatgtggaaataaactgaacaacttagttcttcataagagtttacttggtaaatacttgtgatgaggacaaaacgaagcactagaaggagaggcgagttgtagacctgggtggcaggagtgttttgtttgttttctttggcagggtcttgctctgttgctcaggctggagtacagtggcgcaatcacagctcactatagcctcgacctcctggactcaagcaatcctcctgcctcagcctcccagtagctgggactacaggcgcatgccaccatgcctggctaattttaaatttttttttttctcttttttgagatggaatctcactctgtcgcccaggctggagtgcagtggcgtgatctcggctgacggcaagctccgcctcccaggttcactccattcgcctgcctcagcctcccaagtagctgggactacaggcgctgggattacaaacccaaacccaaagtgctgggattacaggcgtgagccaccgcacccggcctgttttgtctttcaatagcaagagttgtgtttgcttcgcccctacctttagtggaaaaatgtataaaatggagatattgacctccacattggggtggttaaattatagcatgtatgcaaaggagcttcgctaatttaaggcttttttgaaagagaagaaactgaataatccatgtgtgtatatatattttaaaagccatggtcatctttccatatcagtaaagctgaggctccctgggactgcagagttgtccatcacagtccattataagtgcgctgctgggccaggtgcagtggcttgtgcctgaatcccagcactttgggaggccaaggcaggaggattcattgagcccaggagttttgaggcgagcctgggcaatgtggccagacctcatctcttcaaaaaatacacaaaaaattagccaggcatggtggcacgtgcctgtagtctcagctactcaggaggctgaggtgggaggatcactttgagccttgcaggtcaaagctgcagtaagccatgatcttgccactgcattccagcctggatgacagagcgagaccctgtctctaaaaaaaaaaaaaccaaacggtgcactgttttcttttttcttatcaatttattatttttaaattaaattttcttttaataatttataaattataaatttatattaaaaaatgacaaatttttattacttatacatgaggtaaaacttaggatatataaagtacatattgaaaagtaattttttggctggcacagtggctcacacctgtaatcccagcactttgggaggccgtggcgggcagatcacatgagatcatgagttcgagaccaacctgaccaacatggagagaccccatctctactaaaaatacaaaattagccggggtggtggcgcatgcctgtaatcccagctactcgggaggctgaggcaggagaatctcttgaacccgggaggcagaggttgcggtgagccaagatcgtgcctttgcacaccagccaaggcaacaagagcgaaagtccgtctcaaaaaaaaagtaattttttttaagttaacctctgtcagcaaacaaatttaacccaataaaggtctttgttttttaatgtagtagaggagttagggtttataaaaaatatggtagggaagggggtccctggatttgctaatgtgattgtcatttgccccttaggagagagctctgttagcagaatgaaaaaattggaagccagattcagggagggactggaagcaaaagaatttctgttcgaggaagagcctgatgtttgccagggtctgtttaactggacatgaagaggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagagatatgggagcacccagcgcaggatcactgtgaacataaatcagttaatggaggaagcaggtagagtggtgctgggtgcataccaagcactccgtcagtgtttcctgttattcgatgattaggaggcagcttaaactagagggagttgagctgaatcaggatgtttgtcccaggtagctgggaatctgcctagcccagtgcccagtttatttaggtgctctctcagtgttccctgattgttttttcctttgtcatcttatctacaggatgtgactgggaagctctggtttcagtgtcatgtgtctattctttatttccaggcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatctac

SEQ ID NO: 409 - DNA, 10957 bp, Homo sapiens
ctttgtccaccaggccagatggagaggaagggagattggattcccctccccacccacacatacccaggtgccaagagactcagctgtggggggaggtggaggtcagtgggaccaggctgagccgattatggaggagtgggggggaaggaatagttgcttccccgagggcggggggtgcccagcggacttgagaacagttcatcacccccactagtatcccttccccagtaaaagactcaacggagcccgttccttgcgaccctatccccaaaaggaattccgggggtagatttggggttatcacaggatcgggtgcacagggccacacggctctcaggcccctcctccagcctgtcctgcgcggacgagggccgggccatgcagctgtgggtggccgaggagagcgggtcttggtgggcgcaagcccgagcggaggatggcgcgcagcgagcagagccgggagctaggcggggcgcagggtcccagccggagctcggagggacgcgggccgggagcgaggcggagccggggctggcggggccaaggcggggatgggggtgcagggggctcggcagaggcgccgggcgggcggcccgggccggaaggactggcctggcgggagcggaggggcttggagccgggcgcagcgcgggcggtgcggggaaggccgtggctggggaccgggcttcaggccggacgcccctacccccaacccgtggggctctgggagtggcaggggaagggtcgcccgagccctccaggaagcggccgccgctcggggcgcaccgcggcgcgcggggcggggcgggcggctgcggcactggggcggctggggcgggcccgccgctctgtaatcggatccggggagggggcggggaggggccgggccgggcgggccggggggtggggggggggcgcggagccgggctccgggccggccgggctccgcgcctgtcaaacccctcattgttcgcagctgatgtcactcgcagttgtgagcggccgcctctcccggggacaatgtgggactgagcggcccagccgccgtgccgccgccgccgccgccgcaggacagccccagcgaggtagggcgcgggccgggcggggcacggcgggccgcgaagtttgggggttcgcccgggggcagggagcccgcgcccagatccctcggttggggtcgcaggtttgtgagactgcgaggaacacgttctctgtcccacaccgctgaggcctgcacaggtgggaggcgctggtctgccagaggcgcccttggcaccagggaggggcttcctggaccttagatcccagatttgaggcccccatcccactcgctgtttctgtcctttgcgcctgctcctctctctgactcctgccctgggttctggttctgctccatctctgccctcacttgccactcccctgtagctcctggctgggcacacactccttcccatcctccgcagtcgttgggggagccagatacagacctccaggccaggggtgtatggagatgacagctgggggctcagagtggtccctcttgccccatagctcttcagcccttcagctctgacctagcttcttggctggggtcctggggggtgggggtgggaggctctgctactcacttcagcctggccctcatgcctgcctggccaggagagggaggtgcccgcctcctctctcccctatccctggcccgccatcttgagacctgtggcacccagtgccccacccggccccagcacccaggggagtggtctccaaggtgatgatgcacccagggccagttgcattcctttctccccaccaagcccaggatgctcatgttcgtgctgaaccagcaggacatgtgtccccaggggcttgccttccgccacaaaggctcttacaatccatgaactccctaggagctgagctcctgccctccctgttccctgggtcaccctcattgcctcaggaccagtacctgggaccctattctttccccatctgaaaaaatcccctggtcttcccaggtcctggagccccctcaacctccagggcacccccatcccagcccccaccccctagccttcatcagcatgcaggctcaggctgcccaaacacaaggggattgttcttcttgcatgctcagggtggggggctgggagcaggcagcccacacaccctggcaggcccaggccacgaggaggctggcttgccccaccctgtgtccccagacaggctgtccaccctccctactcccatcactgctgcccctccagcctccatcaccattgcccagtggcgctgacatcttgaggaaagagctctgagctgcacaggtagacccctgggttctccagctctgccagttgtctcccatgtagccttacaaacatttcccttcctctctgggccgcgagcccctcttgtgattggtaagacctttccagctgtgacaggctgagcccaactcgactctgtgaaacgtaccccaccccccagcccttcttccagtccccctcttccatgaggagacccactctgctcccaccctctgaaaacctaaagcacagcccaaatcccccaccccagcagcatacctagggagctcctagtcctggtaaaacggcaggagtagggctggggatgctgagaaaggaaccaggaatcctgtccaggcaggtcctacctctgcccatgtggctggccctcatgtctgggtcttctcactctactctcattactcctccgggaccctcagccccatctttggttccaaatgtccccaggccccatgaaccttaactcttctccctgcacactgaccctggtcttgtctcaaatttcctctttctggagctctgtgtatagtggaaagacaggctcagaaatgcccagcggggacttctttgagttgcagcaacatctttgaggggcacagaggcctgagtgatcacatctgacttggaagcctgcggagggcttcacagaggaggtggcgtttgagaaggattttgacagagagtggggaggatgggcgttttgagctgaggtaagcctggagaaaggcccgaagggctggaggtgctaagtgtgttctgcagcctggcatgtgtgaaggatggggtggagatgagacaagagagacaggggctggatcatgaaggtccttgatggcctgtctgtggagttcaggctttattctttggggactgggcagccatgggtggctgttgagcagcagagtaagcatacagttttcagcatggagattggaagctagaggcctttctcaatgtagatgagagagtgaggggatgggtaccatgaggctgtggcctttctcctggagcccagcctgggcccgggcttgacttggtttcccttggttccgaagactcctgggggctgcctaatgatggtgtatggaagctgtagcatttctggcacctgccaacttgtcagagctgcctttcccttcctggcactttgtctatgtggcagatctgaatcaagaagccagaggctggaacttgtggaccccaggatgctcacctgaggcttcccactcccctcctcctctcccaactgtagatgattggctatcccgggaggctgggaggccaagaggctgggcacatgtgtccaagatgctggggcagttcttatgaaggcctggctagttaggagagtgagcatctccagagaagggattgggcaggagagttaggagccctcgatgcagacgtgctgtggcccagggtccacccccaccacaccctgcctccctggatgctccgagccattccccagcatcactgggtgtggctagcatggctgctttgggagtgggaataggagaagggggctgctaggtggggagctgggggtgctgagaggatgtggggggatgtgagatggagagtgaagcccaggtgggtccacaggccctagctggtccagacattctggccagcagagcggagggaatcccccaaggggcgggccagtctacttgaatcgcctggccccaggagccctcccctcccccggattgttcttgctccagaacaaaggcagggtggacacttgatccctgcatgtggggtgagctggctaagcccccagccctttgattgggcagctgtcatgggagagagacagctgggggggaggggcaggaagggggcagccaccatcgcttacacagctgtcacccccccgcctcctccagcctgagtggcagaaagccagggacaggaggagtgggcactggggctggggagggggcctgggagtcaggagggaatgcccgaggtcagaggcctggtgtgagcttggtatgccctgccagggagccctgctgaccagagggggctgggcacccgcggaggtgagctggaggtcactgtggcatgttgtgtggctgccacgtgggtggcccggcaaagacccagggcccacccggctggagcagcaaatgactccctagagccccactgagggcagggggagccagtgatgcctcatggggctgctcgttccttgggccctaggagaataatttggaagacatgggtcagaaccccttgttcttgcctaaagatgggaaagaccttgagagtctctcagaccaggaagggcgcagatagaccagcaactctctccctacccccagcccctaaacacaatacaggtgggtttaggtcaggtgaagacctggccaaagttacccactggacttggggcggtgggtctctgctggagacccaggcatcttttcatggcagaagctctagttctggccatgttccagccctcctgccccatttttcctggagccacaagaggtcatgtggagatggtttggggacaatgtcaggtctcccactggttaccatcccaagggggtccttgaaccccagaaaattttggaacttaagaccgaggctctggacaagttgtcagtcctttccaaataggatccctgtcttctagctaggcaaaggtctcagagacgactgaagcccaatccccactttcgaaggagcccgccctccaggaagaggactaacagatccagacaggagcagcctgaaaggggaggcagatggggctttggatagcctcacactagcaatgctagtcccactgtgtcccacctctctgtgaccttgggcaggttactgatcctctccaggcatcaggttctcctgtgtagtgaattcatctgctcagctaaccagtatgttagctgagttccagctgagctcagtatgttctgagcaccttctctggcctggctctgaactgagccctggggacataaggagaaggcagcagccttggctcctgctccaaggggctcctgggcttggctgtccagagaagcagaaaccaagcacgtcatcacaagtgctttgatgggggaagtgcaggcagctgggggaatgtctagcaagggcagccagcatgaggctggccaggatgctcggagagcacagtccctgcatccactgctcatctccagcctctggagtccctgtggcagaactcaaatggaaggaggagcagctgcacccaggggagcagggtgtcacctccgttggataggtgaggaaacaaagaccttatgccatacggtggcttgctgggacttctgagaaggagccaggctgggagcccctttcaccttccgtgctcaagctctgtctagcaaggggagttcagaagagggcgttggacagaactccatgccctttcctgtcatgttgggatggggcagggggctgaggaggaaggcgcccagagacttctggagtgttccaagctcagcacactcatccttcatccccacaccctcctgggcatgaggaatttgcagtgttagggcttggtcttggcccagacttagcaccagttggtcccactccctgttttccccatagggttctggtcccccagtgagctccccatcaaggctgagccttggcaggagacagacgcctaaggagagggatttccaagcaggattaaggttgaggattaagtcggggcatgaaaaagggtcgggtggggagggctggccactgagctaatcccagcagctaatctcaggctccaccttcctccatcagttaatggccttgacattcccgcagcccaccaaatccttttcttacccatcacgcagtcccagggagaggtattccctccattttataagtgaggaaattgagactcagagcccaagtgacttgtttctggtacagtagaaagtgttccaggctgggaatgtggccagcctggacacttcttacctcctgttcccaaggccatttccagcacatagaagagagattggaaaccaacgtgcagaactgccagtcccctgacacgctgtgccccacccactgcagcccagtgctgaatgaaccctgcccagaggtgtctgtagtgagcttctgccctagtgacttttggtaggtgggagtgtgcctcaattcccccctcaacccctgcctcaagcctttaccaggcagtggcaagacctgaccacacccgaggcctccctgccttcaaggcttcccatggctgctccagcttcctccccagctgctcttctgtgctccatccaccatctggctgctggacgaaagtgcctctcatatggagtaagctttcagcctgaactccaccttcagggccccatccacagaggttacctcttccaagaggtcagggaggaggctctcctcctgactcccataggcttcctagttaattatttcttttagtgtctcagggtaagggaaaggctaggtacctaccatgtatgtgcttattgttttaattctcatcactctttggagatgggaatttgtatccccttctacagatggagaagctgaggctcagagggttgaatgggctccccaggcttacacagctcgtgagacacacataagcaccctggtcagagtgatgtgtggcgctcaaggtccatgcagtctctttcctctgggagtttgactagcccagctctggggtccccatgtaagggcaggggcagggtggactgggctcctctcgaacccctctttggctgcccctgccagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggtgagcgggaggtggagggccaggcgaggcaaggctgggctgggctgggtttcactgggtatcccagtggggaggggctgggcctgggcactggcacccatctgacggctcttgtcttgtccgcaggaagtgggcagcatcatcgggaaggtaggtgcctagctctgctctgtacatccccctccagctgaggcttcagcccagggaaggaggctgtgacctctaagttaagagtgattatctgttttgtacctcccacagaagggcgagactgtaaagcgaatccgggagcaggtgaggatggagtttgggggaggagcccagggcacctgatgtggaggggagatccctgccccactttctctctgaaccactccttctgggctgaccagtgagtcccccagagggtggcagttttgagccttgcctcaggcctggtgagtggggcaggcagacaagttccggcaagggagcagggaagatgccccgctgcccggcgctcattctatatctgcagagcagtgcccggatcaccatctccgagggctcctgccctgaacgcatcaccaccatcaccgggtctacagcagctgtcttccatgcagtctccatgattgctttcaaactggatgaggtccgtggctggccagggcaggacgccaagagtggttccccaggaggaacccaactctgactccagatagtggctatgggtgggaggggaggtcaagcccagggcagtgttcccttgaagtgggactggggaaagggtaccctcctgacccctgggcagatatagcagggacgagcatggccaacccaccgtctccctgtcccaggacctttgtgctgctcctgcaaatggtggaaatgtctccaggcctccagtgaccctgcgccttgtcatccctgccagtcagtgtggctcactgattgggaaggctggcaccaagatcaaggagatccgagaggtgaggggcgagatataccacccacagggaatccggggcaagggagcagttgtaagaggggtgttgggcttatggcgtcctccccacctagagagctctgagcctgggcagcccttttctgggttatgggagcagccagaagtggcccctgttctctgtttgcagactacgggtgcccaggtacaggtggcaggggacctgctccccaactccacagagcgagctgttacggtatctggggtgcctgatgccatcatcctgtgtgtgcgccagatctgcgctgttatcctggaggtgctgccctggggcagggagagagggggcaggagatgggccctgggtctgccttgtcggggaccccaaaccctatgcctgtgctgcaggtggggcagggcagggctgcagggatggatgatgagctccagggatcatgtgcatttccctgggggtcatggtgggggcctgaggccactgggcagctggggaggttatcggagcctgagagggtcctgacagagccctgtttatgccttccagtccccacccaaaggagccactatcccctaccatccgagcctctccctaggtactgttcttctctctgccaaccaggtgaggggaacaacaggagcagtgggacacattactggagaagggggattgagatagaggaggggatggaagaaggaattggaggtccagggacgggggaaggagtgactctggctgaactgcaatgtcacagtaacccccttttcatccactttgtccccacagggcttctctgtccagggtcagtatggggctgtgaccccagctgaggtgagtgacccatagcccaaggcaccccttcctgaaccatgcctcctctgacctctgacccctctttggcacaggtcaccaagctccagcagctctcaagccatgcggtcccctttgccacacccagcgtggtgccaggtaagccacccctgcacaaggaggcagggggagggtcctaagagggcagccccctcccttccagggagagtggaaatggtggggcgggaaaggcccagaaccacactcagtccctcttctccccctcaggactggatcccggcacacagaccagctcacaggagttcttggttcccaacgatgtgagcaggggatgggatggctggagggtgggtagggggtctgggggtctggacctcacccagggctgaattctgccttccctctagttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctggtgagcgcgggctgggcggcagtgggggagcaggtcacggttctcatgtgcccaagaaaggcaggggtggggagaggaagctggcctcctctctctgtctgggcccgacctctgcctctcctaaccctactccaattccccatggtctttgcctaattcaccctctgttgccccatctcccccctctatatccacctctcattctccattgctgtgtcttttccctgggtctctggccaccccatttctccctgcacctcgtgctatatctgcttgtcctttcttcccttcctcttccacctttcccatcttccccttattgttctctgttcactacctctctcttgcctttcatctaatctcatgcccatctctgccctcattgcccctctctcactcccactttcccctttgtctcccctctatatccctctctccagtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccaggaa

SEQ ID NO: 410 - DNA, 130804 bp, Homo sapiens
gggcagtccgcactgcaattggttggcgtctccgggacggatttgaaacttggcggttaaagctccggctgggacagggcggcgggaggcccagggagaacggggaagggacatttagtttggtgagttacgggggcacaccttagctcagaacctgtttttacccagtaccctagggctttggttctttgtcgccgtccccgttggagttttttctttgcctttcagaagcccgtgcactctctttagagtgcagggctgacgggcggtccagccctggccaagtcatggagcgtgaatctcccaagtcagtgttcccgctgaggagggtcggaaccggggaggacgccctcccacccctgctgacctactaacattcatcagcgagccttctttttccccctcgcagagacggtgctgagataggatcatgaaggaagaggtgaagggaattcccgtaagagtggcgctgcgttgtcgccctctggtccccaaagagattagcgagggctgccagatgtgcctttccttcgtgcccggagagcctcaggtgcgtagcagagtccagagcctgtgtctgaacagctggggccaaatggtaacgaggggtgtggtcttgcctttcatttttaaccttacgccttgtcccgtgccttctctaggtggtggttggtacagataaatccttcacctacgattttgtatttgatccctctactgaacaggaagaagtcttcaatacagcagtagcgccactcataaaaggtgtatttaaaggtaaggcgatttgattcctcgaacgtaacatatatattccttgagcatatactatgtgccaagcactgtgcttgggcactgcaaatacaggaatcgatgaatcatgattcctgccttcaagaagcccttagcctaataacatttgtcaacgtctctgtacccttgaagctagttttattctgtatttgctttatgtggttctgttcatctttgacttgtatatgtttgtttatcctggaacttcattagattataaactctgtggtggttgctgatggtgataagtgtgccaacctacttgaggcccaggcactgcaaagcttgttgagggattcaggtgataaataatatagcttcgaggccctgaaggagttcaaagtccaggggataggaatggagatagatgactacataaataattttgaatatataaaaatttttaaattttttgtacctatcttttagaagaaaaatttttcaagttaaaaatatacaacagagtcagtcctatggaagtagtagctctgctctcatacaaagtggtatgaaaaacaaaaggatggctctaactctgcttggggaatttggggtgaatttcacagagtgggaaaactttgagatgggtcttgaataatgagtatacttcttttaggtggagaaggggagtgcctaaagcctctgaatactatcaccagttaataatctttactggggaagctaagtctttaatgctgttgaggaccatagcagggttctaaagaagggagcagtgcctgagagatgtctaattattattctaatacagtggttattcaagattcaaaacagaggttcgtttaaaagaagtagaatcatggcatgctagtgccttaaagttgaaagagacatttgtatatcatctagtttgtttttcatccaaagaaaaatgcgttctaacaatatctgttaggtgaactgccagtgtctaaaatttttttgacagggaactcactgactcacaggtagtccagttgagatttgggttttggacaagtctaattatgttataaagatctttataatgagatgaaatttgcttcctggtaatttctacccagtgatgttagttcattcctttagaagccttcttctaggcaacagctattcacatattttttcacgtttttttgtttaatgatatggctcaaggaacactgaaatttttgtttcaaaattttaagatattaatgcaataatttcaaacgtatagaatgttgcaagaacagcataaaaaacattttttccctgaaccatttgagatgaatcattggcctgataaccccccatactttagtgtatatttcctacaaaaaaggactttcttctaagttaccacaatacaaccatcaaaacaataaaatttgcactgctacattactaccatctattcctgaaaccccattcaagtttcaccaattgtcccagtaaatattttatggcaaaaagatctagttcaaaatcacgttttatttagttttgctgtctctttagtctccattctaaaacagttctttagtctttttttgacttttatgagtttgacactttgaagattacaggccagttattttgtaaaccttttctcaatattgttttgtctggcatttacttatgattagattcaggttgtgtatcttttagcaggaatatcacagaagtggtgctgttttcttctcactgaagcctattgggcagcacatgattttgatttattctattactactgatgttcattttgatcatttgattaaggtgttaatctgctgggcttctccactataatctttttcctttttacatacagtatttggaaaaccgttaagtgtttctacctaattctcttcaattatccccgcctttcctttagccattcctgaaacaatatgcttttcagaccctgcactatctggtcagattcctcaggctatacctccacagcttagtaagagcaccacagttctacttttacattcttaacttgggaaactgatagaattaaattatgttctttaaaggcaacataaagtagaaagtgattccaatatacatgtgtttgcttaacattacccttggttgcaaaaacaaagtcaatattttttatagtcagctcaacagcaccctcttgtactctgaactcctggtaccacagagccctaagtattttgtaaaaactactaaaacctcatttcccaagttattgctatctgcacatatctgtggtattgcagaaaattatggaatgttattctcttgccccatagtcatgccagctgataccagcggtctattacagtgaaaatctcaatttagcatcttcttatgatccttcatttagaccaacaagttttttcaaaacttcaaagttttcatttagattaaaacgttgtttcaaagtttaaagggttttttccttcagactgcaaaattatcttggtaaatagcagataacagctttgacataaatatgatgatcatttaacagagaaagcttgctttgtgttccttgacaacatgtctgccacactaataaggaacagacttccctaaggtcattatttttttcaccttgaagtaaatttgcatttgtagttccttttaggtgccatgcttatagttttagaagctactactgtacaattaagtagcaagttataattatgcatcagttaacgacagggataccttctgagaagtgcattattaggcggttttgtcattgtatgaacatggtggagtgcatgtatacaaacctagatagtatagcctcctatacacctgagcctactgctcctaggctacaaacctgcaaagcatgttactgtactgaatactgtaggcggttgtaacatcatggaaaatatttgtgatctaagtatagaaaaggtgaggtaaaaatacagtatgaaaggtaaaaactgatacacccgtatagggcaattaccgtgaatggagcttgcaggactggaagttgctctgagtgagtcagtgatgagtggtgagtgaatgtaagggcctaaaacattattgtatactactgtagactttataaacactggatacttagcttacactaaatttattaaactttgtgtctttcttcaatcataaattaaccttcgcttattatacgttttttactttataaactttaattttttaaatctttttgacttttttgtaataatacttagcttaaaacacaaatacattgcacagcggaataaacattttcactctgcatctttattctgtaagcttttttctttttaaaaaaatatatttttttactttttaaactttttgttaaaaactaagacacaaacatacacattagcctaggcccacccagggccaggatcttcaatatcactgtcttccacctccacgtcttgtcctactggaaagtcttcagggacaataacatccatagagctgtcatctcctatgacaacaatactttcttctggaatacctcctgaaggacctgcctgaggctgttttacagttaactttatttatcataagtagaaggagtatactcttaaaaatgataaaaagtatggtatagtatactaaacacataaactagtaacaatcatttattattatgaagcgttacatactgtacatagttggatgtgctgtacttttatatgactagcagtgaagtaggtttctttaccccagcatcaacacaaacatgtaacatgttgcactgcaatattataatggctaagtcaataagcaacaggaatttttcaccatcgtgtatacattccacatgattgaaatgctattatatggcacacgactgtaacaattgaagttaaagtaagaataacctgtctattgtctaattgtttctttataaaatcttgctacagttgtttatcttcctctagcttcaatccaaactttgaatttacgggataaaacgaaaatgcccgctgggcatggtcgctcaagcctgtaatctcagcactttgggaggctgaggtgggcagatcatttgatgtcaggagttcgaaaccagcctggccaatatggcgaaactcgtctctaccaaaaaatacaaaaaaattagctgggcatagtggcgcgtgcctgtagtcctagctaccctggaggctcaggtgggaggatcgcttgggcctgggaggcgaagccgtgatagcacacactgtgctgcagcctgggtgacagagtgagaccttgtctcaaaaaaccggggagggggagtgctgagtaactagtaatctggattatctgacaagagaaaatataaaaactaatctacaaaataaacatttttaccagaactaagcccaaacagaaatatacttttttttgaaaccgaatctccctcagtggcccaggctgaagtgcagtggtgcgatctcggttcactgtaacctccgcctcctgggttcaagcaattctcctgcctcagcctcccgagtagctgggaccacaggcgcccaccatcacacccagctaatttttgtgtttttagtacagatagggttttgccatgttggccgggctggtttcaaactctgacctcaagcgatctgcccgcctcggcctcccaaagtgctcgattgcaggcgtgagccaccacgcctggccaataaactcaaacagaaatatattttatgggtctttctgcaaacagtactgataacataagtgataacgaaaaacacagcctctgttcaataatgccttctatttaataatttaaaaaatacaaacgggggaaaagaaaacacaaaaaatttaccatcctatggcttggtgtggtggctcacgcctgtaataccagcactttgggaggccaagatgggcggatcacaaggtcaggagatcaagaccatcctggctaacacggtgaaaccccgtctctactaaaaattcaaaaaattagctgggcgtggtggcacgcgtctgtaatcccagctactcgggagactgaggcaggagaatcgcttgaacccgggaggtggaggttgtagttagccgagatcgcgccactgcactccagcctgggcggcagagcgagactccatctcaaaaaaaaaaaaaaatttaccatcctatttctcagagataaacatcaaaataattaataatttatatacttttgatcttttcctatccatacactcatatttaacaattatttttaagctgcttttttcagttaactatattgtgaacatctttgaataaatgatgcttttttttttttttttttttgagacagggtctgctctgtcacctaggctggagtgcagtggcttgatcaaggctcactgtaacctctgcctcccaggctcaggtgattctcctgcctcagcctccaaagtagctgggattataggcacctgccaccatgccctgttaatttttgtatttttagtagagacagggtttcaccatgttgcccagtctaatgttaaactcctgagctaaagcaatctgcctgcctcggcttcccaaagtgctgggattacaggtatgagtcacggaacctggctcattaatggatgattctttatcaattctcaataaaagcaaaggcatatatcacattgaattatgcttaaatgatgatatttctgtaagcagcctgataatatggttcaaatgcattctgagagttcagatatgaagtagatgctttcattgactgtaaaaagcaatgttgtttccttttcagataaatactgttaatcaagaaaatacatgccagaatcctttctttttctttaatttaatttctgtaatttaaaattgcttaaggtaggaagacagaattttcaagctccaatggcttttgacagtggcttggccaccttcatttagtcagtcatatcttttaagtgtttgatttcttagcttctaagggctatcactacggggacacattttagggttgggttttgttttgtttttgtttgttttttgcttattttgagtagtgcaaggtcatggtacccacagaacttttctttgtgtctgccattcttaagagactgtattaagagagcaatctcagttttattacaaataattgctgaaggaaatggagtatattgattagatgaaaatgtttaaacaccactatgcatgtgacgtctattttgtcaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagaggtaagcaatttatgtttaattattctgaattcgaaattgtctttgggtcgaaaaataaatccaaatcaggtttttcctgacatgactcaaattagtaagttgcattttaattaattgatagagaaaacttactgactcagttggatccggctcccacccagttctttccttggtgttagaatagtctgtttaatttgattgttggaggaattgacattgccatataaaaggtgataggaattctttaattccagtttggcctctgttactgattacctgtatagtctgcagaagagtgtttgatttccctttactgtttaagacttaaatgataatgctgttgcctcatgaagaatgttaaaaaccagctgaaatattgagctgtataagcggtgatagagtgtgtttattaaacagatatttactgagaacctaccatgtgccaggcccaattctaggcacttgggtatatgaggtacttggtatatatcagtgaacaaaacaaaaattctagcccttatgggagtttgtgttctagtgtatattagtatagttgtagactggccaattgtatctaacttcataacatcaaaaacacatctttagggaactgatggcttctgggaagctagctacttgattccatagcagtgatgtcttatcctttagggggtaataattaaacttatataatttaagcatgtgaacacttaatcctgaagttcaatctcagcatgctaacaggtaaagagatgtagaactggaagacaggggattacatcattaagattagccttcttggccaggcccggtggttcacgcctgtaatcccagcactttgggaggccagggcgggaggatcacttcaacccaggggtccgagaccagcctgggcaacatagtgagaccttgtctctacaaaaactttaaagattagccaggtgaggtggtgcatgcctgcagtcccagctgctcaggaggctgaggtagggtggaaggattgcttgagccccagagtgagaccttaaaggcaatttttaattctatttatttatttcttttgagaaagagtcccactctctcacaggctggagtgcagtggcaaaatcatagctcactgcagcctccagctcctgctcaagcgatcctcccaccccacctcagccttccaagcagctgggactacaagcgtgtgccacttcgcctggctaatttttaaatttttgtagagacagggtctcactatgttgcccaggctggtgacagacccctgggctcaagtgatcctcccattttggcttcccaaagtgctgggattataggcgtgagtgactgtgctcagctagattagccttcttgagtctcttgattaacctagttgtggccaacataattgaatatcaaaataactccagatcctggtatgttaaataatagcaatagcagtaatagcaaacacatgtagtgcttagatgtgctaaacactgttctaagtacttaaaattctgtttcatattgaaatattagctgccacttcttccttttccatccacccccatctatgtacctgttattcacattttaacaaaatgggtgaatgtaatgctattatgatgccatcaaagaactgaatttgcgtggtcatgtaacttttcatgtgtctgctgttcctaagagactgtcttaagagagcaatctcaattttgctacaagtgatatgtgaattcattcttataaaacatcaagtgattacctatagggttatggtccttttcttaattctacaagtaatacatgttcattatgaacaaatgtttaaatatagaaagtcacaaataattttaaaaattacctatgatctcaccacccagagattaccactgttaacatcttgtttttgccactttattttcaacaatatcagatttacaatgaagaaattttggatcttctatgcccatctcgtgagaaagctcaaataaatatacgagaggatcctaaggaaggcataaaggtgtgtttgtctctcatttgatgttattaaaaaaatttggcaattataatactaaagttcacatcccttttatctgccactgtggttttaaatgactactatcatctcagtcaggttttctgtggtcctaagtccctttgttaatctaaaatttctaggtgggagctcttgtggggaagcaaggaaagacgcatgttcagttttatcaccttcctgttacctagaggaatgccaatatcaattaaatattatttacagagttctaaggctgagcagtccagtatgttagccactagccacaagtggctatttaaatttaaatgaattaaaattgaataaaattttaaaaattcatttcctcaggcacactagccacgtatgaagtgctcgatagctacatatggctagtggtaaccatgtttgagagcacagatagatacagaacatatccatgtattttcttctgggtcattgttagccagctactaatgcatggatatgattgaacatatctatatccaatagaaaattctgttggacagcactgtaatagacattttgctgggctttgggatgatatttttaaaattgaaaagttaaactatatataatttttaaaacatgtaagtatcataggaagaagagatagcttatttgagaatcttctgtcagatggtatagatgcaagatgaggagctagaactgaacagaaaatgtgaggcaaaattgagagtttcctatgtgggagtgagccaaatccagaagccagtgttgaaaacaggcagagcttgagtattcaggagtgggaaaatcagaggctggaggtagatgaggctaggtagtactctggaaaacttggaataatatcttactcctgttctccttcccttcttctcttgcacaaagaaaaacagagaaagttgaagatttggggtaccagtgagggacaggtgcctgtgctcctgatttttttttctgggtcattaagttgttagccagctactaatgcaaagtttaaaggatcagccctgataagcttggaatatgcaaagatgatttggatagtgaggataagaaacctggacaaaatacatgctattgtactgagccagcacttgaccctgtttcaagatcttttatataccccatgttaaggcaggaattaagtcctaagagttgtttgaggtgagatttgcaatacagagaagtatgagttcctgacacaaattggtaaggaagagtttgtaaacactcttcagatgggatggataggctttaagtaagtagagaaaataaggatattcttatggtaaggaatagctttagcaggaaagcagaaaatatacacctgagggtaataagactacacaagtctgtctggattagaggatttgggctgggaagtaacaggagatatgttaggaccagattatgaagccgggctaaagagcttagtttctatccctgtgaaccatataaactatgtaaaacttctgagtgagggattactgtggctacttttaccaagtttttatcttatgtgtgtatctctccaactctgttacaagtgatatgtgaattcattcttataaggaattcaccctaacctggaggtcaggggagtactttgaaatctctttgtatcttcgttatctagcacagggcttagtaggttggtgacattttaggaaaaccaaacagaaatggattgaaaaggagaaagactgggatgagaaagaccagttggggaaactgttgcttattttttaggtgtgaagtaatatgggcctgaactaggcaagtagatgtgtaaaggaaaaggaagtgatggattcaaaaggagaatgactagtagttggtgatagatattatatggaggagtgggagaagttgaaggtgatgtgagtttttgagaatatgagacaagattaatagaaatggagaagtattatagtagagagaattagtgtttgtgggaggaagatgaatttggtttataattgactgatttcaaagtgtaagtggtaaggtagatcattagaaataaaagactagaaattagggccacagaagtaagtttgggagctatgaagtaataaaattatagcatattggagctagaaaagacttcataagcatctagtccaatcacctcagaggctccaagagattcaacttgtataagttctccaaggtaaatacagtactaagcctggggtcctgttttcctggcttcctaatccagtggaaactgtaccatgctatttcctctagtgaaaatgaggttaaaaatgaatcagaggtacagagaggagcatggggtcagataggggtgaaagtaacaaagagaaatgccatcgctgtttgtgttgtacttgctctccttgggaccagaattaacttcacttggggtttcttggaaggcacgtagccattgctaccctaaaatcttgagatcttttctagctccagtattagctggcacgcttgtttctgaagttcctaaggaagattggagaccttagtttccagctatcttcacagagttgccagttaaagcagttcttatcaccatgactgttctatttgaggttctactagactatcaaggcatttttttaaaccaccaatccctatatttctgaccaagcatttgaagtataaatcataagggaattttctctttcttgcaattagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagtaagttacaatttaaagagtcaagatttttagtattagttctattaaggttaaacattagactgcttcttcaattgatttgacaaatcatcagacatcagtattgtgagcacgagtgactaatggagccattttgactgacttgaaagaaaatgagagctgacaggtcagctttgatattcagttactctcaagcttgtgtaccattctcactgtgtcttcctttcattatcacaggaatagcagctttcgctccaagctgcatcttgtagacctcgctggatcagaaagacagaagaaaaccaaggctgaaggggatcgtctaaaagagggtaagagagtaattaaggtcacagttgtagattaaaaacttctagtactcttgttggtattgttggtgttttcgactgggatttgagatcacattctaacagtagctacgattcagatttgaggctgagttcagaaatagcgaaaaattgtttctttcccttgctctcattctctaattcaggtatgagatttggatctggcctttggtttgatttcatctggtccaggcaagttttagttttagttttgttttgttttgttttaccccaactatttataattaaaatcagtatcctgattctgtcattttaagtattcaccatcccttccagatgttgtcacatataaacctcagcccaatttccatgccttcattcaagttgttgaatttgaaaagtgatgaaattcctaaggctagaagaaccctgtgatgtaggctattagaaaccttcttctaacattatagtgacctggtaatctgcatgccttggtaatgatcttgaagtgattattaatctctctaacaaaaattaacatccagctctatatctcaattttgttcttaaggatatcataaaatagttcatcagatgccttgctaaatccagatacaccatatctactgtatttctcatagctaccagcttagtaacaatacaaaaaagaaataagggattttagcctaaagtgctttttcttggtgaattcaaggttggcttctagtgcttattcttctgttttctaggttcttgcatgctgtccctctaataatccactctagacttatatcaaacccactgtttggtaatttatggaattaacttttatccctgttttgaaaattgaaattgcatctgcccagtcttctagaatgtctttctctgtgattcgtcaaagatcattgacatagcttcagcagtctcgtttgaaattactctatgttcccttagctataattcatctggtccaagatatttgaactcttattaaagcagttgggtttacacttactacctctttactcatattgggcttcatttctctcttgggaactgagaaggcagaaggaaaaatattaattgaggaattttatttctgtcatttatcattattatactgttggcactgagtgcagacctgtttcttcctcattcagctttttgttctgagtgtcattcaaagtaccctttttgttctatgtttgcacttgagatttagctttcctaagactatttttaaaggctgtaatgctttctttatcttcttttaggtgttcagttccaagttgttttatttaacagctttattgagatataatttacgtactataacattacctatttaaactgtacatatcagtggattttagtatattcacagagttgtacaatcatcatcataatctaattttagaacattttatcatcccaaggagaagccccatattcattagcagtcactccccattcccacccctttccctggccctaggcaaccacttaacttacatttctttttttttatttttttattttattttattattattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccgcagagtgtgatgttccccttcctgtgtccatgtgttctcattgtgcaattcccacctatgagtgagaacatgtggtgtttggttttttgtccttgcgatagtttactgagaatgatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgcaataaacatatgtgtgcatgtgtctttatagcagcatgatttatagtcctttgggtatatacccagtaatgggatggctgggtcaaatggtatttctagttttcgatccctgaggaatcgccacactgacttccacaatggttgaactagtttacatttcatataaatgtaatcatacaatatattgtcttttgtgactggcttagcctaagattttcaaggttcatccatgttgcatcatatatcagtacttcattcctttttttttttttttttttttttgagagagagagagtctcactctgttgcccaggctggagtgcagtggcatgatcttggctcactgcaacctccaccttccaggttcaggcagttctactgcctcagcctcccatagctggggttacaagcatgtgccaccatgcctggctaatttttgtattttttagtagagatggggtttcattcaccatgttggccaggctggtcttgaactcctgacctcaagtgatccacccaccttggcctcccaaagtgctgggattacaggtgtgagccaccatacccggcctcatttctttctattgctgaacaatattccattgtatggatatgccacattttggttgttcattcatcagtcatatccaattttctctgttatgaacttctgtgtgtaaattttcacgtggacaaaggttttcatttatcttgggtatatacctaggaatggaattgctaggtcatatggtaactctgtttaactttttttttaaaagaataaaagatataattatataattaacataccataacactcacccttttaaagtatacatttcactgatttttagtatgttcacaaggagttgtataaccatcaccgcaataaattttagaatattttcatcacctcaaaaagaaatccatacccattagcattcactccttatttcccctcaatatatgttcctcacctctcatcctaggcaataaccaatcctctgtctctgcagatttgcctattctgggcatttcatataaatggaattatacaatatgtggtcttttgtgactggcttctttcacatagcataatgtcaaagttcatctatattgtagcatgtatcagtactgaattctgttttattgccaaacaatcttccattgtatggaaataccatgtttttatttatccattcatcccttgatggacatttgggttgttttcattttgggttattatgaataatgctgctatgaacatttgtgtatgtttttctgtagacaagttttcatttctcttgagtgtatacctatgagtggaattgctggatcatatggtcactccatgtttaaccttttgaagaactaccatcacactgtttttcaaagcaacgacatcattttttgttctcaccagcaatatataagggttccagtatctccacattttcacttgttacttatttatttttcaaactcctgggtgccatcagatttgcttgttattatgcctttttaattatagctatcctagtgggtacgaagtggtatctcattgtggtttttatttatatttcactgatggctaatgatgttgaacatcatttcatgttatataacttttggaagaatgtcctttcatatcacatttaggctttgacccattttgagttaatttttgcatatgatgtgaagagtggtccagtttcttttgcatctgtatatgagttatcccagcatcgtttgttgaaaagactatcctttcccccattgaattgtcttggcatacttgtcaagaagcaactggtctctattcctttgatctatatgccttacgccttatgtcttcattactgtagctttgtggtaagttttgaaattgggaagtgtgagtcctccaacttcgttcttgttcaagattgtattggctattctgggcccctttcatttccatatgaacattaggttcaacttgtcaatttctgcaaaaaagccagctgggattttatagagatttcgctgaatctgtagacccacttgggaagtattgccatcttaacaatattaagtctttcaatgtatgaacatcagatgtctttctttttctttttcaaattttttcaaattttttatttttatctttattttattttattttttgagacaatctcactctgttgcccaggctggagtgcagtggtgtgatctcggctcactgcaacctctgcttcccaggttcaagctattctcctgccttagcctcccaagtaagtagctgagactacagacacatgccagcacacctggctgatttttgtatttttagtagagacgggacttcaccatgttggccaggctggtctcaaactcctaacctcaagtgatccacccgccttggccttccaaagtgctgggattacaggcatgagccaccgtgcccggcctcttttttttttttttagagacaagatcttgctctgtttcccaggttggaaagcaatggctgcagcctaaacctcccaggctcaagcaatcttcctacctcagcctcccaagtagctgggactataggcatgtaccaccactcttggttgatttttaatttttttttgtagagacgggtctcactttcttgcccaggctggtcttgaatgcctggcctcaagtgatcttcctgcctttacctcccaaagtgctggtttataggcatgagcgactgtgcttggagtatctttctttttatttaattcttttttaatattttttgataatttttttttaattttcagagtataagttttacacttcttttgttaaatttattcctaagtattttatcctttccaatgctattgtaaatgcaattgttttcttaatttcattttcaatttgtttattgagttttgtagatcttgtatctgcaaacttgcagaacttattagttctaatagctttttaaatagatgctttaggatttctgtgtacaagatcatgtcacctgtgaatagagatacttttacttctttctttctagtctggatgcctttacttctttttcttgcctgcttgtcctgactagaagcgccagtataatggtgaataaaagtggtgagaatgaatgttgttattttgttcctgatcttaagggaaaagcattcagtctttgttcttcataggtgccctaccaggttgaggaagttcccttgtacacctagtttgttaagtgtttttatcatgaatgggtatttgtcaaatgcttttttgtcatctattgatgtgatcacatgatcacattatttttgttctttagtctattgatatggtatactgcattaattgatttttgaatgttaaaccaaccttgtattcctaggataaatctcacttgtttttgtttgtttagtgactttcctggactgattctgtaaactggattccctgtagtttgccatcacagaagtgtcttctctgttaatttagtggttacttgatgactggtctcagttacttaaatgccttgaacctatacatcttccaccatttgccaagagttttgtgtctgtgtttgggcatatgccttcaacactcaggcacttttacaactctgccttagccttcactgcttaaacagagtctcaaagtcagccagagatgcaaaatttatggctttttaggtctttcctgagcatgtagacagccctatacattcagacaactttctagaccttcagaaatatatctgaactttttaatccccactccctcccgtggatacctcatttcccagaccttttaagctcttagctaggcttttgtttaaccatgattattaagtttggtgtttatctttaccagatgtttttctgtgcatatgtgtatgtgtgcatatagtaatatagtttttatatacctttaaatattttggcattgcctaatttatttatttccttttaactatacaagtaatacatgaatagattctcatataaaaatacaaacaatacagatgaagataaaatctaccttgatttaccacccagtcctaatccagaggtgaacactttcatctgactggtgggtatcattcaagattttttcacgtacacatatattttttattggtgttgctgtgtttttaaagataaatgtcatcatgctacacatattgtttttcaacttgcttttatctcttcgtgatacaacttagattttttgttttgttttgttttaagagatggagtcttgctctgtcatccaggctggagtacagtggcacgatctcggctcactgcaacctccgcctcctgggttcaagtaattctcctgcctcagcctcctaagtaggtgggactacaggcacatgctgccatgcatgactaattttttgtattttagtagagatggggtttcaccttgttgcccaggctggtctcgaactcctgagctcaagcaatctgcctgcctcggcctcccaaagtgctaggattacaggcgtgagccaccacgccaggcctgagatcttttttgtatcccgtgtatataagtctacttcatttaaaaaactgttacataggattccacggtatacagtctaccttgtttattcctattttggttgacatttcagttttccaatttctggctattggaaattgatgcctcactagatagccttgtacatgataaacatgtgagagtattctctgttatgtacctgaaagaggaattgctagattgaagggtatacacgtttgagtaaatactattaaatattgcacaccaaaatgtctgcctctttatccactctacctacaaaatatgatgatgtttctctatactactgacaatattggatattattgacctttttagtcttgcctctcttgaatattgcatgttattggctatttctctttccatttctatgaattgcctgttcataccatttgcttattttttcttctttcatgttgtatttttcttattgatttataggagttgtttatatattctggatattaagccttagttacatatattgcatatgttttcctcagtctcattttttaactttattgatctttttcatttgtgccttgtgtgtgtttttcttcttacatattttttctatttttgaatatgtaaaattggctacttaaggagcaatagctttttttctttttcagccttattgaggtataatagacaaaaaaaattgtaaatgtttaaagtagacagtgcgatactttgatatatgcataaattgtgaaatgattaccacagtcaagctaattagcatatcaatcacctcatgtagttatatttttcaatatgttatttcttgaagtaaaatttatatacaattggcctggcacagtgactcatgcctgtaatcccaacacttggggaggtcgagaagggcagatcacttgaggccaggagtttgagaccagtctggccaacatggcaaaccctgtgtctactaacattccaaaaattagccaagcgtggtggcgcacgcctgtagtcccagctactctggtggctgaggcacgagatttgcttgaacctgcaaggtggaggttgcagtgagccaagatcacgccactgcactccaggctgggtgacagagtgagactctttctcaaaagcaaacaaaaaaaatttatatacagtaaaatgcgcataccttaaatgcttagtttgttgagttttgctagttatatacattcatatatctaccaccaaaaatatcatataaaacaattccatctttccagaaacttcccttgtgcccctttccagtcaatccatccttcccccattccacttccagcaaccactttctgacttctgtcaccatagattaattttgcatgttcttagacttcattacagtgggatctcaaaatggttgtgtgtgtgtgtgtgtgtgtgtgtgtgtgtgtgtgtgcctggattcttttgctcaacatagtgttttttgagatttgttcatgttcttgctttgattagtgattttcctttgtattgctgagtagtattcaattctatgattataccactatttgtttttctattctcgtattgttgagaatttaggttatctcaaatttttagctattatgaataaagctaccctgaacatttgtatacaggtctttttgtgaacatatgtttccatttcacttggataaatacctaggaatagaagagggcaagcgtatgtttaactttatgagaaagtgcctaacagttctctaacatggtttgtatcattttacaccccagcagtgtatgagagttccagttttttacgtttttttgtatgctctggtacagttgatataacatggaaattatctctgaaggtttcttgaagatttgattttctatatcttgagccaattctggtcatttatattttcttagaaaattgttcattttggccagtcacagaggctcacacctataatctcagcattttgggaggcctaggtaggaggatcgcttgagcccgggagttggagaccagcctgagcaatatagtaagatcactgtctctacaaaaaataaaaaattagccaggcatggtggcacatgcctgtagtcctggctactcgggggactgaggtggaggatcgattgagccctgaagaccaaggctgtagtgagccaagatcgcaccacagcactccagcctgggtgacagagtgagaccctgtcctaaaaaaaaaaaagaagaagaagaagaaaaagaaagaaaattattcattttttctgattgccgaatttattaatataatattgcaaatagatttactttatagttttaatctcctctttatctgtagttatgtctcactttcatttcaattgtttatatatcttctgttttttctatcacatttgacagattaactctacctttttccaatttttactattactctattactgagttcttcctaagttgttttattttgttttatgttctttttattgcttcttgagttgaaagctgagtttacttcttttcttctcctttttaaaaaagcttttcaagcatatacagaagaggtcaggatggtataatgaatgcctcccccaatatacctgtcatgaagtttcagcaatgactaatttatgaccagtcttgttttgtctatataatacccactttctccctctgatattatttgaaacaaatcacggacatattgttttatttttttcagtttgtatctgtagaaattaagaactcttaaaatataatcacctaggtcaggttcagtgactcatgcctgtaatttcagcactttgggaggtcaaagcaggaagattgcttgagaccaggaatttgacagcagcctgagcaacatagcgagaccccaccatctctacaaaaataaaaaataaaatagccaggtgtggtggcatatacctgtagtcctagctgaggcaggaggatggctggagcccaggagtttgagactgtggtgagctgtgattgagccactgcactccagcctaggccatagagtgggaccgtctctaaaaaaaaaaaaagaaaaaaaaatatatatatacacctaaaaattaaattaacaataatactaatgccttaaaattacatatctagtcagtgttcaaatttttaattgtcttatagattttatttatttggatcaggatacaaacaaggtccacacattgttattgctcaataggccttttaaatgtcttttttttttttttttttttttaagacggagtgtcactctgttgcccaggctggagtgcagtggcatgatcttggctaactgcagcctctgcctcccagattcaagtgattttcctgcctcagcctcccaagtagctgggattacaggcacacgccaccacgtccagctaatttttgcatttttagtagagatggggtttcaccatgttggccaggctgatcttgaactcctgatctcaggtgatttgaccacctcaacctcccaaagtgctgggattacaggcatgagccactgcacccagccaaggcctaaatgtcctttaatctctaggtacctcctccatctttctttacccctcaagtccctggaatttgtttattgaagaaatcaagttgtcttgtagaatttcccatagtgtgaattttgccaattgcatgcctatatagtttcacatgtttcacttttattctctatttcctataaattggtaattcgatctagaggcttaatcacattcaagatcaatttttttcttttatttgcacatacataactatgtctcatttattttcagttgttcttatctaaaaagatatatttaaagctatacatctcctctaactaccacttcaatctaatcttataattttgagaaatagtactcttattgttcatgtctaaataggatatttactctttcattttctctcaaacctaaaagttatttagaaggtgcttctgtctttccttttattgtcaatttctaatgtattgcattatgttcaacaaatgtatgtgatttgtgttttttgaaatttggcctatacttatttggtctttattaatattctgtttatatttttaaaaagtgtattttctcttgggtgtatagttctatatatacctattagatgagcttgttacttgtattattcagatcctcatgttctttttttttacttaatatgttattttctcacagtatgaccaagaatttgtccatttctccttgtatttcttagtttatacattttatactttggagctatgttgccaactgcataaaatgtcatgacatacgtcttcttagaggattatatctattttgtctaattagtatttcttcacctactttctctttgttagcccttacctggtatgttttccatccctatcttacagaaactttgtagcttgacttcattaattaatttatccattcatttatacccaatctgatggtctctctttttaatttttttttcttttattaaactgcttagggatgatgttctcttttaacaggtagttttaccctctgtattcgtgtgtgtgtttggacttatttctgtcatatcactgactattagtctatggtcctactcctgctcctgtaccacaaccagataccttgaccattgtcccagggcttccttctgttttccgaatccactaccttcaagtctgtagtactcctgcagttgctgccaactttttatatcagttctctcctgcatattttttcttatgttggtctgattcatctgctttcagtctctcaaggattttgtggtttctgatccaccagtgatggattcacaggaagttggtggctttcccacttggcagcctattcaaagacttttaggggctctaaaggaattttactcaattgcattagagggttttacatacacattctgggttgcccatcttagcttcagagcttcaatttcctcatttgtaaaataggatttgaatatattctccaatagagttgtgggaattaagtgaactcatattcgtaaaacatttaatgcaattcttagtaaatagtagtctcttcataattaccaattccatcatctgtgtttttacttgctctgagtgtggctaatgaggaatataggggctctactgatatttatatacaatctcagctgaactaagatccctatgagcttgctaaggtgcttgtcaacatttgaggtagatttcgagggtggaagaaacttttagggatatggcttatacctgtggaattaacttttctttggctaccaaactgccattgtcaaaggcaagtcctccactgttagagggaatcattttctacttatcaagaactaagaaagttgctaaaccctctggaatattttcagaaggtggatatggcccggcagaatattgttacatgttgcattactgtggattgggggaaaggagatgtacccaagtgtcagatttgactcgtgaggcaaagaagtttatgacagaatcatagttgagtcctacatcaagtggcagatgccaagagttgaagggaagctagtgagaaaacaggagataggtatataggaagcagacagcagatggaaagattttggacatgtcagatttggagtacatattagaaaaatccaggaagaaatcagaaagtcaggacaagagcttagaagcaacatctgggctagagataaatatttggaatccatgggtaggagagttgtgcagagaaagactggacaatcaaagagccactagtaaatattaaataatattagtaaatactaaatatgagcgaggggcactcatatttaagggccaagggtaaatgagtcaataagagaagctgaagagacactggaggatcatagtatctagataaccaagggtttttataaacaaaaaggactgtcacctgtgtcatatgcttcagtgtgattactgagaagaggtaaatagatttgtccgttgaggttttgggtgatctttgtcagagcagtgtcggtcgagtggtaaggaattaggacaggttgtatcaaactaaggggtgaatttagccaccattctaaatgtggtgtttatcctttccattaatttctttattcttatatcctttaatgatatgtagtgacattttgcatgtttctaaacttaatgtaaggggtttcatggtatatgtgtcttctgaaactgattttttccctcaacattatgttcttgagatcaattcatcttgataatatagctctgttctaacaggttttgttaactagaggcttgagttttcttggtatcaaattgtatcagtaagaagaaagttacctctgccaatatttattcctttatttaattctcttatgtttcttagcaatgagaaaaatgtcagcagatataccctggactagtaaagttgctttcctcaggggaatctagtttctgatttaaatcagaatggttttaatgttttattatttggaatgataattgctattggtgttggtaaatggtatttaattctcttagttctaaagtcttttttaagtgcaaattgtctgtttcattcagcaactctattcattaaagtcctgttctaagtgttctgcatgttctttttggcttctgggtccctttaggtgtattgttattttccttggtctgctctctgggactgaagtctaatgctggagtatctgaagtcatagcagcccagtgagtgggaaaagcacagtggtttctgcccatgagctagcaggcgtattgccagtcagcttgtcaaacccatgaggaggcatcaggaggaggcctctctgtactcttgtttccttgtgctttcttagtctcaaggtagagaggacccaacccatctcattgttttcttagcattttcagatggggaaacctggcacactcacataagcagtattgactttccccctaggagttcagagtggtatgggcgaagcctttgccacagaccatgtttccatccttgcactttggctctgctacaccacactcttagcccagggcttttctctgttccagagatgaaaaattctacatcaccccttactctcaggtctcagacccatcctgcaacctacttttttggctggccccagcacctacttggcttaagaacagtcaatgaatcaggtttgggaatagaggcgatttggaatattttcaacttactatcttcccaaaattcatgtaccttttaaaaatagatgctaccaaactcccatgaaggaatgatgagattattcattttcctaaattctctactaagtattattaccaatttgataagtgaaaaatggcatgtcactttcatttctgtagttattagtgaagttgaacatacttttatatttataggccatttatattcctgattaaattacctattcaaagtatttctctttagtcagtgtgagtgctgtacattttctgttaagtttatccctactttttgttgtgattttgaatataaaacatatttaggccactgccagatagattataaatagattacagatggataataggtagattattcaattgaagtataatatacatattacacataaatatatattacatatacatattatgcatatatgtatattgcatatacatatatgtgtattacatacatattatgtaatataatgatatcaagtcatcattatacagttcaacgaatgttcacaatatgaaatacatacatgtaaatagcacccaggtgaagaaacaatattctaagcatcccagaagtgtcacttgtgctctcttctagtcactgtcttccccaaagagtaaccactgtccagacttttagtcctagattagttttgtagtatggactccttcatgtctgacttctttcactcaatgtaagatctccagagaaaatacaagatgcctagataaatttgaatttcagataaatgacatcattttgtatggaatatacctatattagaaatgattcatcatctatctgaaattcagatttaactggatgttctatattttttttcttttaccaaatctgataaccctaactcaacattatgcttgtgaggttcatccatagtattgcatgtagttgtagtttgtttatttttcattacaatatagtattccactgatgaatgtaccacaatttatcctctttactgttggatgggcatttgggtaatttccagtttggagttgctttgaataatgctatgaatattcttgtacaggtattttggtgaatatacgtacctaaattcctttaatcctgaatcctcctgtaactactgtcctatctccttccctttagactcaagcttctcaaaaaagcttacactgcttagcaatacatgtgattaactcttagtttcacttctttggtgagacatagcatacatacagaacattgcataagttatgtcatgtatctagtttaataaatgattataaagtaagcatctatataactaccactcaggttgaaaacaaaacacttccagcacccatgcatacccctccgagatcatgatccccttccttctctctccaggtatccattcttctgacttttgtgatgtcaattcccttgcctttttttttttttttttttgagacagggtctcgctctgttgcccaggctgagtgcagtggcacaatcacagctcactacagcctcaacctcctggactcaagcaatcctccctccttagcctcctgagtagctgggaccacaggcacatgccacaattcccagctaatttttaattttttctagagttgggatctccctatgttgcccaggttggtctttaattcctgggctcaagcagtcctcctgccttagcctcccaaagtgttggaattacaggcgtaagccaccacacctggccccccttgcttgcttgcttttcttttctttctttctttcttttttttttttttgagatggagtctcactccattgcccaggctggagtgcagtggcgtgatgttgggtcactgcaacctctgcctcctgggttcaagtgattctcctgcctcagcctcccaagtagctgggtttacaggcatgtgccaccacacccagctaatttttctatttttagtagcgatggggtttcaccatgttgaccaggctggtcttgaactcctgacctcaggtgatctgcctgcctcggcctcccaaagtgcagggattaccggcatacaccaccatgcccggcctccccttgctttcttgatagcaatgccacctgtgtatatatctctaaatagcataatatagttttgtctacttttaagctttatgtaagtggaattatactgtttataatctgttgtgccttcattcttccatttaaaatgatatttgagagattcatctactacattacatacagctgtagttcatttcttttcatttttgtatagtaatctatcatttgtctgtaccactattctttctacttttgatggatattccatttttttccagtttttggctattgtcaacaacgcccatatgaaccttcttgtttgtgtatcccaatgcatatgtataagaattttctaggatatgtacctagaagtagtatcactgggttatagagtacatatataccaaactatctttcaaagtttgtttcaatgtatgagagtcctaattgctctatatccactgttttgtgagaattttaaatttttgccaatatagtagatgtggagtgatactttattatggttttaagtttcatttcctcaattactaatggggttgatcaccttttcatatgtttatcgaccatgtgtattttcagttaaatgcctgttcacgtcttgctcatttttctattaaatgtctttttcctactgattaaaagtaattcttaatatactatagattctagttattggtcagttatatttattgcaaatctccccaccctgtgtgttttgcacatatcttctccctcctctctggcttgtgtttttactttctttttaattttgtgtcttaagaaatcctttaggccgggtgtggtggctcgcgcctgtaatcccagcactttgggagggcgaagcaggcggatcacaaggtcaggagatggagaccctcctggccaacacggtgaaaccccgtctctactaaaaatacaaaaattagtctggcgtggtggcgggcgcctgtagtcccagctactcgggaggctgaggcaggagaatcacttgaacccgggaggcagaggttgcattgagccgggattgcaccactgcattccagcctgggcaacagggcgggactccgtctcaaaaaaaagaaagaaagaaagaaatcctttagtacctcaagatcttaacgatattttttctatattatctaataaaggctttacagttttgcctttcacacttaagcctttaatccacctagaactgttttttttatacatgatatgatgcagggtccagttttgtttttccatataaatacccatttgtcctagtactgcttattaaaaagtccgttctttccctactgataagcagtgccatttctttcatatattaagtgcccaaatatcccttagtctgtttctgagtattctattaaatcaaaattaaatctgagtgtttttccctgtagaagtcttatacatcttttgtactattcttacgtaacttgtattttgacagtattgcaagtgatatttttaaaactttttattgaagtataatgtggaaatagaaaagtagacctaccataaatgtatagcttgctgcattttcactaactgaacaaacccatgtaaccaacataaatagaatctttaaaaattatattttctaactttgttttttgtgtgtggaaaataaaatgtgttctttaatattgattttgtatcctgcaacctcattcactctctcagcagtctgtctttacccaccttgccaaaaccactatgtaagagatatccagggatatcttaattaccagaactaattttttttcagtgcccatcttacccaacctctctgtggcattaacacttgaaaatactctttttgaaactcttaatttggcttgtaaagcctcactgtcctagttcttttcctagctcaaactgttacttttcaatcacttttgctttttcttcttgctgatccattaatctaattgcacccagcatgatctccccaattaggaatgagtacccattacctgctgttagttcttccttagcaccatggtagagatgcacccacttccagtctgttcctgccacctctacaaagtccatgccctcacctgcacatctgaactgtagccttctaactttttgactcctagaaggcattctattctaaataccatagctaggttaatcttaaaataccctttgatcaaagggatacatgtaccgctatgtttattgcagcattattcacaatagcaaaaatttggaatcaacctaagtgttcaacagatgaatggataaagaaaatgtggcatatatacacagtggaatactattgggccataaaaaagaatgaaatcctgtcatttgcagcaacatagatggatatggaggccattatgttaagtgaaataagccaggcacaaaaagacaaatattgcatattctcattcatatgtgggagctaaaaacaagggtataatggacatagagagtagaatgatagttaccagaggccaagaagggtgtgggagtggaggccgaggggaagaagagagaggttgattaatgggtataaacatacagttagatggaataagttctaatgtttgatagcagagtagggtgatgagtgaacagcattgtactatacatttcaaaataactagaagggaggaattgaaatgttcccaacacatagaaattataagtgctcaaggtgatggatgccctaaataccctgacttgatcattacaatttctatgcatgtaacaaaatatcacctatatccataaatatgtacaaatattgtgtatcaataaaaatacataaataaatgaattacatatgtagctttaaaaataccaccttttacatggcatctcacgtaaatagaactttgaagtagctgcttacaagatgaagtctaaaaaacatagccaaatcttccagaccctttataccctggtcccaagcctacctcctcgaccatctttcacagcttccctacccacactccatgccagctgtcaggtccccacaacatgcccagctaattctggtctttgcacactttcatcacagccatctcctcttctcccagaatgtagtgtgtgccccccaacacacaatcaaaccatctacaacatagccacgttttaagactcaacttaagtgttggggttttcgacattgccttttttaatcatgttatcttctaatgtatttttttctcctctgagatttctctagtaccacaggactacattgtcattttctggtgcctctgtatttctagcttcatctcccaccattttcccacaaactacaaggttccagccatagcagtctactcattgtttttccaaacagttctgttgtttcagatctctgtgccattactcctgtgtgttttctgctggattttctccccactgcctcagaaacatggttctgtcaagtactcctgctcctcctgttttaacttctccctctcaactgactttctgccctcagcatagaagcatactaatatttccccaacttaaaataaacaaaatatttcatcctcctcttactactgctctcctcccttttcctttcattctacatttttgtcacccctccatcctcctcccattgaaactatcccttttgaagtcaactcatgacctgaacaactgaatccattaggctcttttcagtcctccactgacttggtaattctgcaggtctgacatcctgccccttcttctggacaatctcattcctcttgactctgtgatgctaccctctcctgattttcctctcacttttctgaagactctttcacaggcttctcctcttccactcacccctatctgaaacataacccaggctttgtcctgggatattttctttctcttcccactgttcatgcccatcaccctgtcaccctccccccccaaagtggtttcacccacttagatgcttataattcctacctgtatgctgccaatcctaaacctctatctcgagcccctatctcataagtcatatttaagtatgtaaatatagttgactgtggggagtcttatggatgtcccacatgtatctcccattccacatgtccaaaactgagcccctcattcctccctgttgctgttttttttaatttattttatttatttatttatttttgagacagagtctcactctgtcgcccaggctgaagtgcagtggcgcaatctcggctcattgcaagctctgcctcccgggttcacaccattctcctgcctcagcctcctgagtacctgggactacaggcgcccaccaccacgcccggctaattttttgtatttttagtagagatggggtttcaccgtgttagccaggatgatctcgatctcctgacctcgtgatccacccacctcggcctcccaaagtgctgggattacaggcgtgagccaccgtgactggctccctgttgctttaaatgggtccctccatcaccggcagtgaataatatcaatatccacccagtcacccaagacagaaaccagggcattgttctatgctcttttttttttttttttaatctggctcctttccccaatctcattagtcactgagacctgtcagtcctaacttttcatcttttacttcactctcttttctctaaccctactaccactatcttatgtcaggccctcatcatttttttgattatagcaagaactggtctccctgtcttcagttaggtaccctttcaagccattaaccaatcagcagccagagtattcttcctaaactgtttctcgctgctaagagctcttccagagctcctcagtttgcaccatgctgcctccttaaggcctttttgctctagccatccctccctggctagcttttcctctccccactctttccttgcaatctgcttagccatactgagtgtgcctcgtactctctcatctatgtgtctttctgcattctgttctctctgcgaaattgccttccctctatcttcatgtggctcattcaaatttgcgctcagtcccaacttcatccccttaaagaaactttgtttgaccatctcacttcccccaaagcggattaggtacccctcatctagtgcttacctgtcttccacactaacactgccccagccgtgtattacagtcatttccttaactacctgactcccccagtagacagcaagccaatcaaaggcaagaactgggtcatattcctctttgaatccctaggccccagcatagcacctgacatgccataggtcctcactgaatgcctgagttctttctcccttttggtctgcctggcaactcctactaatatttcaattcacaattcatatgttacccacctatgaaacctctgctcttggtcaagatctttccataaattcatgctcacatagtgggttttctctaacatttattgataaaaattttcaaagttacttcaagttgaaagattttacaatacccctatacctatagtaaaattaacattttactatatttgctttatcacaaatctgtccatctatccatttgtcagtctatatccattttaaaaacacatttttaagtaaattgcacaaattaatatacttcctcctaactacttcagcttacatatcattaactggcatttaatatttatttatttatttatttatttatttatttatttatttgagaccgagtcttgctttgtcgcccaggctggagtgcagtggcgcaatcttgactcactgcaacctccacctaccgggttcaggcgattctcctgcctcccaagtagctgggacttcagatgtgcaccatcacgcctggctaatttttgtatttttagtagagacagggtctcaccatgttgaccaggctggttttgaactcctgacctcaggtgatctgcctcggcctcccagagtcctgggattacaggcatgagccaccatacccgaccaatatttatattcttaatataagatgtacaatgaaaagcacaaattttaagtgtgtattagctgggttttgacaaatgcatttacccaaaagcctgtaacccaaagcctcatcaagataaagttacctctttgtcatagtgttctttcttttcttgtaattatttaattatctgtttcccccattagactttgagttccttaaaagcagagaccatttcttattttcctgctacctgtgccccgcactgtgccttaacacaataggtattctataactgttgtctggctagaagaataaatatgtactttattcctggaatattagtatgcgactttatacattctcttctctcacctttcacatccagaagttagcttagtcatgtcatgtttatgccttaagtacttctgacttctacatccttcattccttttccactgctgcagttctcagagatctgtcatctgaaccattaaaataaccttctaaatggtttctttctttttttcaaagttttaaactttttatttgcacattttaaaaattatgcattctagtaaataaaatcatttgaaaaaaaaaagaatggtaaagggttttttaaacaccaattttttactcccaagtccaccttccaaatgagtaacaaagtaatacttatatttatttttcttgagacagggtctcactctgtcgcctaggctggagtgcagtggtgtgatcacggctcactgcagcctcaacctcctgggctgaagccatcctcgcacctcagcctcccgagtaactggaactgcgagtgtatgccactgtccccagcaaatttttgtattttctgtagagacagggttttgcagtgttgcccaggctggtcgtgaactcctggacaaagtaatacttataaaatccgaagttggtcatgtttccatcctctttaaaaccttttatttgtttcccattgtctacaacagattttaatctgccttcttttaaaagcataggagctttttaaaaaataaaaccttacaacaaattctaacatttgaaatagatttaaaaacattttaaattcatgtaaatttataagttcaaatgtataacattaagtcaatattaaagccataagaatattataggtatgtttatgagcacaatttctttgtttttttcttaagacaaaatctcactgtcacccaagctggagtgcagtggcacaatcttggctcactgcagccttgacctcccaggttcaagtgattctcccaccccagcttcctgagtagctgggactacaggtgcacaccaccacgcccagctaatttttgtattttaggtagaggtaggattttgccacgttgcccacactggtctagaactcctgggctcaagcaatccacccgcttcggccccccaaagtgctggcattacagacatgagccaccatgcctggccattattattcttttttttaatttcaatagtttcagggtataggtggtttttggttacatagataagttctttagtggtgatttctgagattgtagtgtgcccgtcacctgaggagtgtatactgtacccaatatgtagtcttttttccctcacccccatcaaacctccccctggcctgagtccccaaagtccattatgtcattcttatggctctgtgtccttgtagattatccaagtttttctactccattaataataacttaaatatagatagccctttacaaatcacatttgatttttatcccagtcccattaggtaagatcggtattttccctgttttatggataaaagaaagtttcagtggctagttcaatattatacacattggtgaatggcagaggcagaattttaactaagattctctctctcctaatgaagtgcctttcctactctatcccctatcgctggttgcctctatatgttttgtgatccatttcagtaacaatcattccctttctctttgaccaggcagaccatctatcataccatacttctgtttttcaccctaatttactcagccattctacctgctttaggcccatacatattttcttcacacgtagagcagggtttcccagctgtggcaccgttaatattttggatcaaataattgtttacggggaaggaggctgtcctatgcattgtaggatgttttacaacatctttggcctttacccgatgaatgccagtggcacacataccccactcctaagttgtgacaaccagaatgtctccagatattgccaaatgtcccctatgaagcagaattgcccctagttgagaaccactgcatatagatctacatttctctcctacctcatttttcttttttcttacaaatatgcttttatattccagctgtaaaacccattgtaatgtgcctccatgatagctgtgaagttatatttctcttttaaagttaaaatctctcctttattatttatttgttgccatagtgaacaaacacccaaaggtattgagtagcatttttgactctccttacttgatctgttctcattcttacagagaaaactacttcatttttcttcatagctgtccttaatcagaacttttaagtctctgcaaatatgttcttccccatctttgtgatatatattccatctttgggaatcatttatcattttaatgtcttaacaggaaatcaaatcctgttttgtggtgatttatttcaagagaaacattcatgtctcttatctcctttctattcttgagccccaactctcatttgaagaagaagaaaaaaaatgcccactttatccttaagtctatggttcttgcttggatcattgccatagattcttctcagggtttgtctggaattttgttttgctcctatatgaaactatagatggaagttttgctcagcagctttgaaaaacctcagcagtctctcctttacatctagttgagatatgggccaataaaatagcacaatgttttgtttggctaaaaagagaaggaaaagacaggaatggactaacataggatttagtacaggtattagcaggcaggtttgataaatctcagcaggctttccttcatatcctagagaggataagcagtacccattccagttggtaataagaggaaaacaaagggataattgagaaaattatttttgttttagattagggagatttgagcgtgggtgtaggctgaaaagaaggaaatagtgaaggaaaaaaataagtggaagatctaagagagagggagaagctaaaggatcagggtcccagaggaaatggaaggaatagaaacagaggcagaaggcaggaccttgaaaacaaaggcagctatttcctctgaaacaaggggaaggatgaaggaataagtaatagcaaaagaatgaatgtgaggtgaggagaggggaggttggggagcccttgtggataactttcatctctataaagtatttggtgaaatcatctaccaatagaaagtgaagataggtttatattcttaaaaatgatgagtctgtataatagctgccatggtgaattagattagttagattagaaggttagtaaagtaggaatgaggaagaaaagatgatcaattgaccaagggttcagctaaggttaggtagcatgtttatagtggatctcatctgtttggttatgctgtttcttcagtattgtagcctacaaataaacatacacgcacacagttggtttaacctatggttgagaattgacatggtgagaatggtagaagatcatatgtccagtgagttcttaggaaaacgtaattgaaattttcaaccatagggttcagagtaagagttgaaggtccagaagaggctgatctactgacagtattagaaagtgtcagtaaattggtagtccaaaaaaagggtgaagaacaggatccaaagaaatggaaggatagtaggatgcagtcaggaatttcgagttcaggatctcataaatataattgtttcatgttcaaaagatggctatataaaaggtagagtagagctaacaataatgataccatttgtgctgctataacaaaataccttagactgggtaatttagaaacaatataaatttatttcttacagttctggagactgagaagtccagggtcatggtgccagtagaatcaatgactggtgaggacagacatcctggcagcctcacatggcagatggggaaaagggataaacggtgtgtccccacatggcagaaggggcagaagggcaaaagcaactagctaattctctccagtcctcttatcaggcaccaatcccatccatgaaggtagacatttcatggcctaatgatctcctaaacgtcccacctcctaatactattgcattgggggctaagtttcaaacgtgaattttggaggagacgcaaacatttaaactatagcatgatttatttatcatttaactttgcttcatatatagtatcttaattaattccctaccacaacccaataaggtaggtagatttgcctcattttataaaggaacttaacccaagatcatataactagtcagtgacagagccaggattgtaagctgtctattttaacaccaactatgcacttaaccattatactatatagcttttccacagtaagcctaataatgggaagttaattgcttcagcagaacttcagaggttattacagtgtttaagaagtaaacctcagaattaaccaaagtggaaaataatctttatcttttttaaagctacagtaggaaaggtatttcactatggtataatgaaaagagcataggacttgactaaaatcttgagatagaatctcaggcctaccatttactagctgtttgaccttaggcaggtcatttaacctctgagcttctttctttatctgtaaaatgagaatgataataaaaataatgatgatgatatggtaaaaaaaaacctgttcatccaatttcacagcattaatttaaagattatcataatggatataaaaagtaaataactatacagatggttgtcatggtgatagttatttatctatctgctttgtttccatgggaaagggcaagaagtgccagtggactcaatcatacatatccaacatttggacctttgtcctttacttaaagaggcactccaaaaagtgaacaagattaagaagttttctcaagattgatgactcgatatttttatggggtctttatttcttttctctttctcagaagaaacataggtatatgttggatgcattaccaagcaatttaaatttcatttcctgctattaggtattaatattaaccgaggcctcctatgcttgggaaatgtaatcagtgctcttggagatgacaaaaagggtggctttgtgccctacagagattccaagttgactcgactgcttcaaggtaagcccaaagtgcctccaaaaataagagagtaactcaaaatgatagtgctgagacagcaaagatgaaataggtaaaaagccagctatttggactatgacatacacagttgtctaattgataaatacgagagagtgctgttggcaagcaggtttctaagataatggaaaaatatcttcatatatgacattgagagccaagaaatctgtagtgcaccaactgtactttgtactttacacctgaaagtgaatttggttactgtttctttaattattagtgcggctaagcagaattccctggagagttaaaatccacctagagggggcatcctaagaatgtttaattccactagtggctcctaacttacttaggccaggccccagttgttttaacctgattaactgctgaaatcacaatcccttttgagaaaggggacacatgcaataggatttaaatgtatattacatcagaaatcttagatatgtatacatttcctattatttcaatataaaaaacactaagaactttttcttatagctctgaattttaagtcaccaacccgaatggacggctttgcttatatcctacttgtttgatttcatttcctttcgttattctttattgttctttttcagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtataagggacttaaagtttgatgggaaaaattacaagtatgtgagtggaatgatagagcttctgttttcagtttcttctttatcagaagtttagagatgttggttaggcattatgtttgttcggggacctcttaaaataactcctattaacgtgtttgctgtccatttaagattgggggtagcattggaaagttcactgatgaagaagtgagcagtgagagatgagatgagaggtgtagacaggggctaaattctgaagttccttatatgacttgttaaagaatttggaattcaacctgaaagctatgaagagccattgaagagttttaagtaggagggtgatatgataaaatgtgtgttttggcgagatcattctagcaggtatagagaaaatagattagaagtgggcatgactagaagaaggaaaataaatcactgcacaaaacaaagagagttctagagagaagaaacataggtagcaaagtacagttgattctcgaacaataggagtttggtccaacaaaacacagatcaaaaatacagtatttgcaggatgagaaacccatgtgtagactttttatacatgtggattctgcagggctgaccgcaggactggactatgcatctacatttttgtatacgcacagggtcctggaaccaatcccctgcatatacataggaacagctgtatagtggccaggagcactgacactgcaattagcccacccatgttcaaatcttagctctataactcactggctatgtaccttgggcaagttctctgtgccttggtatccctatctgtacagtagaaataataataataccttcttcttagggtttttgtgagggttaaatgagttaatacatgtaaagcacttagaacagtacttggcttatagcaagtgttggaagggtctgagataggacagaagtatagtgcatttgaagaactcaaagaatgccagtgtggctagagtgtagaaagcaaggaaagagtacaggcttaccttagggatgttgcaggcttggttccagaccaccacagtaaagcaaatatcgcaataaagtgagtcacacaattttttttgttttccagtgcatagaaagttatatttacactatactgtagtatattaaatgtgcaataccattatgtcttaaaacaatgtacataccttaatttaaaaatactttattgctaaaaaaaaatgttgacacagagacatgaaatgagcatatgatgttggaaaaatggtgccaatagccttgcttaatgcagggttgccacagatcttcaatttgtaaaaaaaaaaccacagtatctgtgaggtgcagtaaagtgaagcacaataaactgagatgtgcctgtattccaggatgaggctagagggaaagcagaggactgatccaggactcatggacaatattaaaaaggattttaagccaggtagtaacttgataatttacatttttaaacaatggcctggctgctgtatagaaatggattatagtagagcaagagtagattcatggagaccatttaagaaggtactgcagtagtctaagcgagagataatgatggcttggacttagagtgctggcagtggtgatagaaagaagtaaccaatgaattagataaaggaatgacacccagatttctggcatgtggaactggatattcactgacctgggttacactggaaaaggaccaggtttgaggataccagacaactaagtggaaatatcaggtagatagttgaatataaaagtataaagttcagaaagatctgtgcttgaggtaaatttggaagtcaccagtttcaggtaatagaaaccagaggcagagatgagacattcagaagagaatataaggagaatgtaagtaagaaaactcctactgagctttgggggactttaccatttaaaggacaagtggagcaaagatgaaccaagaaagagacttagaagatcagttagaagaatagaaggaaaagcaggaaaatgtgtcttgtaagccaaatgctaccagtcagtcagtcaagtaaaatgaagactggaaaatgctcactggatttggtgacatgcagctcgtttgtaacttgggcaagttatttcattggaacaatgtaggcagtcatattggagtaagttgaggagcaaccgagtggcgagcgaaaggaaatggaggcaattggtgtattattctctcaaactttgtgaaaaaagagaaaaatagggcaagagagataggaagtggggttggggaggatgcttttgtttttaagatgggagagacttgaacatattttaatctgaataggaaggatcttatagaaagggagaaattgaaaatatagaagagagaagggataacagtgtaagattcataagatggcaagaagagtgggaatccaaagcacatgcaaggagaccagtcttgggaggcagaacagctccccttgtgtcataggagggaatgggagaggatgcttacacttgcgctctggtttaagatccatctccatgaagcctccctttgactatttaggtttttgttaatttgcttattctgtcttgtattatttcctactattttagacttcaggcttatctttcttaagtagattgtaaacttgagagtaggggtcatattttatttttatatgtccgtacgttgtctagcccagtgctgagactgattttcaaaaataggtactcaaggccaggagcagtggcttacatgtgtaagccccgcactttgggaggacgaggtaggtggatcaattgaggtcagcaattcaagaccaggctggccaacatggtgaaaccctgtctctacaaaaaatacaaaaattagctgggtgtgttggcgggcgcctgtagtcccagctacttgggaggctgaggcaggagaatcacttgaacctgggaggcagaagtgccactgcactccaccctgggcgacagagcaagactctgtctccaaaaaaaaaaaaaagaaaagaaaagaaaaaagaaaaataggtgctcagtaaaaactcattaagatgtagataaaatggacaactcatcttctacttaatagttgttcatgtaatgctgattttcctgttatcattggatcatcaactatgtatgatgcctttggtagtatctaaggtatgctatctgccttagatttcatagacatttagtaaaattactttattgctaattgtggtaattttactgccaagggttaagtagcatttggttggtgactagctgattatttttctttgcttctcccaggtacaacagctacaagtcttgttgctacaggcccatggaggtaccctgcctggatctataacgtaagagtcatagattaatttgaattgtgtattctaatagaggctatttttcctaataatagtttttccctggtttctgctagcacttggtgtcacggtaaggatcttaccaattttgctgactatttaggacttagttatgtttgaagcagcctaatgtaacagaaagagcatgggttctggcctcagaaatttattaattggaattctattgtgaggaagagctgtctcttcttctccatttgtttatttgacatttagttatatttgtatagattcatggatatttattttattctatggtttaacatccagtactattatttgttttattgctcaaattgttcctgctttgtccattaggagctccttcaggttggctcttctcaagtttttgatcatttctacaagaggttccaaactcatcttgtattttccctaccccagttctggaatcaaccatgtctccaaggaaccctagttcctttctttttttgttgatggaaaattgtgtttagaagccaagatttgggtactagcgccagctgtgtttattgttaccagagttttactgcttctaagcactctgagcaggtagagctcagaaatatctacctgtgtagtaacgtacacatacactttcatctatatttttgtatatatctatctgcatatatattacaaaccatgagtttatactgacacctctgataccattccaatgtgacagggttcattttggctttccccctttccttatttgtaacttctttctccaacagtaagaaacccagctctcatctgcaatctatttatttacttgctcagttctactatacacataaagtagtttcagaattgttagcctatatccctgtgggaaacactttctatgaaatagattacagcatttatgtacagttctttttatctttaggcatagagtatctaagcaagataatgtttcccacagttactgtttgtattcccttttaggcactctccccctaaatcttagttacttttgtttgtttatattttaggtatgtgaaacataatggatctaagagtcagagttacacaaaaagatatactcagagcagagaaatgcaaattaaaaccccaatgagatatcacctcatgcccattaggatggctactgttaaataaataaatagataaataactgaaaataaaaggtgttggcaaggatgtgaagatatagagaaattggaacccttgtacactgttggtgagattgtaaaatgatgtaactactgtggaaaacagcatggaggttcctaaaaaaattaaaactagacttaccatatgatccagcaatcccacttctgtttatatatccaaaataattaaagcaaggtctcaaagagatgtcttcacgaccatgttcatagtggcactattcactatagttaagaggtagaataacccaaatgtctatcaacgtatgacctgataaacaaaatgtggtatatacatgcaacagaatatcattcagccttaaaaaggaaggtaatcctgtcacttgctacaacatgggtggacattgaagatatgctaagtgaactaagccagtcacaaaaagacaaatactgtatgattccacttatgtgaggtatctaatgtagtcaaattcatagaaacaaagtagaatggtggttgccggggactgggggataggtgggaaagggaagttgtttaatgggtatagaattttagttttgcaaaatgaaaacattctggagatctgtttcacagcaagcaatgtgaatatacttaacactagtgaacaacacacttaaaggtgattaagatggtaagttttatgtttatatgtttcccatgattttccaatttgtatttgtataaatttatgggatataagtacaattttattatatggatgtgttgtgtagtggtgaagtctgggcttttagtatatccatcacctgaataatgtacattgtaacaacttagaaagttaaatactggatgttctcacttacaagtgggagccaaataatgtgttcacatggacctagagtgtggaacaattgacattggcaactaggaagcataggaagtttgaggggagtgggtggtgagaaactacttaatgcatacatgtaccacaatttttttcaaaaaggaaaaaggatatactcagtgaggtaaatgtcattccctctccatccctgcaactctgttcccattcctatttcccacccttatttctacctcttttctaccattattctcgctacgcctgtatttaacccatctctttagtttctggtttagccttcttgtatttcttttgtacaaatgaacagatacctgtgtattttattatatcacctttttttctcatatgaatggttgggtactgtatgtaatgattgtatactctttgtagctttgctttgttcagtatttcctggaaatcatttcttaccagttcagagaagtcttccgcattcttttttgcaggtgcatagtacttttattgtggacatgtgccatacatatcaattcaccccccttcctatgtatgcacatttaagttgtttccaatgttttgcaattaaaaacatgctgcagtgaataacctgtgtgtatatatttttgtattgtcagaggtttatcttaagggtaaatttctagaagtgggattgctgggacaaaaggtaagtacatttctacctttataaggtattgccatatttgcctccagaagagatgtaccagtttgcattcctaccagcagtgtatgagaaagcctgtttccccacagcctcactaatggaatgtattgtcatactttttcaatttttggcagtctgataggtgagaaatgctatctcagtgttgttttactttgtatttctcgtattatgggtgaatttgagcattttttcatatgtttaagggccacttttatcccttttgctggtgaattgtccatgtcttttctcatttttctattgggttttttggtcctttggcctctttttaaaaataaattgtggtaaaatatacataacataaaatttaccattttaattattttaagtgtacaattcaatggctttaaattcattcacaatgttgtgcagccatcaccaccatccacctccaaaatttttttcatcttgcagaactgaaactctatacccactaaacaataactcctcatttcctctctcctcagtccctggcaaccactattctgctttcagtatgaatttgactactctaggtacctcatatgaatggaatcatacagtatttgtcttttcatgactgacttgtttcatttagcataatgtcttcaaggttcatccatgttgtagcatgtgtcacaatttcctttgattttaagattgaataatatttcattgtattttgtgtatccattcatccattgatggacacttggactgcttccatcttttggctattgtgaatgatgctgctataagcatgggtgtacagctaggtgtggtggtgcatgccgaagtcccagcaactcagtaggatgaggcaggaggattgcttgaacctaggagttcaaggctgtagtgtgctaaaatagcacctgtgaatagccactgcgcttcagcctgtgcaacatagtaatattccgtctctttaaaaacaaacaaacaaaaaaacatgggccaggcgtggtggctcatgcctgtaatcctagcactttgggaagcaaaggtgggcagattgcttgagcccaggagtttaagactagcctgggcaacatggcgaaaccctgtctctacaaaaaatacaaaattagctaggtatgatggtgtgcacctgtagtcccagctacttgggaggctgagttgggaggatcacctgagcccagggaagttgaggctacagtgagctatgatcataccacgcactctagtctaggcaacagagtgagaccctgtctcaaaacaaacaaacaaacaaaaaacacacacaaaacaagcaacaacaacaaaaaaactatggatgtacaaatgtctgatcatatccctgctttcaattcatttgggtatatacctagaagtaaatagctagatcatatggtagttctgtttttaatttttaaatcaaaccaccatactgttttccatagtggctgtaccattttacatctccaccagccatgcacaaaagttccagtttttccacaccctcaccaatgtattttttttataatagcaaccctaagtttggcccttatttttgacaattctttatatattcgtgatattagccctttgtctgtggtgtgtgttacagataatttctctgaatttatcagttgtcttttactttgtttatgatttttttgtcatataaaatgttatgatttttatgtagtaaagcttattaatttttttattgcctctggattttttcagcagctttattgagctaaaatttacgtaccataaaattcagtcattttatgtgtaccattcaatgatttttagtaaatttacagagttgtacaactatcaccacaattcaggtttagaacatgtccatcaccccaaaaagtttcctcatgcccatttgccatcactctcattcccactcccagaccaaggcaaccactaatctcttttctgcctttatagatttgcctattatagacatttcgtatacatggaatcatagaggatgtagtctttttttgtctggcttctttcacttatgttttgtggttcatccatgttatagcacgtgttagcacttccctttcttgcgtaatagtactccattgtctagataggccgtatttgtccatccatttaccagttgatggaggtttgggttgtttccactttttggctttcataaatactgctgctgcaaacattcacttgcaagtttttatatggacatgggttttcatggggtaaatgcctgggtatagaattggtgggtcatatgtttaactttttacgaaactgccaaactgttttccaaagtggctatatcatttacattctccccatgcctctggattcatagttagaaagcctttctccacaccagggttaaaagaggaattcagccgggcgcggtggctcatgcctgtaaccccagcactttgggaggccgaggtgggcggatcacaaggtcaggagatcaagacaatcctgcctaacacggtgaaacctcgtctctactaaaaatagaaaaaattagctgggtgtggtggcgggcatctgtagtcccagctacttgggaggctgaggcaggagaatggcatgaacctgggaggcggagcttgcagcgagccaagaccacgccactgcactccagcctgggtgacagagcgagactccatctcaaaaaaaaaaaaaaaaagaaaaagaggaattcacccatgttttcttctagtaataatgtcgttttatgttttacatttcattttggcatttggtatttattcttatgtatgatgtgagcatactttcaatatttttgttttcaattattcatttttttctgattataaaagtgactaattgcttctagtagaacatttagagaagtatagagaataaaacttaaagttgctataatttcaccacccagagatgactacctctttcttcctaattttccccctttagataatttagtctgggtttcctgattacattttattctcactatactcatttagaagcaattgacccatcttcctttcctttcagtttagcacaaaaagttccagacttctgattgtctagaatgtgctaaaggaaatagtttcagctgcaaaagtaatagattctaagaaacagttgatgaatcaaacaattaaacttaattgttcaatattttacagagaaataaagatgctccttttcacaagaatgtatatttatatttttagagacattttataaggcttgttaacaaaaagtacattttacatatatgaatgttttcactttttgtccttagattattttcttttgttttttaacatgtcattgaagcttttgtatttattttctgtgagtgtcggtcaatttgcacatgctcagtttacttgaattcctagccttggcaattaaatagcatgtgaaaacattggttttctgttatattttctttttcagtctgatttttgcctggccctagtcctgtttttgctttacttttaaagattttacccattacgtggctgtcctatatcacgtggtcctataatatatctataatcttgccaagaactcttttttttccttattactgtgagagcttttatatccagtattctctgcattcatatagtacctatctctgtagtcagcatggtagttaagagcatggactctgaaactagactgctgagctcaaatttcagcttcacattacctactagctgtgtggctataggttatttaacttctttgtgcctcagtttccctagttataaaatgaggataacagtagaacttacctcataggggctattgggagaacttaaaaaatttaatgtatgtaaagtatttagaatagagcctagcccataatgctatagaagagttaactattattaattatagtggtatttaaatattcaagcatttgcctcaaattacaatgaagaacctacttctatgtgctaaattttccttggaaaaatcaacagttaaacttaaatatgattttcccatttagagaaatcctggaaattttttagggaaataaaaaactatcgagttaaaagtatcattactttgaagcttgtcagcttacatgaatgacacatggaagttttcagtttaataaagaaataacgaaataacacttaaatttactaatagttttttttataatctgcattttaattgaacattccttcataagagtcttagtaaatgctcaacagtgtaatatgagaccttattgtgtggccttcctattaacttttgataaagtgccttctaagatcttctataaaaattgatggaggtcttaagatgggtgagagggcatctactctattcctgaagtccttttctatcctttattgagattgagaacagctgttccctgtcctttatttttctctttttcatagccttgacaactattcatttttcccctcagtcttcttcagatcaaatcttcatatttcttctgatctttttttaaccagtcctgttttccagtcttttgaacatttcatcccagtggattaaaacaaaaaacagccctacttcgtattggtctgctttactagtctggaactgatatcaagtgatatgtatacattccaaagtttcttacctatatgtattccttcaagctatttctgaccctcccttttcctcgtatttgaaatggacaccattgttgtcatgactcactctaagtaatttaaaattaatagacaaatgaacaagaggctatgggtcataagttccaagcaaagcaagcatttagaagggagcacttatttataaagaattgtgaaatgttttctgagtggccgctggtcatcatttcaactttttgacttctcaaatgctgtttccctaaactttacaataaatgggaaatatatttatgttgattaggttgaattttgaccctgagcagtgtcacttctacctcccccatacctctcccttctctacttccctaatctttaattagggattgagggtgggaagaaaagggacagaacatgtattttagctccagttagctataacttcatacctacaggacacaaacagaaaagatcctagccaagagccaagatagaggttagtcattcctgttgcaaccgtatctggctctgaattattacctttctccaaaccactgaagtacttcagagatgtgtttattgtacatccaatattctacctgactaggaggatagattgggttggacacacttttcccagacttttgtggtataattttgacctaatccccctacctatccaaaaggcctatgggatatatttttatccacctttgatataggtattatcaatcagatatttttctaatatgttatttactttgttttagtgtggaaccatcagagaatctacaatccctgatggagaagaatcagtccctggtagaggagaatgaaaaattaagtcgtggtctgagcgaggcagctggtcagacagcccagatgttggagaggatcattttggtaagcccccaagaataaactactagcaatctgaacatttactagctttagtttccagaatatttaacatgtatctcattatgagagacaggttatattgaaagaaatgtatttgtattaccatatcctccagggagcccctctggggtaaatatgtgggcttataatcaaacatacagaaaagttaaaagaattgtacagtgaacacctatgtatctaccacaaagaatctacataaatcccattttaaaatagattcatttaaaaataccagaaagtaaagaaccaagtacctctgtcaccttaaatcctgcctaatctttatccataataccaagtaaccattccttctccaagattttagttattttccatctctcttcccctaatgttgtcacatttcatatcccatactaacagctgccatggtgagatacaacagcttggaaattaattttaattcattttccatgtgattgatttccaaatagtggatcactatataactgattacacgagttctgactcctactacctgcttgtctgtcagtaacctcctggatcagtgcatgctgactctatcactaaggtttttctactagtctaaatacaactcaatctttgatagcacgactgttgccagaagcaaaaataagtttccaccaaaatataattgaacctctgtaatgtatacaccttcatgcatcagtgtgctctctagtcaaggaaagataagctgcttaaagatttctttcaagtgggctaaatcctacgtccattgtattgtccattactaacggagggtgaaaatgggatataggggatttttatatacagttttctgtctccagtgctgtatttatgctttgaagtaactctagaagctgtgtttcacatgtatgtgaatgaggctgttgtaacagaaactacttcttattctatccacatactcatccgacctttataaggttgttacagtgtctgcctgataggcttattgtttgatatcctgtcagaacttcataacaagcacaacatttttgtcctatataaacgattctttccagatctgttatagtatccagcatgttacagatactgtgattgaaataaaactgaaaatatcaatcacccttcccaaaacgtaagctgccttctgctgtttcttctttctctaccatcattcttgtgccgtaccctttttcttgctgtcttttgctaaaactagcctaccatatcaaatagtataacttaaaaaaaaaatctcagctcaaatttagtgtgaggcccttttatgttttaaatgcccttatgctggggctagggaacagcgtagtgtaggaggcagtttaaagtaagtggggttttttgtttgtttgttttttgtcttttttttgtttgttttttttgtttgtttgttttgcaaacagcagggactaacatgccaggaaatattgctttttcccctcagttgcaaagttctctatggaattaaggcttcacactccaccccatagtctgagtttcatggcaagcataaaacctagctgctcggatgctatttttagtagctcatgttgactgaagggctaatttccatgactcttttaaaaaacacatttttcactgaataaccaaagcccactaaatcctctgttacagcaaaggagacagcctctctacctagcttttaattcataggagtaggagagcataattatgtgaggctgtcaggcaccgccactgatgatctcctgggtctttgttgcagacagagcaagcgaatgaaaaaatgaacgccaagctagaagagctcaggcagcatgcggcgtaagttgcccaccagatatttgttagcaacctatagcatcttagtatataatcgtggagcctctggcctttgtcatatgaataacccttgggttctttttgtttgaattttcagctgcaaactggatcttcaaaagctagtggagactttggaagaccaggaattgaaagaaaatgtagagataatttgtaacctgcagcaattgattacccagttatcggtaagccaagtaggggcagtgtaaataggcatatcactttcatttgtttctcttgacacatacaagcctttctagctctgtgccttttgctgaaacaactagattgtgagccgcttttggacagaggtcgtggatcatttgatatgatctgaatattgagtttgttaaaacactcataggttacatatacaatgcacattagtatttcagtattctaatcaaataacagaagcaacaacatagcagtgcaaaattgcctaggtagcaagagcagcagtcattgatttgctgtcctcacagtgtaggctaacttaaaaagaggacttgtaccataccccaattttaaataagctaaattctgacagatagcttaaggcaaccagggaataccataagcctcttttataaccaataataagtaagtttgaatgattgttctaccataagttcccatttttgtttatttttagaaccattatagtagtggcaggtgtgttttgggggtggggtggttatttgttgtttttcccagaagaaaaattttcacaatcccactatccctaaaaatctatttttgttttggtgttccatctcttagtccttaggcatatatgcttttaaaaaaaacattgaaatcgtactataacatactatgttaagtggtaatggttggttttgttctgtctacactctgttgtttattattctgaaacagtgatgtgtatgcagatgcctggtggtaattcctagctcttgggcagagattttaattttaccagaaccatgagactgtagtccctggtcttgcccagtgttttctagagttgtcaatagtgtgtcacaaaattatccacacatagatttattcttgaagagaatattaaaaaaatgccatgcaatattgtcaggacttgttatgatggccagctctaagaaattaaatgagtaaactccccaaagactattaggcagtgttttagaataaggagtactgtaaagctatcatgagcagtccaagatgacagctcatttatccaacaaacagggtacagtaattgagagcctgggctctagagccacacagaccctggtttgaagccagttctgccacttcctagctatgtaatcttactaagtgctgtattactatcaaaaggaaagaatttaagtgattcaaataggggttaaaagcattattcatctgggcgcagtagctcttgcctgtaatcccagcactttgggaggccaaggtgggcggatcacctgaggtctggagttcaaaactagcctggccaaaatggtgaaaccctgtttctactgaaaatacaaaaattagccaggtgtagtggcatgcacctgtagtcccaggtacttgggaggctgaggcaggagaactgcttgaacccaggagatggaggttgcagtgagccgagattgtgccactgcactccagcctggatgacagagcgagacttcatctcaaaaaaaaaaaaaaaagaagaagaagaagcattatttagctgatgcactcagggtacacttgaactccaggtaacttcccaagtaaagcaagattggagctttatagagtaaagagaagaaagggttgtatgtccgtgtggtttagctcaggtaacagtttttaatgttaattgatgtgaaacttttggttggagattgtttcatttttttatacctcttcctcaggaatatactgatgcaatcctatccggataactgttattatattttgagagttgttcttacaagccttgtagtttctcagttggtcaaggttcacaggtgggagaggtggcaaaatagggataacggggaaaggaggcgagggttgaaggcaaggaaaattgggaatcctctctcgtgtgctttcttttatatcagcaatgtaagcaaagtgcagtgggatcataaaacaaaggatgattaactgttagtccagaaaattcaggaaggcatcatagaagaaactgggtcctaaaaatgaacaggagtttgccatgcagacaaaagggaagggacaggccaactctgggcacactgcttacgagttagccctgctccacaaggaaaaatttaagagcttttatataaaataaataaggttttttaaaaagggactagactatatatagaggaaaagatatagataaaagcaaagaggtatgaaagtttaaaaaatggtaagaacttcaatgtggctgaagtatagagtacttgttagacaacggctatcacaaggttaaatttcacaattataatgccactcaaatgcaactgaaacatctgatacatgaaaaccttgtgtgagctgcctcagaattaagataatctaggctgcagaagcccactggggccaaaacttacaagctcagaaatagtgacccagggtacccaccattgttcatggccatcacaccaatcttagaggattaataccacctcatttctggggcttcgagtcacatagaaaagatgaaggaaacccgtggaaccaaattaataaaataaagcatcctcagtgagaatctggcaatatgactggtgcctggtgtgcctgtagagggagttgctagtggtggctggctcagaggaactccgtagaatcgctgtgtctgccacttaaatgtacttggcacacacagtaggagggtgctaaagattgccacaaactgataaagttcctggcttccatccactgtcacagttaggcagagtaagcccttttatccaggagtcctgctggactcctgaatcagagttctccacatctattgttcggagaccctcccagctatatatttttttggaaatacacaacaatgtatcccatggcttttattaagactcactacagtgaaagcaaaatgtttcaaaagtaagtgcttgtgcccttcattctggattaaaactatttttattttaagtgactagtgaacacccccttttccattataaaggcaaccattgttcctagatattcttcctggggctttaagcgctaaactgtaccatttcttcctttaaaatataattcaagcaaacctccttgtgcagttacctgtgaggaaattcaagcagtcctttcagttcctacaaaatcaaatgatcttttttgtttatatcccctcctccaagaccagttccataaaaagcattttgcatgcccagtaacggtaccgcctacaaacacaaacttcatcttggaggatattgctggttaatgtagcacagtgtacccttgttcccctaaccatcacctttatgaaatcacgttttatttttaagaggttcttggttatagtcttagaatcgggggaaagagggctgtgagactgaaataaatcttattgtcatatatttacatttaggattatagaggcagaattctgccatgttcatgcagaacatgtcaccatagccctaagcttaaaccttagtattgtaaaatttcactgggccaaaagccaaagataaacccagagtaacaacatatcttcttcaaggattaacccatctacttttgatcctaactctggaaggtactagagaaagtctccaaaggccagtgttttaggccctaataatctaggacaggcctctgattagtccttatactgaaaattgaaacatgggagggaggaaagggtaaccattatagattttttttaatcctttttaagaatgatttagggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaagaatgatttagtatgtcctgcacttggagaatcaccagtactacaaatcatcatgagaaaggatgtgggaatactgaagcttcctttaaattctctttgagcctcactggttgggagtttctgagcagaataagggaaatgcttcataaatagcacttattaaggatctcttcaggccaggcgcagtggcttacgcctgtaatccaaactctttgagagaccgaggcaggtggaaccctggagcccaagagcttgagatcagcctaggcaacacagtgagaccttgtctctacaaaaaaataaaataaaatgagaccatccttcatgacatagtgagaccctgtctacaaaaaagttttttgtttttttgttttttttagtatttattgatcattcttgggtgtttctcagagagggggatgtggcagggtcataggataatagtggagagaaggttggcagataaacacgtgaacaaaggtctctggctttcctaggcagaggtccctgcagccttctgcagtgtttgtgtccctgggtacttgagattagggagtgatgatgactcttaacgagcatgctgccttcaagcatctgtttaacaaagcacatcttgcaccgcccttaatccatttaaccctgagttgacacagcacatgtttcagagagcacggggttgggggtaaggttatagattaacagcatcccaaggcagaagaatttttcttagtacagaacaaaatggagtctcctatgtctacttctttctacacagacacagtaacaatctgatctctctttcttttccccacatttccccctcttcttttcgacaaaactgccattgtcatcatggcccgttctcaatggtcgctgtctcttcagagctgttgggtacacctcccagacggggcggccgggcagaggcgctcctcacttcccagatggggcagctgggcagaggtgctcctcacctcccagatggggcggccgggcagaggcactcctcacctcccagacggggcggccgggcagagacgctcctcacctcccagacggggtggccgggcagaggcgctcctcacctcccagagggggcggccgggcagaggcgctcctcacctcccagacggggcggccaggcagaggcacttctcacatcccagacgatgggcggccgggcagaggcactcctcacttcccagagggggcggccgggcagaggcgctcctcacttcctagacggggtggcggccgggcagaggcactcctcacatcccagacaatgggcggctgggtagaggcgctcctcacctcccagacagggtggccgggcagaggtgctcctcacttcccagatggggcggccgggcagaggcgctcctcacctcccagacagggtggccgggcagagacactccctacttcccagatggggcggccgggcagaggcgctccccacttccctgacggggcggccgggcagagacgctcctctcttcccagacggggcggctgccgggcagaggcgctcctcactactcagaccgggcagccgggcagaggcactcctcagttcccagacggggcggccgggcagagatgctcctcacatcccagacggggtggtggccgggcagaggcgctcctcacttcccagacggggtggcggctgggcagaggcactcctcacttcctagtcggggtggcggccgggcagagacgctcctcacctcccagacggggtggcggccaggcagaggcgctcctcagttcccagacggggcggccgggcagagatgctcctcacatcccagacggggtggtggctgggcagaggcgctcctcacttcccagacggggtggcagccgggcagaggcactcctcacttcctagacggggtggcggccgggcagagacgctcctcacctcccagacggggtggcggccgggcagaggcgctcctcagttcccagacggggcggccgggcagaggcgctcctcacttcccagacggggcagccgggcagaggggctcctcacatcccagacaatgggcggccaggcggagacgctcctcacttcctagatggggtggcggccgggcagaggctgtaatcttagcactttcagaggccaaggcaggtggctgggaggtggaggttgtagcgagccgagatcacgccactgcactccagcctgggcaacattgagcattgagtgagcgagactccgtctgcaatcccagcacctcgggaggccgaggcgggcagatcactcgaggtcaagagctggagaccagcctggtcaacacggcgaaaccccgtctccaccaaaaatacaaaaaccagtcaggcttggcggcgggtgcctgcattcccaggcactcggcaggccgaggcaggagaatcacgggagccggaggcagggaggttgcagcgagctgagatcagggcagtacagtccagcctcggcaacagagggagacgggagagggagagggagagggaaagggagagagggggagggggagggggagagggagagggagctgggtgtggtggtgcacacttgtagtcccagctagtcaggaggctgaggtgggaagatcatttgagcccaggaggtggaggttgcagtgagctgagatggcagcaccgcattccagcctgagtgaaagagcgagactctgtctcaaaaaagagcgaggggagaggggtctcttcacttctcacattaaaggtactaaaagttaagtttcaacaactatgtaatgtttcataagggtgatatagagactccatgtactaaccctaaattcttagctgttgagctaatagctttttcacctatgacctccttaagtacatgacttcctggaaataattcttttttcccagggctttgaagaatcacttacacagaagtggtaatccatatcttacaataccaaataaagcctaaattccagtggtgagaacagagcttgctaatatgatagcctataaacaaattagtcctattaagtagtttagttttcccttctaggtggcatttgtttgaatgccccaaaaaataatttgccaaagaattagtgcttacccttttcctcctagttacctggagtagcaccatatcatctgttctttttttcccttttttctttttttctatttttagatttagggggtacaagtgcagttttgttacatagatatatcgggtagtaccgaagactggatttttactgtagccgtcacctaaatactgtacttcgtacccaataagtaatttctcatccctcaccatcccccaaccctttcactcttccaagtctccaatgtctgttattccactatgcccatgtgtacacattatttagttcccacttataagtaaggacatgcagtatttgactttctgagttatttcacttaagataatggcctctagtttcattcaagttgctgcaagagacatgattccattcttcttatggttgagtagtgttccatggtgtgactattactattccagtagtagtccatggtgtatcaatggatgatcagataaagaaaatgtggtatggtatacacacaccacatacacacttagattgattccatatctttatgatcagttcttatttacatgagggacagaggctgcagtacctttatctgacttcaagagcacacttttctgggagtacccatctaaggcatttatttctttctgttttttgtttttgtttttgtttttgttttttgatttttgttttttcttcaagatggagtcttgctctgtctcccaggctggagtgcagtggcacaatcttggctcactgcaacctccgccccccaggtttaagcaattctcctgcctcagcctccagagtagctgtgattacaggtgctcgccaccacgcccggctaattttttttgtatttttagtagagacggggtttcatcatgttggccaggctgatctcgaactcctgacctcttgacctgcctgccttggcctcccaaagcgctgggattacaggcataagccaccgtgcctggctaggcatttatttctttatagaggaagatcctgctaccttgactgactataaaaataaaaaataaccattctatttacttttctgatgcattgccattatttgatatgtctgttcgtagaatggtatgtccccataagaactggctaggcttgtacattaatagaggtatactaagcggtagatgcataaaaagaaagggtagagtccataaaatgggttaaactttggccttttggaatggctaaatgtttcactctggcccaaatgtctctggcagggcaggagaagtgcaagaaatatgtcagttgccacatgaccttattttttataagagctacacaattgtcctttatgaagaagaaagactcttgagagatgggaaatggaaacgtgactattggggtttctgtaactataaaatgggtccaatatcttaaacagtctctgtatacacttaaaaaaaattaaataaccaatataaaatccaccagtaagctttacttcagactctttccctaaaccaaaacatttgttactgcaggatgaaactgttgcttgcatggctgcagccattgatactgcggtggagcaagaagccgtaagtaattggcccctttgtgtagaaccaggagctctaactgccgtttcctataatttatcactcaactgaaaaagagaacctgtgattgttaccatcctccatagaatgcctgttaaatccagaaatctttagtgtaaatctcagcttcataaaatccctaccttggataggctctaccactaatagtataactggtaatggggggcaggacttctcaagaatgtaatgttccatatttgcaacccagctgactgatttcttgttagaggctagtattctgcatcaaccgtccagcaagttaaaaatgaggagaggaaaaaatgaggaaattatggcaaagtcaaaaaagcattagaggagaaacagaagagaattttttctatggatgagatattaggggctaaaagaaccaaggaaaataatttaagtgttcagatcacaaggatagataaaatgtgttagatgttgactaaaggttataaagacaaaatgaaaggctggatgatggattgcttgagacaggcttttctccctaaaatgaatctatgtcagtagttttcacattctgaaagaaggaaaatactaggtcaggtactagaggtcagctgtgtgagaacaaatgaacccttttctcaatttccaggaccttctctcctgtaagaaccccttggaatgaggtaaaagtaagaaatgccatccagatcaataaaggaaagagcaaagaaagttagttgatactaaaagagtccattaaagtatataagaaataaggtgcttgagagagcagggaactaggctagctatttatttcagatacttaaaacaaatgtatgcagagccactgttgtaaaggaacagagatattgttaatggagaagtgcctgtgagacttgatgaaatagtgcctaaggaactccatttgcttgtttctcttataaatcattatcctgatttttttccagcaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggtaaactatttcctagggcagtatttgttcatgtctacagtctcttaaactgaatgggaagaaaacaacaagcatataatttttgatgatgaaaagacaacaaaatgtatatagtataatgggagttgtactgttggtttaaaaagaggatacattcaggacagggagcatgtaattttgttccatttaatctaatgccttaccttatgccacaggtatttaataaatagtttgataacattataataaatgtggtccctacttatagagaaattatattctaataactatgcttggattctgagaaaaaacacatcttttggtaaatagtctgggttatagtatgaattatgaagacactagtggatgtcacatgacttgacaaatggctaaacttttttctgatgatagttctaagtggcctttgccaattaatagtcaggtctttacttaaaggcaaatccttggctttcaggttacccacaagaaatggcccttgctccagacttattttcccttgcagaccagtgtttctcactgtttgtaattacagacaaagggatattaggatgggtggtagggggaagaatgggttgttttcctgtccagctatatcctactactcccaaggtattatgtgtttatattgaggaacagctctagtatccatgctttcttattcccccatggcaactgttcatatgacatactttatttccaatctacaaccattaaaaacactttattactttacactgtacagttgttctcacatctgaaataagacacaggggcagggagagcttttggattggactgcagttgtcctagcaccctatctatcctgggaagtagccttttgaagacagaagtggggaggagagaacagtggacaagagaggtggacagttggcccaaggatgcccttggtcccttccctcctgagggccttttccaggggatcccccagggcccacgactgcaggaccttcaccaggaaaccaggctgaatgggaagagggttcacagtattggcgggggctgggaagtggggccaggatgaggaggaaggacagcttctggctttcttcccagctgctgggggttggagctgttttttggcactgtctacaaggtcttcctggggttgggaggaggaggaactgggggtttaagattctttccttgtggagttaggattctttccatttgaagaggggccatctggtctatggtgaggttcccaaggcataaacagtcagggtcttctgcctcctgcctccccaggacttccacccctgcctggctggcatcatctagacagccttttgtaaaaccaagacaagtgagagaggtgagcagagctggaaccaagccaggagcagggaaagaaaaaaatgtatgctttctccaggccctccaatttatcttcctcttccaagaggagagactatagggttggtttttgttggtggtggttcccaatctcagaagtccagatgaggctagtgttttctacctgttcttggtctagacagccccagtccctccccaggctacactaatggctggcctagatcagtagttggcagattctcatgcatgtcagaatcatccggaaggctccttaaaaccccagcttgcagggccccattccataagctctaattcagtgggtcttgggcggggccaataatttgcacttctatcaagttcccaggtgatattcctgctgctggaatgcaatacgagaaccactggcctagaatggtgcccacagtcacatcctcagcaacctggtgtctcctgggcagtactaaggagctgggccacagctggcaaagcccagccttaggggtaccaacatcacctgggaagctgctgggaatggtcttggggtgagcgcccggtgcagagaagtaaactaaggcacagagttcagcggcagagctgggagaggagcaggataccagggcccagtagagaacggatggggctgcaggaccctacaacaagtactcatgctttttttaaattgccagctctcatacgttttcagagtaaagacaaaaaaagtgtttctgctaattaattttcaccactttttccccctaggttagaggttgcttccaaaataataactgagttgccaatagagatttttttcccttttgttatcatggtcttttttaacttttaaaaacttagttttttgtaatgccagcactttgggaggctgcagtgggcagatcacttgagcccaggagtttgagaccagcctgggcaacatggcgaaaccctggctccacaaaaaatacaaaaattagccgggcctggtggtgtgagcctgtagtcccagctacttgggaggctgaggtgggaggatcacctgagcacagggaggtggaggctgcagtgagctgagatcacaccactgcaatccagcctgagtgacagagtgagaccatcccaacaaaaaaaactttggctgggcatggtgctcacacctgtaatcctagcactttgggaggccaaggcaggtggatcacttgaggccagaagttcgagaccagcctggtcaacatggtgaaaccctgtctctactaaaaatacaaaaattagctgcatgcctttaatcccagctacttgggaggccgaggcgggagaatcgcttgaacccgggaggtggaggttgcagtgagtcgagattgcaccactgcactctagcctgggtgacagagtgagaccctgtctcaaaaaaacaaacaaacaaaaaacttaatttttatctatgtcaaacaaatgcatatatatcattttttaaagtcaaatactataatacttagaaaaatcaaagcagtcctctattcctattctgacatttacctccatatttctagataagaattggcagtataattatgttacattttttagataaatatctattgacctcccatgatggaagacaagaacgtagctctcttatcccaccacctgtgcacactgcctcaccttcttctttcaaaatggttatatcaccctttttgtttaaatgagtatttagtgtttaaatttttctgattacataaatatgtttaaaattgagccatatagtatgattgcatttcctttcttgtatagctctttgtatttgctagagataataatctcattttttccatttacttagttttcgatatacctgtcaataattttatctccaaacttcttgacaaaactgtaaaactcatcccagcactttgggagcccgaggcgggcggatcacgaggtcaggagatagagaccatcctggctaacacggtgaaaccccgtctctactaaaaatacaaaaaattagccgagcatggtggcgggcgcctgtagtcccagctactggggaggctgaggcaggagaatggcgtgaacccaggaggcggagcttgcagtgagccgagatcacgccactgcactccagcctgggcgacagagcaagactccatctcaaaaacaaacaaacaaacaaaaaaactataaaactcttcattgtggtcagacataccagataatttatcaatccatttctttcctgaaaacaaccgttctggaatcttctgtcctggtttgctttctctagggctgttgcccactcaccagtttgggaccatcatcctggggatttgcttcacttctttctcatctgtgttgacatggatttcatgtcttcctcctctttagtatacccctttgctttggtggagtaaaaccccaatagctttctgagaatgtatacatgaaagggaaatactttaaagctttgcatgtctgaaaattgctttttaaaaattcttttacttgttagtttggctgggtttacaattctatagaaatgttttcttcattattttgaaggccttgctccattgtcttctgtttccagtattgctgttgagaagtctattataattttggattatttgttatagacctatttttttttactttggaaactttcaggatcttttcattgtccccaggtgttacttaatttcacaatgatggaccttggtatggtttcctgttgtttttttgttgttgttgttattattgttgtttttatagagacagggtcttgctctgttacccaggctggagtgcagtggtgccatcacagctcactgcagcctcaacttcctgggctcaggtggtcctcctgcctcagcatcccaagttgctgggactacaggcatgtgccaccatgcctggctaattttttattttttgtagagatggggtctcactatgttgctgaggctggtctcaaattcctggtctgtagtgatcctcccagcctcccagtcctaaagtgctgggattacaggtatgtaccaccacacccagccttcttttctcgtttattgtgcttggtgctcgactggtcctttcaatctagaaatttgtactcctttctgggcggtttttttcctatcatttctttgataatgctatctctacattttctctgttttctctttcttgcacttctcttagtcagatattggacctcttagatttagtttctgcttttctgatctctttcttcctattttctatttctttgtctttttattccactctgagagatttcccttcattcttagtgaattatttcatttggctattaatttccaaggtctccttttgatcctgtaattgttccttcttatagccttttattctttttgtgtggatgcatagcccatctctaagaataggaattaaattttatcaaggttttcttcttctccctgccttgcctttgtttcctccagatttcctttctctactgtgtttgttttggtctgtctttcaggtaagatactttcctacaatttctagtgagccatggctatccattcatatttaagagggaggcactaaaagccaatagcaagttgtatgtgcatggatttctcttaggctagtcaatttccaataaagaaatcttttattcttttgcctagagttgtatgggcctagtggtggtatgccatcattctagtaacccagacaaaataagggagttgaagtctctccaatcatagacagacttttatttaatccctgtcagcagtatggtactgcatccctgctattagctgtgtccaacctgttaggttcggcctctccagaaaggaagcctctgctctactctgtggctctgtggtacatattggcatgcttcttcttgatgtttgtcctgtaggagttatattttagctttttccactctggatgtcagttactgcttatccagctgttttcttcttccaaaagtttgttgatatctctcaactgctttccttgtctcttttcattctcgttgatttatacctccttttttgttcattttcatgtgatttcaggagggagtaagttaaatatgtagctcaattgtccatgttaataggacatacaatgcagcctctttaaggtcaaatgtattttggcttttccaggataaacaaaggattactggtaaggctgagaagtgattcctcctttcttgtactcttgcctagaaacatggggatatgtgttcccccactgtatttctttctttctttctttctctctctctctctctctttctttctttctttctttaaccggagaggggtatatttattttctcacattttaaaaaaaaaaaaaaagctgaacataagtagtctggggcacgtacagcagcaaaggcccaggatccttcctgctttctgcttccttggccttagggtgtgaatcttttcctcatgctctcaagacagctgtctgagcaccagccatcacatccacattccaggcaggaagaaggcaaaggtgaagggtactgcacatgtcagctgagctccctttacaggttctttcctgcaagtctctcccgacatcatccacttgcatgctacaactgcccaccctgggttgtgagggagggtaggacatggcttttgcctgcccgcttgtcagaattgggcagaagcactgggattctgttagtagggaggaaggagaatagatgctgggttaacgatttgcagtccccgccacagccaggacttaggcaggggtgattcccactaaaagccaaaggtttcatgcctggctgcaggggagaggtgcttgggctggggtcctgccttgtcttaacaaatacgaggctcttgttaaatatttaaccctgtgagggtggcttgtggcccacgtgcacccgaatcagctgcctggcatgcctcagcccactccagggcttccaattcaccctggggcaggggaggcctggggcacgcggttttcacacacacactcctagctgatttctttttcttctgtaatttataaaattaacactgcacttattggaagacatgaaaatccaaagatgggtagagaaaaagttcacctccctgtgccttgcccctgactaacccacgttaacagtcttacctgctcccaggggattctgggatcatggaaggtccttgagaaactctctagtcctagacaagtgctggggggtgggaggataggctggggagagaagggggctcctcagcaggccgagccttggttgctcaaccctgctggtactgactacacatggagcgaggaatgtgctgagggctcagccacgtgggtggtccttgtggcctctgccactgccctgggtagtcgtcactcagccacgtcaacaagcgacattggggaggcaggcctgggccgcctgaaccgtcacctcagtcctggttgacacctcaggcctggtcattatctgaactttggctgcagggcttctgggcagaaagggcagatccaactggctcgtcctagccatgtgctcccggagcagcctgcccagggatctggagagcagcagccagatcctaacctactctgcaccaacaggcaggaaagggcaccttgagtctgccactgtagggtttcagaagcaggctgacctgaggctttccaaatttcacgagggctccttctaaggcctgggctgtgtccagatgttggaccacatgcaaagaatggaggccgagtccagaaagaggagggccctcccccatgggaatgtgcacgttggaagggctccccatttgcccctagatcctaggctggatgtgggctcaggaggctaacccctatggaccagcccacccgttcagccaatgggcagccacagcaagggcagagggagcagcagaggcagcccacgtggtcacaggtcccgtgggctccagagctctcagctccaggcacccctgcctgccccgcttcgagcctattgggggcagacttcctgctgtgtctggtcactaacctctgcccacaccactaaaggactgtagctgaattctccttagttaaatcctctgctaacacaaaaggaaaaagccaaatctcatctcacaagagctttatttgaggtgcagcatgcatggggccttgccccaaatgccatgggcatcacattcaggaagaggcagacatccccacaacagtcacatgctgaagcttccgtctgcaatgtctggtggcagagttctcactcagcagacctgtatcattatatacatcaccatgttatcaaagtccctggactggatattgtccccgggttacagaaggggttgcacatcacatctatgtaggagttgtgcagcttccagaacatcctgtgaatttcattgtctcgaagagctgtgttggaggaattcaccaccatgacaaacttcaccttggagatggtagtgtagccctgtctgcatagctggttagggaatgcacttgtaagacaaggactgctgggacagcaggtaaagaacctgccagctgagggccctctgtgtgccctcagtttggagaagcctggcaaccttgaatcacaggaagtgcccaggctgggctggtcctgcagtgaccatactgggtgcatgcctacatacttcactgggatgactggtgtttactggagaagcaaagggcaggcagctaagctttacccaattctggctccggaagctgagccattcagactctgagtctctgtgtgcacctgggatgcctcaccctctttgtgaatcaatgcctggtccagaaagttaactgcaaaaccagagacttcatgaataaggcggacctcctctgtagaggccatgttttgtaaaatagtggctactggtaaatgtcaccatggacaagctacattactgctcttggaacgtctttgaactccatggtctcaagtgatttgtccaaagggactggtcgagagtctctagtgacttatgaggcaagaccttgtagtcctctgtggggtagagcaggtccagatagacctctctctggttgaccaaggccttccccattgaggagatcttctcatccaccacatccagagatgtgtgcaccatgtactggaaactcagctctttctccgtgggggtgctgcggatgtagagagggtaattctccttggtgatcaccgggatgcatatcaccatcttgggaggaccagtgctgggtgccccgcccattgtattcctaactctacaaaggggtgctagtaaggagctatagctatagtaagagatctagtctttttccccatggcatctagtccttttccccatggtatcaaatatgcttgattaacttaagaagaaataaattttttttgagacagagtcttgctctgtcacccaggctggagtgtagtggcgcaatctctgcacactgcaacctccacctcttgagttcaagcaattctcctgcctcagcctcctgagtagctgggattacaggcctgtgccaccatgcctggctaatttttgtatttttagtagagacagggtttcaccatgttggccaggctggtcttgaactcctgaccttaggttatctgcccgcctcggcctcccaaagtgctggcattacaggcatgagccactgcacaaggcctgaaataaattcttaatataatcaatatgttttaatcacatgtgaatcaccatctttttttttctctaagaaataaaagcagtttttaattcaattatttatttatctagagacaaagtctcactctctcgcccaggctggagtgcagtggcatgatcatagctcactacagccttgacttcctgggttcaagggatcctcccacctcagcctcctgagtagcatggtatttttcctatcacctgtaaagaattgccaaagaaaaatagggggagggataggttctgattaatgaagattaccatgagttgtagtaaaccaggactcaaatttttgaataattcccccttgtggagttggtaagacaattagggactaaatgtggtgtatataatgaatagaaactatttttctttttttttttaattatactgtaagttttagggtacaggtgcacaacatgcagctttgttacatatgtatacatgtgccatgttggtgtgctgcacccattaactcgtcatttaacattaggtatatctcctaatgctatccctcccccgtcccctgaccccacaacaggccccggtgtgtgatgttccccttcctgtgtccatgtgttctcattgttcaattcccacctatgagtgagaatatgcagtgtttggttttttgtccttgcaatagtttgctgagaatgatggtttccagcttcatccatgtccctacaaaggacatgaactcatcattttttatggctacatagtccatgctgtatatgtgccacattttcttaatccagtctatcattgttggacatttgggttggttccaagtctttgctattgtgaacagtgctgcaatagacatacgtgttcatgtgtctttatagcaacataatttataatcctttgggtatatacccagtaatgggatggctgggtcaaatggtatttctagttctagatccctgaggaatcgccacactgacttccacaatggttgaactagtttccagtcccaccaacagtgtaaaagtgtccctatttctccacatcctctccagtacctattgtttcctgactttaatgatcaccattctaactggtgtgagatggtatctcattgtggttttgatttgcatttctctgatggccagtgatgatgagcattttctcatgtgtcttgtggctgcataaatgtcttcttttgagaaatgtctgttcatatcctttgaccacttgttgatggggttgtttgtttttttcttgtaaatttgtttgagttcattgtagattctggatattagccctttgtcagatgagtaggttgcgaaaattttctgccattctgtaggttgcctcttcactctgatggtaatttcttttgctgtgcagaagctccttagtttaattagatcccatttgtcaattttgtcttttgttgccattgcttttcgtgttttagacatgaagtctttgcccatgcctgtgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggttgctgtagccttgtagtatagtttgaaatcaggtagcatgatacctccaactttgttcttttggctgaggattgacttggcaatgcaggctctttttttgtttccatatgaactttaaagtagttttttccaattctatgaagaaagtcattggtagcttgatggggatggcattgaatctataaataaccttgggcagtatggccattttcacaatattgattcttcctacccatgagcatggaatgttcttccatttgtttgtatccccttttatttcgttgagcagtggtttgtagttctccttgaagaggtccttcacatcccttgtaagttggattcctaggtattttattctctttgaagccattgtgaatgggagttcactcatgatttggctctctgtttgtctgttattggtgtataagaatgcttgtgatttttgcacattgattttgtatcctgagactttgctgaagttgcttatcagcttaaggagattatgtgctgagacgatggagttttctagatatacaatcatgtcatctgcaaacagggacaatttgactttctcttttcctaattgaatactcttcatttccttctcctgtctgatttccctggccagaacttccaacactatgttgaataggagtggtgagagagggcatccctgtcttgtgccagttttcaaagggaatgcttccagtttttgcccattcagtatgatattggctgtgggtttgtcatagatagttcttattattttgagatacgtcccatcaatacctaatttaatgagagtttttagcatgaagggttattgaattttgtcaaaggccttttctgcatctactgagataatcatgtggtttttgtcattggttctgtttatatgctggattacgtttattgattttcgtatgttgaaccagccttgcatcccagggatgaagcccacttgatcatggcggataagctttttgatgtgctgctggattcggtttgccagtattttattgaggatttttgcatcgatgttcatcagggatattggtctaaaattctctttttttgttgtgtctctgtcaggctttggtatcaggatgatgctggcctcataaaatgagatagggaggattccctctttttctattgattggaatagtttcagaagcagcggtaccagctcctccttctacctctggtagaattcggctgtgaatccatctggtcctggactttttttggttggtaagctattaattattgtcacaatttcagatcctgttactggtctattcagagattcaacttcttcctggtttagtcttgggagggtgtatgtgtcgaggagtttatccatttcttctagattttctagtttatttgcatagaggtgtttatagtattctctgatggtagtttgtatttctgtgggatcggcggtgatatctcctttatcattttttattgcgtccagtctatttgattcttctctcttttcttctttattagtcttgctagcggtctatgaattttgttgatcttttcaaaaaaccagctcctggattcattgatttttttgaagggttttttgtgtctctatttccttcatttctgctctgatcttagttatttcttaccttctgctagcttttgaatgtgtttgctcttgcttctctagttcttttaattttgatgttggggtgccaattttagatctttcctgctttctcttgtgggcatttagtgctataaatttccctctacacactgctttgaatgtgtcccagaaattctggtatgttgtgtctttgttctcattggtttcaaagaacatctttatttctgccttcattttgttatgtacccagtagtcagtcattcaggagcaggttgttcagtttccatgtagttgagcagttttgagtttcttaatcctgagttctaatttgattgcactgtggtctgagagacagtttgttataatttctgttcttttacatttgctgaggagtgctttacttccaactatgtggtcagttttggaataggtgtggtgtggtgctgaaaagaatgtatattctgttgatttgggatggagagttctgtagatgtctattaggtccgcttggtgcagagctgagttcaattcctggatatccttgttaattttctgtctcattgatctgtctaatgttgacagtgaggtgttaaagtctcccattattattgtgtgggagtctaagtctctttgtaggtctctaaggacttactttatgaatctgggtgctcctgtattgggtgcatatatatttaggatagttagctcttcttgttgaattgatccctttaccattatttaatggccttccttgtctcttttgatctttgttggtttaaagtctgttttatccaagactaggattccaacccttgcctttttttgttttccatttgcttggtagatcttcctccatccctttattttgagcctatgtgtgtctctgcacgtgagatgggtttcctgagtacagcacactgatgggtcttgactctttatccagtttgccagtctgtgtcttttaattggagcatttagcccgttaacatttaaggttaatattgttatgtgtgaatttgatcctgtcattatgatgttagctggttattttgctcgttagttgatgcagtttcttcctagcctcgatggtctttacaatttggtatgtttttgcagtggctggtcccagttgttcctttccatgtttagtgcttccttcaggagctcttttagggcaggcctggtggtgacaaaatctctcagcatttgcttgtctgcgaaggattttatttcttcttcacttatgaagcttagtttgactggatatgaaattctgggttgaaaattcttttctttaagaatgttgaatattggcccccactctcttctggcttgtagaatttctgccaagagatcagctgttagtctgatgggcttccctttgtgggtaacccgacctttctctctggctgcccttaacattttttccttcatttcaactttggtgaatctgaccattatttgtcttggagttgcttttctcgaggagtatctttgtggcgttctctgtatttcctgaatctgaatgctggcctgccttgctagattggggaagttctcctggataatatcctacagagtgttttccaacttggttccattctccccgtcactttcaggtacaccaatcagacatagatttggtcttttcacatagtcccatatttcttggaggctttgttcatttctttttattcttttttctctatacttatcttctcgcttcatttcattcatttgatcttccatcactcataccttttcttcaagttgatcacgtcggctactgaggcttgtgcattcgtcacgtagttctcgtgctgtggttttcagctccatcaggtccttgaaggacttctctgcattggttattctagttagccatttgtctaatcttttttcaaggtttttaacttctttgtcatgggttcgaacttcctcctttagctcggagtagtttgatcgtctgaagccttctctcatcttgtcaaagtcattctccgtccagctttgctccattgctggtgaggagctgcgttcctttggaggaggagagctgctctgattgttagaattttcagtttttctgctctgttttttccccacctttgtggtttttatctacctttggtctttgatgatggtgacctacagatggggttttggtgtggatgtcttttctgtttgttagttttccttgtaacagtcaagacccttagctgcaggtatgttggagtttgctggaggtccactccagaccctgtttgcctgggtatcagcagcggaggctgcagatcaggggatattggtggacaccaaatgtcgctgcctgatcgttcctctggaaattttgtctcagaggagcacccggccgtgtgaggtgtcagtctgcccctcctggggggtgcctcccagttaggctactcaggggtcagggacccacttgaggaggcagtcttttcgttctcagatcttcagctgtgtgctgggagaaccactagtctcttcaaagttgtcagacagggacatttaagtctgcaggggtttctgctgccttttgtttggctatgccctgcccccagaggtggagtctacagaggcaggcaggtgtccttgagctgcggtgggctccacccagttcgagcttcccagcctctttgtttacctactcaagcctaggcaatggtgggcgcccctcccacagcctcattgctgccttgcagtttgatctcagactgctgtgctagcaataagcgaagctccatgggtgtaggaccctctgagccaggtgtgggatacaatcttctggtgtgccatttgctaagacctttggaaaagcgcagtattagggtcggagtgacccgattttccaggtgccgtctgtcacccctttccttggctaggaaggggaattctgtgaccccttccgcttcctgggtgaggcgatgcctcgccctgcttcggctcacgcttggtgcgctgcacacactgtcctgcacccactctctgacaatccccagtgagacgaacctggtacctcagttggaaatgcagaaatcatttgtcttctgcattgctcacgctgggagctgtagactggagctgttcctattcagccatcttggctccaccccctagaaactatttttcatctatcagattggtaacagtttttaggtgtagcaatatcaaatgttgacaagggtgcaagcaaagtactctcatacatagctggtaagagtggaatagcccctttggatgacaatttggcagtatctataaaaaaagaaaatgtatatcctcatgactctgtaattcccacttctttctaccctagtaaaaccttgcacatgtgcacagaaatcatgtagcagaatatttcattatggaaaaaaaatgaggcagatctgtatatgctgatataaataaatctccatgactaattaagttaaaaatggcaagttacagaataacatatatatatataaaattctatgtttaacacattttatttggtataaacacacacgtgtgtgtgtgtatatactatatacttacatcaattatatattctagtaatggatattatgtgatatgtaatatataatacatttgtttaatatataatcatgcaccaaataatgacatttcagtcagtgacagaccatggatacaatgatagtcccataagattgtaatactgtatttttactgtaccattatgtttagatacaaaataccattatgttataattgcccacagtattcagtacagtcatatgatgtacagtcacatgatatacagttttatagcctaggagcaataggctataccatatagcctgggtgtatagtaggctatactatatagatttgtataagtgcacactatcatgttcacacaatgatgaaattgcttaacaatgcgtttctcagaatgtattcctgttattaagtgacatatgactgtaaatgtctagatatgtaatatttgactatgtaaatgtctgcaaaaaatggaaggtatgcatcaagctgataacagtgcttacttctggagggggactggaattttggcagggttgaggcagtcaaggagacttgacctttacaagtattatctatttttttatataaatatatttatatgttacttctataagtaaaaatatagaatatatttttctataagtatagataaatatagaatatatgtaatatagaatatatgatatactatatatagaatatatgtaatatagaatatatcatatatattctgtatgtatagaatatagaataaatgtagaatatatcaaataaagaatatatgaatatacacatacatacatacacacccatgttattagtggttttaaatatgcagggtagtttgggcgtggtggctcatgcctataatcccaatactttgggaggccaagggaggtggatcacttaagctcaggagttcgagaccagcctggccaacatggtgaaaccctgtctctactaaaaatacaaaaattagccaagtgtggtggcaggtgcctgtaatctcagctacttgggagactggggcacaagaatcttttgaacctgggagacagaggttgcagtaagccgagatcacaccactgcactccagcctatgtgacagagcaagactctgtctcaaaaaaaaaaaaaaaaaagcaaggtaactataaagattgattttcattggttatactgaagtgactgagtacattgcttggaaaacagctctaggctatttagaaagcttctctgatatagccccacctaatctgcctctgcttattcgtgtcagtctaatactggtctagggcgtgcatataatcttcttggctgccaactactcatccagtcagttttcgccaatcttttttggttatgagaataggatggaatttgggttttccactgtcaaacttcagtttctagacttcgttttctttttttttttttccatttaaccctgagtggacacagcacatgtttcagagagcacagggttgggggtaaggtcacagatcaacaggataagaatttttcttagtacagaacaaaatgaaaagtctcccatgtctacctctttctacacagacacggcaaccatccgatttctcaatcttttccccacctttccccccgctctattccacaaaaccgccattgtcatcatggcccgttctcagtgagctgttgggtatacctcccagacggggtggtggccgggcagaagggctcctcacttcccagtaggggcggccgggcagaggcgccccttacctcccggacggggcagctggccgggcggggggctgacccccccacctccctcccggatggggcggctggccaggtggggggctgacccccctacctccctcccggacgggacggctggccgggcggggcctgacccccccacctccctcccggacggggcggctgctgggcggagacgctcctcacttcccagacggggtggctgccaggtggaggggctcctcacttctcagatggggcggctgccgggcggaggggctcctcacttctcagatggggcggctgccgggtggaggggctcctcacttctcagacggggcggttgccaggcggagggtctcctcacttctcagacggggtggccgggcagagacgctcctcacctcccagacggggtcacggccgggtagaggcgctcctcacatcccagatggggcggcagggcagaggcgctccccacatctcagacgatgggcggccaggcagagacgctcctcacttcctagatgggatggcggccgggaagaggcgctcctcacttcctagatgggatggcggccggcagagacgctcctcactttccagactgggcagccaggcagaggggctcctcacgtcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaaccagactccgtctgcaatcccggcacctcgggaggccgaggctggcggatcactcacggttaggagctggaggccagcccagccaacacagcgaaaccccgtctccaccaaaaaaatacgaaaaccagtcaggcgtggtggcgcgcgcctgcaatcgcaggcactaggcaggctgaggcaggagaatcaggcagggaggttgcagtgagccaagatggcagcagtacagtccagcttcggctcggcatcagagggagaccgtggaaagagagggagagggagaccgtggggagagggagacagagggagagggagagggagagggaaagggctagacttcgttttccaaatgcatgcagaactgcagttgttattgagtagataagtttgaaagttctgaatataagaatatttgtgcagctctttacagtttacaaaatgtctacctttttatcttatttgatcttcccaacaaccctgtgaggtaggtgttattattaattattgacatagatagggaaacctttgggagtccccaagagctcccctagatcaaatgattcactaggaggactcacaggactcagcatatagtcatactcacagttaagatttatggggctgggtgccatggctcacgcctataatcctagcactttaaggaggccaaggtgggaggatcgcttgagcccaggagtttaagaccagcctgggcaacatggcgaaaccccatcactacaaaaaaatacaaaaattagccaagttggtggcagactcctgtagtccttgctactcaggaggctaaggtgggaggatcacttgagcccgggagataaaggctgcagtgaaccatgatcatgcctctgtactccagcctaggtaagagtgagactctgtctcaaaagaaagaaagagacagacagagaaggagggggagaacggggagggagggaaaggaaaggaagaaggaagaagggaaggagggagggagggaaaagaaaagaaaaaaagaaagaaaataagcaaatgaagagccagatgtggtggcacacacctgtaatcctagcactttgggaggcagaggcaggaggatcacttgagcccaggagttcaagaccaacctgggcaacatatatatatacatgtgtgtgtatgtatatatatatatatatatatatatatatatacgtatatatatacatatatacgtgtatatatatacgtatatatatacatatatacgtgtatatatatacgtatatatatacatatatacgtgtatatatatacgtatatatatacatatatacgtgtatatatatacgtatatatatacacatatacgtgtatatatatacgtatatatatacatatatacgtgtatatatatatatacgtatatatacacatatatatacatatatacacatatacgtatatatatatacacacacatgtacacacacacacacacacatacacacacacacacacacacaaactcttttctgaacagaaaccaaaactaaaagatgaagtgactttccttaaagatacttatatagtaagcgtggcagtcaagattaaaacccagaccctcagattccaaacatttcctactacataattttaatctccatcaaatcaagagtaaatgttttcagcgtgcagttgaagtggtaaaaattaatgcatagttccttgagacatggaatgctgaagtgatttttcttcctgtgccatataatgtcttctttctctttgacctataacctttctaggataacataaaagagctagaattagaagtcatcaatctgcaaaaggaaaaggaagaattggttcttgaacttcagacagcaaagaaggatgccaaccaagccaagtaagaataaagttaataaatgttatttcaagtccctactatgtgtgaggagctttgcaagaaatagagaagtagaagtcccatttactgcccctaaagatttaaacctaattatgaagaggaaacctaaacacaaaaaatggttaaataattgcaattttaaatagcgtctcaagttgacagtaaaagaatgtcataacacagcacatgattagtagccaaataaatttcttaggcagtaattgtgttaagagttcagaggcgaggaatatcaattcaggctaccatgatcaaggaaggctttgtaaaaagttagcatttgagctggcttttgaaagattatcacacttactagataacagcagtttctttgtccctgcactaatggtaaattagcttgtgaatggaattaatgtccaggctagtgatttaaaaaatcaatctagccatctcttaccagttaagaataaaaccaaagcagataaccataacatcctactctccttcagacctctgccgtatgggctatcctaccttctttttactcagtgactccgttttatctctcagttgagtctaaagctcatgtttgtaaaagttatgctgaatgtttactttctatctcagacttgtataataatcatcagaattattcttcatagctaaagtgaagtgaaatgccttcaaagaaccattttgatgcaaaaggggcggcgtatattgaggcagttgcattgctgtgtactaaaagttgtcttactctttgtattaagctcctattattgagacaggtttggttgtttgggtggtattctttttttaagatggctatgtgactagtcacctattttatatatgtcagtgttgtaactctgggagtctagtattatgtcttttgaagtcaggctttgctgctggtagtcctcacttctacagcatctgtgtttaggttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacgggtaataaattctcatccttgcatttacccccattggaatttacaaacataggtattccatttagaaatatactagaggtgttttcaggtgagaaaatagcaggcagagcaatcatttcaagtgtgtgaatctccacaaatgtcccttttgcagaacattgtgctagtggtcatctaggatctgcttaataaaacgttgctttgacattcaaaatttaatgttagagtctctgaaaccaaagaacaaagacatctccatacttagtgggttatatcctgatcaccttccatgatcatgcagcataattttgtaaagtagtaataagatgacagacacctagagaaaattctcagttattgaatgttcaacttgtggcaccaacaaagtggtggttacaggctacttgtactgaaacctttagaatacaatggttactaggtggatttgtcctggaggcttagtagatgtttccttgaaatttcatttgtatacagtgaatttagggctggatttagcttgtaggtacatttttatttaatttcttctcagtgttcacttgtatagcctgtacttggaaaccctgtgcaagcatagcaaggggtattgtaagcctaatcagggaatctgttggggactgctttcccagcctagttctggcttttctctcttcttaatggtaagtctatccatccgcaccagcctagaataaactgcagatgactaatacttttgctggtttttgtttttatagatgatgaaaaaccagcgggtacagttaatgcgtcaaatgaaagaagatgctgagaagtttagacagtggaagcagaaaaaagacaaagaagtaatacagttaaaagaacgagtaagtaactaaaacttcttgaaggcctaggtaataaacccttctctgagctgactaacaattttaatgcttctcttcaaacacctcgtgtctccaaaagtgtgacattctcatgaatttaacaactttattaaatgtctactatgtctattatgtgcaaggtactatctactaggcactattagaaatagaaaaattagtagtatataagctctgcccttgaagaatgtcttacctaaaggagatggtaagatataagcatggatttctcaaatacaaggaagaaagagatttgggctataagaataaaataaaaagtaactaagagaaaagaaagcaaatttgcagttggagtgaaaagatgatggttgaataggccctgaataataggaagggttatgatagagataagtacaagcattccagatagatagatcaaagaaatagagatgacaactttgtagacacattcaaggaatggcaagtggtccaactggggtgaagtatagtagtggaccattccattggaaaggcaagtcgaagctggattattaaagatccaagaagtttgaactcattttgttagtagcataaagatttttaagggtttttagaaagtgatatcaacaaaatactgctttagaaagatatatctgggaataatgtatagagcaaactgtaatattgagaaacagaggccagaacacaagaagatattgtataatccagaagaattataagggcctgaatatacatctgacaacagagcccccagaatatatgaagcaaacactgacagaaatggagagagaaatagacaaatcaacagtaataaatatttggagacttcaatccacctctttattttctttcttttttagatatggggtcttgttctgttgcccaggctggagtacagtggtgcaatcatagctcactgtagcctcaaactgctggtctcaagcaatcctcccacctcagcctcctgagtagctagaactacagctgtacaccatcacacctggcaaattttttattttttgtagagatggaatctcactatgttgcccagactggtctcgaactcctgggctcaagcagtcctctcacctcggcctgctaaagtgctggtattacaggcatgagccactgaacccagcccctactttaataatggatagaacaataggcacaagatcagcaaggatattgaagacttcaacaatataatacctagcattttcatatctacattcataagagatattggtctataagtttatgtaatatgctagattacacactatacctaacagaatctatagactacgccaaccaacaacagcaggatatacagtcttcctaggtgcacatgaaacattctccaggatagaccatatgctagaccttttatgcctcaataaatttaaaagtattgaaacaggccatgcatggtggctcactcctgtaatcccaacactttgggaggccaaggtgggcagatcacctgatgtcaggagttcaagaccagtctggccaacatgatgaaacaccgtgtctattaaaaatacaaaaattagccgggcatggtggcacatctgtgatctccagtattcaggaggctgaggcaggagaattgcttgaacttgggagatggaggttgcagtgagctgagatcgtgccactgcactccagcctgtgcaacagagcaagactccgtctcaaagaaaaagtattgaaaataatacaaaatctgttctctaaccacaatggaatgaaattaaaaatcagtaacaaaaataaatttaggaaattcacaaatatgaagaaattaacataatcctaaataaataatgggtctaaaaggaagtcatagggaaattaaaaaatactttgagattaataaaaacaaagatacaacataccaaaacttatgagatacagctaaaacagtgtttggagggaattttatagttgtaaatgcctatattaaaaaatgcagaaaggctcctgtagccccagctacttgggaggctgaggtggaaggatcacttgaccccaggagttcaagaccagcctgggcaaaattgtgagactgcatctcagttttttttaattgaagaaagatcttaaaccaataacctagccttctactttaaaacactgaaaaaaagagagcaaactaaacccaaagctagtagatgaaaggaaacattaaaagattagagtagaaataggctgggcgcggtggctcaagcctgaaatcccagcattttgggaggccaaggtgagcagatcacctgaggtcgggagttcgagaccagcctgagtaacatggagaaaccctctctctaccaaaaatacaaaattagctgggcatggtggtgcatgcctgtagtcccagctacttgggaggctgaggcaggagaatcgcttgaacccgggaggtggaggttgcagtgagccgagatcgcaccattgcactccagcctgggcaacaaaagcgaaactgtctcaaaaaaaaaaaaggattaaagtagaaattaatgaaatatgaaatagaaaaaaacggggaaaatcattgaaaccaaaagttggttttttgaaatgatcaacaaatactgacaaaccttcagatagccttaataagaaaaaaaaagaggccaggcgcggtggctcacacctgtagtaatcccagcactttgggaggctgaggcaggcagatcacaaggtcaggagatcgagaccatcctggctaacacggtgaaaccccatctctactaaaaatacaaacaaaaaaaaattagccaggtgtagtggtgggtgcctgtagtcccagctactcaggagtttgagggaggagaatggtgtgaacccggaaggcggagcttgcagtgagcagagatcgcaccactgcactccagcctgggcaacagagcgagactccatctcaaaaaaaaaagaaaagaaaaaagaaaaaaaagaaagaaaatttaaattactaaagttaggaatgaaagagggaatatcactactagtcttgccggaaggaaaggattataaggaattactattaacaactgtatgccaacaaattagatagcctagattaagtagacaaatgcctggaaagacaaaaactaccaaaactgactcaagaagaaatagaaaatctgtatagacccatgacaagaagttaaattagtagtttaaaaacttcccacaaagaaaattccaggcacagatggcttcactggtgagttctatcaaacattttaagaaaaaatacccatttcttggccaggtgctgtggctcatgcctgtaatcccagcacttttggaggccgaggcaggcagatcacctgaggtcaggaattcgagaccagcctggccaacatggtgaaaccctgtctctactaaaagtacaaaaattatttgggtgtggtgacacacacttgtaatcccagctacttgggaggctgagacacaagaattgcttgaacccaggtggcgaaggttgcagtgagccaagatcacaccgctgcactccagcctgggcgatagagtgagattctgtctcagaaaaaaaaaaaaaaaagacagaaatacccatttctcagaaactcttctgaaaactagaagcagtggaaacacttcccaactcattccatgaggtttgtgttccctgataccaaaaccaaagacatcacaagaaaagaatactacagaccaatatatcttaatataggcatgaaaatcctcaacaaaattctagcaaactaaatccatcaacatttaaaaaggatgataggctgggcgtggtgactcacacctgtaatctcagcactttggaaagccgagatgggcagatcacttgaggtcagaagttttgagaccagcctggccaacatggcgaaaccctgtctctactgaaaatacaaaaaaaaattagctgagcatggtggcatgtgcctgtaatcccagctacttgggaggctgaggcacgagaattgcttgaacccaagaggaagaggctgcagtgagccaagaccgtgccactgcactccagcctgggcaacagagtgagacactgtctcaaaaaaaaaaaggatgatacacttatgaccaagtgaagtccatctgaaaaatgcaaagtttgtttaatatatggaaatcaatttatgttatatactgtatcagtaggaaaaaggacaagaaccacatgatcatctcaatagacacagaaaaagcatttgacaaaaatctaacactcatgataaaaacactcaagaaactaggaatagaagagaacttcctcagcgtaataaagggcgtgtatgaaaaacccacagctaacatcatacttaatggtgaaaaagagcatacttttcccctaagatcaagaacaagacaaggatgtccactcttgccatatctattcaacattgtcctggaggttctaaccaggaagtttagggaagaaaaatatataaatggcatctaaactggaaaaggtgaagcaagactatctctgtttatagatgacatgatcttgtatatagaaaatcctagagaatccactaaaagtctattagaattaatatatgagttcaccaaggttgcagaatataagatcaatataagaaaataagttgtgatctggcacagtggctcaagcctgtaatcctagcactttgggaggccaaggcaggcatatcacttgaggccaggagttcgagaccagcctggccaacacggtgaaaccccgtctctactaaaaatacaaacattagccaggcatggtagcacatgcctgtagtcccaactacttgagaggctgaggcacgagaatcatttgaacccaggaggcagaggtttcagtgagctgagatcaggccactgcacttcagcctgggctacagagcaagactctgtctcaaaaacaaacaaacaaaaaaaacaaaaggaaaagaaaagaaaatcagtagtatatttatatactagcaattaacaatttgacaatgagattaataaaacaatcccacggctgggtgtggtggctcacgcctgtaatcccagcactttgggaggctgaggtgggcagatcacaaggtaaggagctcgagaccagcctggccaacatagtgaaactccgtctctactaaaaatacaaaaaattagctgggtgtggtgacaggcacctgtaatcgcagctacttaggaggctgaggcaggagaatcacttgaacccgggaggtggaggttgcagtgagtcaagatcatgccactgcaccactccagcccaggcaacagtgcaagactctgtctcaagagaaaaaaagaaagaaaacaattccattaataataggatcaatacaaataaaatacttaggaataaatttagcaaaagaagtgtaagacttgtatacttgaaaactactgaacatcattgaatttaattaaggaagacttaaataaatggaaggatatcccatgttcatgggcaggaagacttgatattctaaagatggaatacccttcagattgccttacagatgcaacacaatcccagtgaaattccatctggtttcttcacagaaactcacaaactgattctaaaatatatatggaaatgcaagggacctagaatattcaaagcaatcaaggagaagaacaaatttgtaaatgtcacatttactgatttaaaaactttctacaaagctacactaatcaagactgtgtggtactgtgtaaagatagacatataggtcaatggaataagattgagaatccagaaataaacttacacacttatggccagttgattttcaacagtaatgccaagacaattcaatgaggaaaacaattttgtcttttcaacaaatagtcctagaacaaccgggtagtcatatgcaaaataatgaagttgaaacttgtggccaggcacagtggctcacgcctgtagtcccagcactgtgggatgccgaggcgggtggatcacttgaggtcaggagttcaagaccacctggccaacatggtgaaaccccgtctctactaaaattacaaaaaaattagctgggcatggtcgtacatgcctgtaatcccagctactctggaagctgaggcaggagaatcacttgaacctgggaggcagaggttgcagtgagctgagatcacgcccctgcactccagcctgggcaacagagtgagactctgtctcaaaaagaaacttgctctcataccatatacaaaaattaaagcagatcaaaaacctaaacgtacgagctaaaactataaatctcttagaagaaaacataggtgttaatctttgtgactttggattagacaatgatttcttagatgtgacacctaaagtacaaacagctaaccaaaaaagagttaaattagacaaaattaaaagcttttgcattgtaaacaataccatcaagaaagtgaatatgatcaggcatggtggctcatgcctgtaatctcaacactttgggaggccaaggtgggaggattgcttgagcccaggaaattgaccccaccctgggcaacatagcaagaccccatctctaacaaaaaaaaaaaaaaagaaagttaatagccagtccatagattgggaggaaaatatttgcaaatcatatagctgataagagtcttatatccaagatagataaagaactcttactgtctgggcacggtggctcacacctgtaatcccagcactttgggaggccaaggcgggcggatcacctgaggtcgggagttcgagaccagcctgaccaacacggagaaaccccgtctccactaaaaatgcaaaaaaagtggccgggtgtggtggcacatgcctgtaataccagctactggggaggctgaggtagaagaatcgcttgaatccgggaggtggaggttgtggtgagccgagatcgtgccattgcactccagcctgggcaatagagtgagactccatctcaaaaaaaaaaaaaaaagaactcttaccaatcaacaataaaaatataacccagttttaaaatgggcaaagcaataagtacatgaaaaggtgctcaatgtcatttgccatcagagaaatacaaatcaaaaccacaatgagatgcaatttcacatctactaggatggctataaacaaaaagacagataataataagtcttagcaagaatgtggagacactgaaagcctcatacattttcagtaggatgggaaaatggtatagctgctttggcaaacagtttagcagtttatcaaaaggctaaataaaaacgtagaggtaccatatgatccagcaattccactcttagttttgtctacccaggagatacgaaaacatgtcatatatgcaaaaccttgtacccagatgttcatgcagcagtagtcataatagccaaaaagtggaaaaacccaacatgtccatcaactgatgaatgggtaaataaaatgtggtctatccatacagtggagtattattcagccatacaaaggaatgaagtactgatacatgctacaacatggatgaggcttgaaagcattttgcttagtgaaagaagccaatcacaaaagaccatgtatgataggattccatttatatgaaatatccagagtaggacattaaaatctgtagagacaaaaagtagattagtggttctctagggctttggggtggggtgatggggttgtagggtgatcactaaacagtatatttctttttgtggtaatgaaaatgttctaaaattaagtgtggtgatgtttacatcaactgtgtgaatgtgccaaaagccattgaatcatgtactttaaatgagtgaattgtatggtatgtgaattatatctcaataaaactgttaagaaaaacaaaagaagaaaggagacatctctataaagtgatgacaactttacattctacaggaatatatattccacattgacaaggatctttgttttgctcacttctgcatttccaatggctagaacagtggctggcaagtagtgggcactcaataatgtttagtgaatgattttaatcataattaatgcaaaatatacctttcaaaaaatgaaggaagtagggcaacaaaaagtaccgcgggcttttcagtgactgtaaagtcagaggaaacagctagtttgaagagacaaagttggttttaggagaataatctttgggatggagagacctagaaaatattggataatgttggcctagagttcaagggagaagttgggctggactttgcaattaagagttgtctttgtgaggccaaggtgggtggatcacgaggtcaggagttcgagaccagcctgaccaacatgctgaaaccccatctctactaaaaatacaaaaaaaattagccaggcacggtggcacatgcctgtaatcccagctactcaggaggctgaggcaggagaatcgcttgaacccgggaggtggaggttgcagtgagcagagatcgagccactgcactacagcctgggcgacagagggagactccgtctcaaaaaaagatttgtctgcatagaggtgaaaaatgaaactttgggagtaatgagataatggagacagagaatatatagaaaaagaaggctaagaagagaatctctttttttttttttttggtctcaccctgtcatccaggctggagtacaatggcaccatcttggctcactgcaacatctgcctcctgggttcaagcctcctgagtagctgggactacaggcgcatgccaccatgcctggcaatttttttttgtatttttagtagagacagagtttcgccatgttggccaggctggtcttgaactcctgacctcagatgatccacccaccccagcctctcaaaatgctgggattacaggcatgagctaccatgcccaactgagaatctatttcatgtataagaaaatgaaaagaagacaatgaaatttgtaaggtagaaaaataattaggatggtatggggaagttattggtagtgctaacgatgctgggagagaagccaaagaagatagtgactgtaaaaacaccactgaatttaagaagtaggaaattccaggacaactggtaggaactacttacaaggggattatggagtgaccagtaatgacaattggaagcactaaacatagacctctctttcaaaaagtctggtactaagaagactgttgacttttctctttccactggactagcttagtcctctgactgtgtttctttaattatcttgacttttcatttcaacacacatcatattttattataattgtattgcatgttgtttgtattctctggtaatctctgtaggagtagtaaccatgtcatgtttatctctgtatcctagacacctagcccagtgcctagtgtttagttgatggcacagtaaatattatattgttgaatgaaatgaattgttctagtatgctggcaaagacatgacaaaaatggctgaccattctatccagattggattggaacaagtgaagccagaaggagcttaatggattattagaagagggaaatggccaagaaatcaaagcagttaaatattgtgtgctcagctgaagcaggtgataccccatagtatttcttggtattctttatctttaatctctgggaagaaagagcacattcagtaataacctgtttttatttttattttagattcagtgggtgcaggagcaggtttgttacaagggtatattgtatgatgctgagctttgggcttctactgatcccatcacccagatagtgaacatagtacccaataggaagtttttcagctcttgcccccctttctccatccctccctccttttagagcccccaatgtctattgtttccatctttatgtccgtgtgtacccaggttaaccttgtttttttcaaaaatgagaaacctcttttttttttagctgcaggttactttaattttataggtggttggctatgtgatagactttctcttttttgccagccacctgggttttgtaatggatggacaggtagggttgatgggaaaagaatactggtctatttttcaggagacctgaatcccacctctgtcaataactacctatgtggaaaggactgttcattagatgatctttaagcttccttccaggcctcacattctaggatattatttctagtagttgatttatgactgagactcaagaatttggccacagagcaataagccaaagggaaaaaccacttcccctctacacacaaacatggtttctagaactacgagtttttgactcatatgagaagatgaaggcagctcactgtattgtagttaaccttacaaatcaaggatgtcttgagagacaccttatagtataaggttttattttagctagctgaacagcaattaatatctgacttttttcttgtcaggaccgtaagaggcaatatgagctgctgaaacttgaaagaaacttccagaaacaatccaatgtgctcagacgtaaaacggaggaggtaagaaaattcaatctgctaggtcaagtgtattgtcatcttcaggtttaaatgcttgcaaagtaatatcctttaaactagcaagcgtcctgagaaaccagggatgccaatcttcacaagcaattcctaaatcttgatcactgtttatatgccactgtgagcagataaaaacttgatgaaaaatggtactgttcaaataaggattttttcctaactggacgtgagcctttcctgaaaaaacaaagtgatattgatatgtgacatttctagacacttttagtctgcagaacttccttgaagtgtgttcctcccctaggcaccaaagcagtagctgttcaccagtgttatgtccatggaagtttataaacctggttcctataggaactcaaacccatagaatttttatctttactaatgtgctagaaattggattttttttttttaccattcattcaacattactatgtgccaattttatttaggcagcagctgccaacaagcgtctcaaggatgctctccagaaacaacgggaggttgcagataagcggaaagagactcagagccgtggaatggaaggcactgcagctcgagtgaaggtatgaacaacttgaactgccatttctcttgtggacactgggaacaggaaaaaaggagaaatagctttttttttttcctttttttagaagtaaacactgcaaaatctaaagttctacttgaaagccttatttcctaaagatagcaatgtctttgaactgttgttaaagaccaggagtatagaactctttctatctttgcccctattgaggttcagttacttttttaaacagcttcattgaagtagaattgacatattataaattgtacatatttaaagttcacaatttggccgggcatggtggctcacacctataatcccagcacattgggaggccgaggtgggcagatcacctgcggtcaggagtttgagaccagcctgaccaacatggtgaaacctcatctctactaaaaatacaaaaattagctggttgtggtgacaggtgcctgtaatcccagctacttgggaggctgagggaggagaatcgtttgaacctgggaggtggacgttgcagtaagccaagatcgcaccattgcactccaaactgggtgacagtgaaactctgtctcaaaaagaaaaaaaagtatacaatttgatgagtttggacacgtgtatacacccatgaaatcatcaccataatcaagataatgacagtgtgcttcattgcctaaactttctttgtatccctctgtaatcccttcttcttatccctctgtaatcccttcttctcctccctggtctacccgtctactccccatttcatatatatttctttatatccccacagtggttccaggcaaccattaatctgctttctgtcactatggatttgttttcatctggaatcatacattatgtattttttttctggcttttattcacaattattttgagattcatccatgtggttgcatatgtcatatacaacttctttcctttttattgctgagtggcatcccattcattgtatggctataccataatttgtttttatatccatctgttgatggatacttgagtggtttccagtttttggctcttacaaatattgcactgaacatttgtgcacaagcctgtgtggattttttttaatttcttttgagtagatagctaggagtaaaatggctttcttgtatggttggtgtatgttttaactgctaagtggctgccaaactgttttccaaagcagttgtaccattttacattcctactagcaatgtataagggttctagttgctacacattcttgccaataattagtatggtcagtcttttgaattttagctattctgtgtgggtgggtagtggaacctcattgtggttctaattttcttttctgtaatgactaatgatgttggacatcctttcatgtgcttatttgccatatgtatgttttcttttgtgaaatatgtgttcaaatctgtccccatttttaaattgggttgtttatctttttcttattattgaattaaaattctttatatattctagatatatttaacagaggacttctgtgttttacaaatattttctccctggctgtggcttgcccttttcaatttgtaacagtgtcttttgaagagcaaacatttattatgttaatgccatccaatttattgatatttttttctttatacttaaacagttttcatatcttgcttaagaaatcttggctgggtgtagtggctcatgcctataatcccagcactttgggaggctgaggcaggaggattgcttgaggccaggagttcaagaccagcctggggagcaaagtaagatcctgtctctacaaaacaaaattttaaaaaaattaaccagacatggtggtgcatgcctgtagtcccaactaccggggagactgaggtgggaagatcgcttgagactgggaggtcaaggctacagcaagccatgatcgcaccactgcactccagcctgggtgacacagcaagatcctgtctcaaaaaaatttaaaacagaaatatttgtctggccaggctcagtggctcatgcctgtaatcccagcactttgggaggccaaggcgggtggattacctgaggtcaggagttcaagaccatcctggccaacatggcaaaaccccgtctctactaaaaatacaaaaaattagttgtgcacggtggtgtgcgcctgtagtcccagctactcgggaggctgaagtggaagaatcgcttgaaccggggaggcagaggttgcagtgagccgagatcgttccactgcactccacctgggtgatagagcgaggcttcgtctcaaaaaaatatatatatttgtcaaacccatggtcgctaagatttccccctaagttttcttctagaagttacatatttttaagctttacatttacgtctttgattcattttgactggacacctttgtcaaaattaaatatccatacatctatttcagattgtttcattgatctatatgtctatttttatgccaataccaaaaagtcttgaatgcagttgctttttaagaaatcctgaaatcagtgtaagtccaaagttgttgttctttgtcaaaattgttttgggaaaactgggtcctttgcatttccatatacattttagaattatcttgttaatttctacaaaacagcttgctgggagttggattaagattgcatagaatttacaaatcaattcaaggagaatcaacatgttaagaatatttagatacacgaatgcagtatatctctttatttaggtttttaatttctctcagcaacattttagtttttagtgtacaagcgttgtacatcttttgtcaaacatatccctgagtatttcatatttttatgatattgaaaatggcatttttatttccatttccaattgtttagatattcttgttggttctcaaagcttttttgtagagttcttaagattttctacctagaaaatcatgtcatctgcaaatatggacaattttatttcttcttttctgttctgtgcttttttatttttttaacctttgtcttgccttattgcacttgctagaacctccagtacaatattgaatagactaggtgagaggctacaaccttgctttgttcccagtcttgggcagaaagcattcagtttttcaccgtaaagtatgataatagctatagattttttggtatatgtcttttatcaggttgaagaagttcctttttttagcttgcgaagtttttattacaaattgatgttgggttttttcaggagcttttttttctgtttctgttgagatgatctgactgttggttgattggtcagtttttattctgttatatggcaaatggcactgatttttccctaatttattctgtcaaggcatagctgacatacaataaaataaacccttttgttgtatagttctatgtgttttgacaacatgtacagttgtgtgaccactacaacaatcaagatacagaatagttctcttatccccagaaactcccctatatctcttacagccaattcctcccacaaccctggcccttgacaaacactgatctgtactctgtcattattgttttccctttccatcagtgtcatagaaatagaaacatacagtatgacttccttcacttagcataattcgagattaatttgtgttgtttgtgtatctgtagtttgcgtgtttttgttgttgttgttgagtagtatttcattgtatggatataccacagtttgtttatccattcacctgttgaaggatatcttaggtttttcttttccttaggttttggcaattacgaataaagctgctgttaaaaacacatacacgtttctatgtaaactaattatttcacttgggtaaatacctaagagtgggactactgggtcatatgataagtatatgcttaatttgtaagaaactgccaaattgtttatccagttagttgtttattgctgatatatagaaatacaatttatttttgtatattaacttttatctcatgcctttattattctactagctcttttataggtttttaggattttctatgtagactatcatgctgtctgtaaatacaattttatttcttcctttctaatctgtatgtctatcatttctcctacttgccctattgcattggtgagaaccttcaggatgatgatgaataggagtggtgagaatagacatccttctgttcttcctgatcttagggggaaagcattcagtctttcaccattaagtatattaactgtagttaatttttttgaaatactttttgtctctagttagttgatttggtgaattattttgattgatgttcaaatatggaaccaaccttgcatttcttttttttttctttccgacttttactaggttcaaggattacatgtgcaggtttgtttttacatgggtaaatggcatgtttcaggggtttcgtatacagataattttgtcacacagataatcagcatgatacccaataggtagtttctcagtcctcaccctcctcccaccctccaccctcaagtaggccctggtgcctattgttcccttctttctgtccatgtgtactcaatgtttagctcccacttagaagtgagaacgtgtggtatttgattttctgttcctgcattaattctcttaggataatagcctccagttgcattcatgttactacaaaggatgtgattttgttcttttttttatggctgtgtaatattccattccaaccttgcatttcttggataaactccatttaattgtgatatatcatcctttttatgtattattaaattcagtaatacataaaaaaacttgtttaaatttttgtatctgtgttcatgagggatattggtgtgtagttttttgtaataccttggtctggttttgatatcaaggtaatactggcctcagaaagagctgggaagtgtagtcgtttctcttcaaatgtctggaagattttgtgcagaattaatattgtttctttcttaaaaatttgatagaattcatcaggaaagccatctgtggctggagagatttatgtttcttgcttagttttgctttttggggagagggatgttaaataaagttttaaaaatagatataggattgttcaaagttatatgtttctccttgagtaagctttggtagtttgtgtgtttcagagaacttgtctgtttcatctaagttgtcaaatgtattggcataaagttgttcatcatattcccttatcgttctaatatctgtaaaatctcagccaggtgcgattgtttatgcctgtaatattggcacttagagaagctgagatgggaggatcacttgagcccaggaattcgagaccagcctgggcaacatagcaagaacacatctctattttttttttaaatctgtaatgatgtcatctatctcattcctgtttgtatgttttctcctttttctcaatcagtccaactagaggtttatcaaagaaccaactcattcttataataggtaaaatggtaatttttatgttatatatattttaccacaataaaaaaattcaaaacaactcccaattcattaatttccactctgatcttataataataataataataataattattattattattattttgagacggagtctcgctctgtcacccaggctggagtgcagtggcgtgatcttggctcactgcaagctccgcctcctggatcttttttttttttacttctgcatactttggatttattttggtcttctttttttacttaaggaagaagctaaggtcattgatttctttcttttctaatataggcattcagtgctataagtttccccttaagtattcctttaacaacatcccacaaattttcataatgttatattttcactttcattcaattcaaaatacattctaattttcttattgatttttttctttgacccatgggttatttagaagtgttatgtagtttccaaatgtttggggatttttccaaatgtctttttgttattgatttccaatttaattctaatatggtcagagaacatacttcatatgacttgaatccttttgaacttattgagacttattttatggcccagagtatgatcaatcttagtaaatgttctatgtgtacttgagaagaatgggtattctgctgttgttggatggagtatctataaatgtcaatcatgtcaatttgattgattgtgctgttaacatctattgtgtccttgctgattttctgcatactcgtcctatcaattattgagaaataggtattgaaatcaccaactataattatggattttttccttagagttctacatttaggattaattgatccctgtattattatgaaatggacttctttattcttggtaatattctttgttctttgttctaatatctactttgtatgatattactgtagcccctccaactttctttttattaatgttagtatgttgtttttttttttgtcatggtgtatttaatgttaacgtatttgtgccttcatttttaaggtgtgtttcttttcttttcttttctctttctttctttctttctttctttctttctttctttctttctttctttctttctttctttctttctttcttttttttttttttttgacaagatcttgctctgttgcccaggctgaagtgcagtagcacagtcacagctcactgtagccttaacctcttgggctcaaatgattctactacttcatcctcccaagtagctcagattacaggcacatgccactacgcctggctaatttttgtattttttgtagagatggggtttcaacatgttgctcaggctggtctcaaactcctggggtcaagtgatccacctgcctcagcctcccaaagtgttgggattacaggtgtgagctaccacacccagccaaggtgtggttcttataggcagcatatatttgggtctagctttttttttttttccatagacaggatctcactctgttacccaggctggagtgcagtggcgtgaccatagttcactgtaacctcggatacctggactcaagtgattctcccatctcagtctcccgactagctgagactacattcatataccaccatacctggctaatttttctactttttgtagagacagggtctcactatgttgctcaggctggtcttgaactatgggcctgaagtgatcctcccaaagtgctgggactacaggtgtgagccactgtgcccagccatgtctagcttttttaatccaatctgaaaatctctacaacttaattggggtgtttagaccatttacatttaatgtgattattgatacaggtaggtttgagctatcatcttgctatttgttttctattgtgtcatctgttcttcattttctttttccctgctttttccttttttggatcagttgaacatttttatgatttatattatctttgtttacttgtacatgattttgtttcatgtattttggtgctttgttattagggacgtacacattaaggattatattctattgaacaatcggctcctttatcatgaatcctttttatccctagttttattttttgataggaattctactccatctgattctaatataatcactctggctttcttttgattactattagcatggtataccttcattaaaagcagaaatattctcagggatagttactgtttcaaaaagtgaattttggctgggcatggtggctcacacctgtaatcccagcactttgggaggccaaggtgggtggatcacttgaggccagcagttcaagaccagcctggccaacatggtgaaaccccatctgtactaaaaatacaaaaattagccaggcgtggtggcgcgtgcttgtaatcccagctacttgggtggctgaggcacaagaattgcttgaacctgggaggcagaggttgcagtgagccgagatcacgccactgcactccagcctgggcgacagagcgacaccctgtctaaataaataaataaaaagtgaatttactgaattttgtttccttttttaaaaatcccgttcatctactttaaaaattaaaaatggatatttatttattaaatagaatagatcataaaatattcaattttttattatgttaagggcaaaggaaaaaaatgaagaaaataaagaacagggcacatagaaatactaggaatctggagaaagattttctggagaaagcctctttcttgtgaccttttggcatgttgctgttaaaggctcttcgagaggtactgacatttttggtaagtgtaggtatgaatggatatcacacttgtagttacttgggctctggtccaaatgaagttaagtctggagctgaatctagcccatgagctagtgattcctcatccctaacacagacatcactgatttctcttccagaattggcttggaaacgaaattgaggttatggtcagtactgaggaagccaaacgccatctgaatgacctccttgaagatagaaagatcctggctcaagatgtggctcaactcaaagaaaaaaaggaatctggggagaatccacctcctaaactccgggtaagtacgcttatgaaaaaatgttgccaataatcagactctacattccccagaaatcctcatagctttggaggattactttccttttagtatttcacccttgttctcactattatttacagaggcgtacattctcccttactgaagtgcgtggtcaagtttcggagtcagaagattctattacaaagcagattgaaagcctagagactgaaatggaattcaggtaacagggactatctctaagccattataaaaatttatgcctggaatcaaaaattgaacctattaatctagtgattcaaaagccttgtgatggtggaaaaacacgagaaaataacaattttttttaaaccagacactgtactaggtatcttagatacattttcttattcaatccctttgatgccttatgaggtaagtatcattcttctcatgttagagatctaaaattaacttggtcatatggaagtgggttatcagaacttattaacattagtgtcactgaagttggtatacaaccccctcgctgctaaatttgactggctttttaataaataactggttaattggttaatttttaaaaggaaattcagcaatcttaagaaatttgccaaaggtaattaactggctaacaaacaacagagctgggattcaaaacacactctaattccaaagcccatgctttttacaatacagcacaattttttctctttatttttttaactgataactagagagtcaggcaccataatttttgatgcagtagtgtctctaagatgtagaaccaataacagaattttagaggaaccaaagaaatgataatagaagagcaacaacacagaaggtgaactttagagatcatcaagaaaatagttctaacatggtaagtaaagttgtcatgagcattaaatgaaattagtaaagtgcataacagtacttagcatattagaagtgctcaatgggccaggcgcagtggctcatgcctgtaatcccagcattttgggaggctgaggtgggtggatcgcctgaggccaggagttcaagaccagcctggccaacatggtgaaaccctttctctactaaaaatacaaaagaaattaggtgggcatggtggcaggcacctgtaatcccagctactcgggaggctgaggcagaagaatcgcttcaacccgggaggcagaagttgcagtgagccgagattgcgccattgcactccagcctgggcgatagagcaagactccatctcaaaaaagtaaaaaaatggccaggcacggtagctctcgcctgtaatcccagcactttgggaggccaaggcaggcagatcacgaggtcaggagatcgagaccatcctggctaacacagtgaaaccccatctctactaaaaatacaaaaaattagccaggcgtggtggcacgcgcctgtagtcccagctactcgggaggctgaggcaggagaatcacttgaacccaggaggcggaggttgcagtgagccgagatcgtgccactgcactcctgggcgacagagtgagattctgtctcaaaaatgaaaggcagacagacagaaagaaaggaaaggaaaggaaaggaaggaaaaagaaagagaaaagaaagaaaagaaaaagaaggaatagaagtgctcagtgaaggccgcactttctcaggacctcttgagactgtgttccctgtgccgtggtcactcatattggctctaaaaagtaaaaagaaaaagaagtggtcaatgaatgttcttctgtccctcatctcctagctctagaccagaaattatgctacacaggctcttctaatcatgattattttaagcagtttatgaaatctagaaggaacagaaccttgacagagattttatcgtgttttaggataatagaaccttgggatcatttaatctggttttagcaatacatactaactttatcttgggatacatctataaatcactcaacctttgagttcctgctttgtgctacactggatgcagttgggatatacagaaaaaatagatgacattgcccttgctctcaggtggaaatagtatcattactcacactggtgtcctggaatcatttgctaaaatttcaagaatgttgtaaaccgttgttagtttacaattgattatggtgagaatttttacaccacagaaactgacaaaagttacaaatcagggctggggtttttgtttgtttgtttgtttttgttttatgtttgtttgttttgagacaaagtctcactcttgcccaggctggagtacaatggcgcgatcttggctcactgcagcctctgcctcctgggttcaagtgattctcatgtctcagcctcccaagtagctggaattacaggcacatggcaccatgcctggctaatttttgtatttttagtagagacagggtttcaccatgttggccagggtggtctcgaactcctggcctcaagcgatcggcctgccttggcctcccaaagttccaggattacaggtgtgagccattgtgcccagccaagggctggctttttaagtgctggttattaaaaatttacctacataccatatgcgtaagtaaatgattatgtaaatgtagggctggtgccaagtagaaggaattagaggtgagtttagttaggagaatttttttagaactgatgagacttaaactacattttggaatagataagggacacgaattgtcagagaagacaggaaagggccaatgataggtgacaactctgaagtgttgtgccccacctcttccagaagccttccctgactttttaatccctcactaatcttccttgttctctaaactctttcagaacttatgatactcaattatgacatactgctgacatgttatctttatgtttattgttttatgtttattaattttgtcattctaaagacagactgtaagcttgttgaaggaaaggactctacattagaccagggttttcaaagtgtgggccgcagattactggggagctcatgagccagtgatcaaaactattttcataataatattaaggcattatttgccttttttgctacattggaatttgcactgaaaatgcaaaagccatagtgggctaaagtgctgacaccctaggctgaatgaaagcagtggcaccaacctgaactagtagtcattgtatgcttcaccactatatactctcaggttttaaaaaaacaagccagtcttaattaagaatggtgttgcgaaagcagtaaaagttgttgattttactaaatctggaccctggagttcatgtctgtgttacatcctgtgtgacgaaacaggaagaacacagaaagcacttctactgcatgctgaatatgatggtcgtctcaagaaaagcactgcgattgtttgaggtgtgagctcaataggcctcttttttcatgggacatcatttttacttaaatgaacaactgacagacaaactgtggttattaagacttggttacttggcagacattttctcaaaaagaatagagcgagcctgttgctttaaggaaaacagctgacagtgtttgttacctaagacaaaatgtgagctttcaagcaaaatttggatttggaaaacttgtatctgccactgtgaacttgacagtttttcataacttttctgataagaccagtagtgatattaacaagtgtgattttaaaaatatatattttatagaatgaaatgtgttaacatttggaagatctgcatgactctggagtaatattgtccaaatggcactttatagaatgatgtattcgtaaatgagccattcagattgcaagatagactgatgaattttaatatgagagaatataaaaaagtttatggaaatcatcattctcagtaaactatcgcaaggacaaaaaaccaaacaccgcatgttctcactcataggtgggaactgaacaatgagaacacatggacagaggaagaggaacatcacactctggggactgttgtggggtggggggaggggggagggatagcattaggagatatacctaatgctaaatgatgagttactgggtgcagcacaccagcatggcacatgtatacatatgtaacctgcacattgtgcacatgtaccctaaaacttaaagtataataataataaaataaaaacaacaacaacaacaacaaagtttattaataagtttcagattcaacattgcaactaactcttttttttttttattatactttaagttttagggtacatgtgcacattgtgcaggttagttacatatgtatacatgtgccgtgctggtgcgctgcacccactaactcatcatctagcattaggtatatctcccaatgctatccctccccccttcccccaccccacaacagtccccagagtgtgatattccccttcctgtgtccatgtgatctcattgttcaattcccacctatgagtgagaatatgcggtgtttggtttttttgttcttgcgatagtttactgagaatgatgatttccaatttcatccatgtccctacaaaggatgtgaactcatcattttttatggctgcatagtattccatggtgtatatgtgccacattttcttaatccagtctatcattgttggacatttgggttgcaactaactcttaaggaggtaccgcttgttgagttttagtgtagtctcaaagaagactatttgcagttatctgaaaaggctattaaaatactccttttcccatctgcatattcatgtgaggccagattgtcttcatttacatcaactagaacaacatgtcacaaaagattgcatacagagggagacataagaatccagctgtcttcaactaagccagacattacagagatttgcaaaagtgtaaaataattccttttcttactatttattatctcagaaaatgctacttttcagaaaatatgtaatgtataataggtttatgttttttttttgtttttgtttttttgacagagtctcactctgtcacccaagctggagtgcaatgacgtgatctcggctcactgcaacctccacctcttgggttcaagcaattctcctgcctcagcctcccaagtagctgggattacaggcacctgccaccaggcccagctaattttttgtatttttagtagatacggggtttcaccatgttggccaggctggtctcgctcctgacctcaggtgatccacctgcctcagcctcccaaagtgctgggattacgggagtgagccaccgcgccccgccaataggtttatgatttttttttttttttttttgagatggagtcttgctctgtcgccaggctggagtgcagtggcacaatctcagctcgctgcaacctccgacttgctggttcaagcaattctcctgtctcagcctcccaagtagctggaattacaggcacacgccaccacccctaactaatttttgtatttttagtagagacagggtttcaccatgttggccaggatggtctcgatctcctgacctcataatttgcctgcctcggcctcccaaagtgctgggattgcaggcgtgaactacctcgcccagcctaggtttatgatttttaagtgaattaattttttttttttttgagatggagtattgctctgtctcccaggctggagtgcaatggcacgatctcggctcactgcaacccccacctcccgggttcaagtgattttcctgcctcagcctcccaagtagctgggattacaggcacccaccaccacgcctggctaatttttgtatttttagtagagccggggtttcaccaggttggccaggctggtctcgaactcctgacctcaggtgatccacccacctcggcctcccaaagtgctgggattacaggtgtgagccactgcgcccagctaaaatttttttcagttgtactttctaatactataaatctctataggtataacacatgtgaacagaatgtcctagatgtcttcaataatttttaagggtgtaaaggggtcctgaaaccccaaaatttgagaactacagtcttagattattttcatacccatcttccttatagtaccaaacttatcactgcatatgaagcacatgctggtatactctttctcactagacacagaagaaatttgagaagaaagctattaattaaactgaaatactgtgtagattttggtctaggacatacttgatcagaaagtacccagaagctataaccagggtcagaatatctagtcttcttagaaacttctcggtcttgtggcaggcacatcaagataacctctcacaatgccagccatgggtatcattttggtacttgattgtagtaaagagcatatctacctgttcttttgagctttttccttcaagtctccaacctgaatcttatccttgcatgggtggaccatcatgtcacagtctgagcttatatggcctcaagacaaagtaacatattatacttaatccactacaacaaaagccttactgtgataagtctttccaagtcccactttatgacccatttatttcaaccagtatttaatggaataaaaccatttaaatagtctcttagagtccctttgttacaagatttgcgatactatgtaaaatcctaaccagatgacttaaacattatttaaatgatatttaactgatagctccatccataaaattatttgaagtttctcctcagagctcttcccccttcttgatgttcaggctacttgcaataaggcttactgtttctttccctgaaggagtgctcagattgctgacctacagcagaagctgctggatgcagaaagtgaagacagaccaaaacaacgctgggagaatattgccaccattctggaagccaagtgtgccctgaaatatttgattggagaggtaaacatcactctaaccagcagttaggaggctggctgtgtaggttgaaatgggatgttagccttgaaatattgtcaaagtgttattgccacttttcatggtagaaaccctaataacactaacattagagagtttagtagataaaggttggtgtaagcaagtacaggccagtcacttacaaaaatataatatgactcacaaattgatgcccgttgtgactggcctatagcaagtgctgaatgcgtgttagctgttgttattaggaaagaccagaatgccatagtgggtcactggctaaacatcaactgttatactgtactactttttaaaacccctatgagatgtatattcaaaaatttaagatccagtctagaaaagggaaaacctaagcatcttttgacatataaagattcattttagggaaaagccatctttgctgaccttaaaatgatatgtcaccttacgttgtcacaagaggaatgaaaattgattgcctctggtgattgaagcattttcactcaagataagcatacaaactccaaacccacaagtttaaacaatgctaccctttatacatttttgtgttagcttagcagatttgttctactaaggaaatcttgatcagtcttgtgaacactggtacttatgatgttcaccatctgggctagtagtgaatgtaaaactaggccagtgtaggatatgtagcctgaagagccagatctgcagtctcagtctacaagttctaacatgtgaatatagacattctgaaatgggacataattggccataagggtgtgtcctgtggattttgcttaaaaattaaggaagaacttcttaaatatcagaatttgtaattgtcagatactattcgggttagctttattcttgccttgaggcagagcaagaaataaaatggccttagcagtggcttctagccccaagatacatgtctcagcagaaatgtggactcttggcctgggaatagaacaatagtatatttactattcaatgttggaatccatatgacatgaaaaaataagaatagacttgaacatggaggaatttttctcagaccctttcaagaaagctgacattatcctgcctgttgaaagggggaaagaaaggtggtcattcttcaaataaactgatcttcttttattccttccagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtaaactctagcaagtcaagaagctatactgtgaaactatcattgccttgtattgttagttttaaaaaaaaagtggggatatgaaatttctttcaaaagtccacgtggccttttctaaattttgcaaataaaaagaaacctgaagcagagacgtgacttgtctaactttatacataccagtgacaatggctctgggtttccaacttaaatatgaatattaacaatattaacatgctgagaaacaggcccagcgtggtggctcgtgcctgtaatcccagcactttgggaggccaaggcaggcagattgcttgagtccaggagagtgaaaccccatctctacaaaaaattacaggaaattagctgagtgtgatggtgtgcacctgtgatcccagccactcataaggctgaagtgggagaatcgcttgaacccgtgaggcagaggttgctgtgagccatgatcgtgccattgcactgcagcctgggcaacagaaagaaaaaaaaaaactatgctgagaaacatccatgctgtacttactacttcatgccatgacagcaaatgagaacagtttacttctaaatcacaagagagcagtcacctggatcactgcttgaactaagtcaaaatttctttttccccttggtacctttgttaccacccattggatcgtgtctttctctaggtgctgtaccttctcagccagctgcagcaaagccaaatggcagagaagcagttagaggaatcagtcagtgaaaaggaacagcagctgctgagcacactgaagtgtcaggtatgatcacgagaggtctccagagatgagtttcacagtactaactgagaatcttgtctcatttagacccttgtacttgcagcagagagtaattaactactggaaaaagtatttataatggtagcctctactgcttttaggccctatttgatcaggttaggggtgcttagagtgtagccatatataggaataacctcattttgggtaccaaaatggcagcacatactccatatcagactctgaggccttgtggttcttggcgtcaaccctgagctctaaagagttgaggaagtgaaatcatccagtagttacttagaatcctagggccattcaaatggtatgaagagcttgttcttctgtgctgagacctgacatatttgtaaaatgcctggggtctgaatttcttccagaggctaggaacaccacaccctttagtggcatgttgtagcactattttagtctaacttagaatctttttcctgaaccaccagtctgtagggtttccttggcaccttccatctaagacataagcaaactagttaaggttgtatgcatgaatctgggtgtcttaggtgccaggtagttcggtcaggcttactaaagtagcaagtaaactgcctagtctatgttgagaagggtaaagagaagcatctatagacttcaagaaaatagagctaagtttctgcgggtttcttaatcagcatccgaatgtgaataagggatatgaagctaaggaatggaaaagaataaggaaggcttgtcgggcagagtccacggttcctatgaatgtggtcagagctgctggggagcattggaatggaagtggcattcagggcacctaggaactgggaatcagacatttttctgggtgccagtgcctgctgtgcaaaaaccatctgctgccagcaacttggcagcagtatgttttcatctatgtgagttgtttggtaacccacatgtagtgcccaaaataaccccatatatcactgcactatctggaaataggatgaagaacttgagaaaatgcgagaagtgtgtgagcaaaatcagcagcttctccgagagaatgaaatcatcaagcaggtaatacagtttcccacccacttgataagccctaagagaccccgttgctactgaggccagctcttgggaccaacccccattgtggtgacttggctttatttcatgaggtctacatttagtttccatgtgacatatgcatttcaaagtggaataaacataagtttttaaatttgccattttctgaatctaatattgttgatattggaaagtgggagtcaacgtactctactataatcctgcatcactttactatggtttaacgttaagctagcctaggtctggtatctgttttagccatgaacactcccagaagctgccctgcattatatactttgtctcttcttttcaaatagaaactgaccctcctccaggtagccagcagacagaaacatcttcctaaggatacccttctatctccagactcttcttttgaatatgtcccacctaaggtaaaatgatcagtgcctgtgatacctttgcacagcttaggtttggggtgagtgtgctaaaattgccctttataagaggttgacagttaaaattcccaaattctagcatctcacttttctttggagtcccagataaaactacagttcaatcctaaggaaagtaggcattcttactcctcagaaggctgactttgggccatggacaggcattacctaacacaactgaggaggagggacaggagaaaagagcaataatgttcagctgtccatccaaagatacttatctcatcatatcatgagtttccctttcctccctcagattggtcagcctccaatttcactgccttcaaagactctgcaaagccataggctaaagcagaatttcttctgattggtaaagccaagtggggtggatttgagagagtctgaaatctttgctctgagaatatagctggcaacagctactgggaagatatgatgcatatatagtttttagtttttattaaataactaaactactccaaaccttttttcctagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccaggaagaacatccaaggggtaggagccagctcttcaactttttttttgttttgttgttgttgtttttggagacagagtctcactctgtcgcccaggctggagtacagtggtgcattctcggctcactgcaacctctgcctcccaagttcaagtaattctcgtgtctcagcctcctgagtacctgggatcacaggcgtgtgccaccacacccagttaattttgtatttttagtacagacagggtttcaccatgttgaccaggccagtctcaaactcctggcctcaagcaatctgcctgcctcagtctcccaaaatgctaggattacaggtgtgagccaccgtgcccggcctagctcttcaactttgtcaggggttctaattcttagtattcattcactgccactgggatagttttctgaatctaggaatgtgttggccccataccctttagctatcatttagaggcactgactccactaaaggggggcttgttgggccatctttgtgtagaacctggggctagtatagagggctgcttgagtgcacaagttggctctcttcttgttttcaggttcttatcaatttgaataggtaatgttccataccatttcattgaagctgatcccaaaatgatcataacaattcttcatgtttttatagcactttacagtttataaaccattctcatatatattaccacttttaatcaccacaaaaaatccagtgaagggccaggcgcagtggctcacgcctgtaatccctgcactttgggaggccaaggcgggcagatcacctgaggtcgggagttcgagaccagcctgactaacaggaagaaacctcgtctctactaaaaatacaaaattagctgggcctgatggcgcatgcctgtagtcccagctactcaggaggctgagacaggagaatcgcttgaacctgggagggtggaggttgcagtgagccgagatcatgccgttgcactccagcctgggcaacaagagtgagattccatctcaaaaaaaaaaaaaaatccagtgagatatttactatttgcattttccagatggacccccgacccacaggagggaaatgaccttgcccaaggtcgtaaaactaagtgatagtcaggacttgaaaccaaatattctgactccaagtccagtttgtttcccccacatcatggttatgtcagtaaaaaccatagaccagaagttgagtgggtactttatctttgcctaacagagtaattttactctctaggctaaggaacaaaaagaattacagaaaaagctaataattaagatcaaacacactaagttaaggctacttaggaacaatccgacttaggcatgctttattttcttatacaatgatagtcctactcaaacctagatgttttatgttgaaacattaacttcccaggcattacagttcagcaccactacccccaactgtgccctgcagccacattccacttaaagagaacagttcacaagttatcttagctggcttcctacattatttgatttgattagcctatagctcatcacctggggaactaagccttataaacccacaccaccaggatgaagcaagtcataagatatagacagccatggtggtaagtcatttggtcagtcagaatcatcaagaatgcaacatatcatgtgctcatagtgaaactaagagctcatccttagcttcagagagtttataatctaatgggaaaacaaggtaaaggaatagaagcctaccatagaacctcagcatattcgtctcagggagatggaccggggagtttttggtttgtttgttgtgttttttcttttgagacagagtttcactcttgttgcccaggctggagtgcaatggcacgatcttggctcaccacaacctcctcctcccgggttcaagcgattctccagcctcagcctcctgagtggctgggattacaggtgcccgccaccatgcccagctaattttgtatttttagtagagatggggtttctccatgttggtcaggctggtctcgaactcctgacctcaggtgatctgcccacctcgacctcccaaagtgctgggattacaagcatgagccaccgtgcaagtttttaagagtgactataaagccaaaccaaggaggtgtaatttaagaaaatgccatgaaagaggtgactattgctgcgttgtaagacagaaagggaaatacagtcttgggagcaactgggagacatttctggcacaatgaatagcatattcctaagacttgaagatggtagtggaacagagagttgggacacttagagaaaatggggcagagcgtgtctctttctttcatttactcaacaaacatttatggacgttttactatagttgaagtagagagcatgagctgaatgtagattaaaaggtcagctaagtaataggaggcagagttgagaagtacacacagaaaaatggtagaggccaggcgtggctcatgcctgtaatcccagcacttcgggaggccaaggcaggcggatcacctgaggtcaggagtttgagaccagcctggccaacatggcgaaaccccatctctactaaaaatacaaaaatcagccaggcatggtgacgcatgcctgtaatcgcagctacttgggaggctgaggcaggagaatcgcttgaacccaggaggtggagatggcagtaagctgagatcacaccactgtactctagcctgggatacagagcaagactgtctcaaaaaaaaaaaaaaaaagaaaagaaaaaaaatggtagagggcctaaagccctggaaaggaatttccaaatatgaggtgaatacaggtatacttgtcctcaaggaaagcttcatatatttattagagcactgttgctctaagcttaaaagggcaacatagaagtatagcaaatattgcagtaaataatatttactattagtgataaatcctacgtctaaaacaatgaggaattactgttttctaggcttttcccctgattttataatttggaaagtgaatataactgggctttaaagggaacaagttagcataaaatctggtttctctaaagttaccttttggcagtctgaaagtacatggatactatgactgctctttgatcagactgcttgcagacatattacctgtagaacttgatgcttcacagaggacctttattattactgcttcaacccagctgaagctggctgggactatcactagattactgaaaaggagactgaagcaggcaccaaaatgatgacttgtccagagttaatggcttcctcactcagccacatttcctatatgtactaaggagatgctggggggtaagtcatgtgctatcatagaaaaagtagtaacctagaagccagatagacatgggtcttgagtttgccacgggttcattgagtaaccttgagcaagtcagtctccctgggcctcagattccttacctatgcaatgcagggtctagaacagcggtccccaatctttttggtaccagggaccggtttcgtggaagacagtttttccacggactggttgtgggggtggtttggggatgaaactgttccatctcagatatcaggcattagttagagtctcataaggagtgcgcaacatgtgcagttcacaacaggattcttactcctatgagattctaatgctgccactgatctgacaggaggcagaacccaggctgtaatgcttgctcgcctgcagctcacctcctgctgtgtggctcagttcctaacaggccactgaccagtactggtccccagcctaggggttgtggaccccctggtctagaacagattatgtataaggttccttctaggactaatatcctgagtcaaagtaacagtcaaagttgtgtaaatgggttttaataacaatgcttttatatggtgttatatggtatctgaaaagttaggaggaatatatgcaaaagcaccttgtgaaggatacagtatcatgcagatattgttgttaaagcactgtaagcattttacaaatattctcatttgtcacatttggcagaaaagaggaagcaggtatttttgcctctaccttactgatgaaggaatagcctgggcacggtggctcatacctgtaatcccaatacttggggaagccaaggtgggaggatcacttgagcccagagttcaaggctgcagtgaactatgattgtgccactgcactccagcctcagtgaccgagcaagaccccatctctaaatttaaaaattaaaaaaaaaaaaagaatggagattaacttggatgaagtgacttgtccaaggtcatgccaagcattaaatataggactagagcctgagtctcctaattcctagtctggtattctttgttttttgtttttgccacagcatcacttaccaatcctggtattttttttttttggaccagatctcatccttctgaagtatgaggtacagtgtaacactgagcttggtgctagaggaattatggactctaaagcagtagttctcaagtctagccacacattggaacacccaagggagcttttaaacatggagcctaggactccacccccagatattctgatgtaattagtctgaggtaggacatggactttttgaaaagctccccagagatttcttatgtgcagccagagttgagaacaactggcttaggggaaacccagactctgctttccactctctacaaagaatcccttggccgggtgtggttgctcatgcctatcatcccagcactttgagaggccgaggtgggaggattgcttgacgccaggagttcaagaccagccttggcaacatagcaagatcccatctctacaaaagaaaaagaaaaaaaaaaagagtccccctattacttctcaactacggtgctgggacatgctggtgggttgccagcagttgtgatacacacacacacacacacacacaccaccctgtatacatgtattaaatacatttgtagttatgcctgtgatagggacacattctgtctttgacattctaatctgcttcttggtgtgagagagaataggatgaagttacagctcatgtacctggcattcacgcaactacatctgtcatgtatgtcatgactgtgctataataccactaccaggtatttatctaacctcttcttgcttgaagacttctagtagggggaagctcacagtcttataggacaacccattggattccactaattgttagaaagttacttcttgtttagctgaaatgtgctgtcctatacatcatcccagtaggtcttggctgtgtaagagcctaatcattctttatgacagcccttcagatactgctttcatgatattatccctaggataaaatagagaaacatggatgaggtaacagcatttttgaagcatttagatgaatttgtaaatggccaaaggaccatacccaggctgtagcaatcaatggatcactgtcatcctggtgaagtatcaccaggacatgtcatagaactccatctttcatcctgtcttaaagcagcaaagattttttgttatgataatgtctagcgttggcaagggtgactaagaagggcacttctggccgggcgccatggctcacacctgtaatcccgacactttgggaggctgaagtgggcagattacttgagcctagtagtttgagaccagcctgggcaacgtggtgaaaccctgtctctactagaaatacaaaagattagcctggcatggtgacacacacctgtagtcccagctactcagtgggggctgaggccacaggatcacttgagccctggaggttgaggctgcagtgagctctgatcatgccactgcactccagcctgggtgacagagtgagaccctgtcttaaaaaaaaaaaaagaagggcatttctgtattgctattaggaatataaattggtatacctttcaggaaggcaacttgaaaatacgtatcagtagcctttaaaatgtttctatcctttgacccagtaattttacacatacaaatttatactgaggaagtagacattggtatgtaaatgtatttattcgtttgacaaatttttttctgagcacctatgtgccaggcactgtttctagatgctgagaagacatgaaacaaggcaggtgagattctttaccctcatgaaactggtattcttgtggggagagacacatggtaaccagaaaaataaaataattttagatagtgatgagtgaaaaagaaaagaaaatatagtgaagtcatagagaatgtgggatgggaaaagagcactttagaagagtgcttggggccaggcgcagtggctcacgcctataatcccagcactttgggaggccgaggtgggcggatcacttgatgtcaggagttcaaaaccagcctggccaacacagcaaaaccccatctctactaaaaatataaaaattagccgggcgtgatggcgcacgcctgtaatcccaaccactcaggaggctgaggcacaagaattgcttaaacctggcagaggttgcagtgagctgagatctcgccactgcactccagcctgggagacagagcaagactccatctcaaaaaaaaaaaaaaaagagtgcttgggtaggccgggcacggtggctcatgcctgtaatcccaacactttgggaggctgaggtgggaggactgcttgaggtcaggagttaaagaccaggctgggcaacgtagcgagaccccatctcactaaaaacaaattttttttaaagaagagtgcttgtggagctctctctgagaaggaaatatctaagctgaggcctaaacagtgaagagcaagtcaggaaaagcatcagaagaacatttcaggaaaagggaacagaaaatgtaagacctcagggcaggaatgagcttagtatctcaaggaacagctaaaaaggccagtgtgactagaatgtatcaagcataagctacagtcaggggatgggtagtcaagggccagatcatggagggccttgtcagtcgtggtacagtttagattatatttctatacaaggatatctactgcaacatgatttataatagtgaacaatttctttcaaaacaatcttaatatttaacattaggggactggttaaataaatcgacattatccccatgaggaaatatatacaactattaaagtcaagttttttgattttcaaattttgtaaagtgatatatattattctgctaatcagaaaaaaaatgttattgtggtttctacagagcaactacagagcaaaggtgatggttctcatatgaaaaaaacttaaaggcttgaatttgactataagctcagtatgaatccacaaagatgtgacaggaaaaaaaaagcaactgattttaggcctcatgaacaggactactgggtccataacaagggaggtgtttatcacagtccacctcacagtggccacaccacatttagaaagttgtgctcatttctagatctcacaattgaagaactttgacaaattggtgtatagtcaaggtggtgaggatacatgagaaccatgtcatgtggcaaatcattgagggaactaggtacatttaactttgagaggatttggacagaaggggactggggagtaaaaattacgttcagggtttgaacagttattctataaaagtggggttaaactgattccatgtcattttagatggcagaattgggtcctatgattagaagttatatagaaactattatcacctcaggataaatagagcttcagataattagaccagggatgttaagaggggcttcatacatcaaaccagtctttaggtggtcgctgaggtctcttctcactctgttccttcatcctgtgagctcagccacctctgtcttttcaaagccaaactatcccactttcttctacgatttttcttatagcattgcttcctataattctgatcactcacctcttttttgtttaacatcctctttataaaacatacacactgacttcctgaatgtgtatacaagaaaacatgcttattgattaaactggtttaataaatggaaagcccttatagcagtgcctggcacacattaatgttagctatcactactgcagccttgtttataagaatggaaaatggcactatcaggagaatgggtaaattgtggcaacttcatagagtgaaaatgaatggaattgaagctatatgtatcaacatatgtcatttatacaaagtttagaaacgtgtaagacaatttcttgtttgtttttgtttttttacaaaaactcttatgtgtggctaggtgctgttgctcacgcctgtaatctcagcactttgggaggctgaggcaagaggattgcttgaggccaggagttcaagaccagcctgggcaacatggcgagaccctgtctctacaaaaccaaaaaattagccaggcatggtggcatgtgcttgtggtctcagatacgctggaggctgaggcaggaggatcactaagtcaaagaggttgaggctgcagtgagctatgattgtgccactgcactccagcctgggtgacagagcaagaccctgtctccaaaaaaaaaaaaaaaactaatgtggtaagagacatacataggaatgataaacacctaattcaggagactgtttatccctggaaagggggaggcaaataggatcaggaaggagtgcataggagaccttggttatatctgcattttactattaaggggggttagtgggggcatgagtgaggttttttattgctattgtctatgcttttgtacacatgaacaaaattatggtgccctaaaataggatgcattatttctttttttttttttttttttttttgagacggagtttcactcttgtcgcccaggctggagtgcaatggcatgatcttggctcactgcaacctccgcctcccgggttcaagcgattctcctgcctcagcctcctgagtagctgggattacaggcatgcgctatgatgcctggctaattttgtatttttagtggagacggggtttcaccatgttggtcaggctggtcttgaacttctgacctcagatgatctgcccgcctcggcctcccaaagtgttgggattacaggcgtgagccactgcgcccagccaggatgcattatttcaaatgggatccagttgagccagggtacaatgaaataattactccccatcttttctgaactccaaatttctacctgactgcatttgctttgggacagccatttcaagctgttgactcacagagcttgcttacacctcaaatccctaggcccttttctgcacagtctttttttttttttttttttttttttgagacgaggtctcactctgtcacccaggctggagtgcagtggcgcgatctcagctcactgcagcttccacctcccaggctcaagtgatcctcccacctcagcctcctgaggttgacaccacgtccagctaattttttgtatttttggtggagacagggtttcagcatgttgcccaggctagtctcaaactcctgagctcaagcgatccacccgccttgacctcccaaagtgctgggattactggcatgagccaccgcacggtctacttttaagctagatcactccccatgttgtatttatatggctgagttgaggggaacctaaataccaaacttacaaacttactttctacttttaccccttaagtccagcctgtcaaaatatttttgaattgtgattcttttatcttacatattactaatccttccagctttctgtcattgttagagctgataaatatgcctaccttgtagacaagttatgagattcaaatgagattttgtatttatgtacatgaaagtactctgaaaactgtaaagtgctatcaaatgtaaatgattttatttcatatcatcagtgatttatcaaaatgtgttaaggacaaagcccaggctaacactggacaaaatgcagaaatgtgagctggatgaaagtacagcttggtaattctaaaaatactgagcaactacacttagtttttaaatgtacttaactatactaccatccagctcacagtgcttcactttacccataaagttgtcataagagtctttgtcggttgccttgcattattatgctatccctctgatctgtccttcaagtattctgtccaaaagaaaatggatttttcagccaggcgcggtggctcacgcctgtaatcccagcactttgggaggccaaggtgggctgatcacctgaggtcaggagttcgagaccagcctgggcaacatggtgaaacccccgtctctactaaaaatacaaaaattagccaggtggccaggcacggtggctcacacctgtaatcccagcactttgataggccgaggcaggtggatcgcctgaggtcgggagttcaagaccagcctggccagcatggtgaaaccctgtctctactgaaaatacaaaaagtagccgggcatggtggcaggcacctgtaatcccagctactcaggaggctgaggcaggagaatcacttgaacctgggaggcggaggttgcagtgagcggagatcgtgccactgcactccagcctgggtgacataataagactccatctcaaagaaaaaaagaaaagaaaaggaaatggatttgtctggcaagacttgttctctttaaacctatgacggttcttggtgattattgttttcaccaaagaagagaggactaaggagattgaagcttggtagataatagtactttccatttttttctagaaaagcttgcaaatgaagggaagtcattttaaactagtcttctaaccctttcagtaatgtgtctttctgcaaacctgttttgcagtgttcctgcaagggctggtgtggaaacaagcagtgtgggtgcaggaagcaaaagtcagactgtggtgtggactgttgctgtgaccccacaaagtgtcggaaccgccagcaaggcaaggtaggatcagggctgtttcctctccccttcccttcagaccttcctctagtttccaccctctttttctgccttccatcctgaaacctggagtctcctgcacagctcttccaacccttctccttccctctgcacccagaaaaagagacagttcacttctcaatcctttttccttgctgcttgcctgttcacatacccctttcagaaaccacagcacttcccaggagattcccaggtatagagctccccacccccaggcttggctgtaaagtttctgtactgtttttgagatgacaaagacaagaaagcaggcattcacaggcatatagacatgcaggatcaaattagtccagaggtttaactggaactgtaagagccacgtactgaggtagcagcttccaggaagttaatccttttgacatctcgagacattcgttacctagactctctccatggcaaccagctagctattccatggctctagaaaaagacccacaggaaccaggcctttctaatagtcactgttgtaaaccaagttaacctaaatgtcctcttaatattgctcccaggaatagcaaactcaggaaaaccaaatgttccctgggaagagcagcaccaagcaggtcagatccctatacctgccttacacctacctgtgcaatagcaaaaatgcattactacagctctatatgtgatatacagtaattctagcaagcacaatctaatgatgattcatcatgcatttcttgaacatccacatgtgaagagtttcaacctgcatcttctattaaaaagacctctggccgggcacggtggctcacgcctgtaatcctagcactttgggaggccgaggcgggcggatcacgaggtcaggagatcaagaccatcccggctaacacggtgaaaccccgtctctactaaaaatacaaaaaaattagccaggcgtggtagtgggtgcctatagtcccagctactcaggaggctgaggcaggagaatggcgtgaacccgggaggcggagcttgcagtgagctgagatcgtgccactgcactccagcctcagcgacagagcgagactccatctcaaaaaaaaaaaaaaaagacttctaacatagataggcaagctagaagtcaggctaagaactgtagaagtagcagagaccttaaggatcctctattcctgtggtttttcagtttgcgttcaagagtcatgtagtagctccatgaaagggcctccaggcagaggggcatggccccttcctccctcctcccatctctatctgtctctctctcggactcagttttcttaactgaaaggaacacccagtatggatgctaaaagagatattgcaaattgtagagagggggagtttagtcaaacaaatgaccgaggcttgtctttgctttaaacctggccttgtgagatgtcccatgcaactacctagtctttgccttcagaggccacctacaggcattgctccattccttcagggacagagcgtgtcaaacactatgacctccccaagcagggcctccctaagacttgcttcagctgactaatcaggcacttagagctgttacctctttggttgaatgggagcagactgattttgtaaacctggcagccaaatttataatatgcctgtctgcttgattttcaggatagcttgggcactgttgaacggacccaggattccgaaggctccttcaaactggaggatcctaccgaggtgaccccaggattgagcttctttaatcccgtctgtgccacccccaatagcaaggtaggtgggctaaaaggcaggcattggaaaactggattagcgtccttctctgcattatctatgagagaccagtaggagagaggcaggtggagtaaaggtgtaatcagcttgctgggaactagggatcgggcatagactctagtctggttttttccatagaatgatcttaaagaacacttcatactactgggagtatgtcgagcatctatagcagctcggctgggctgagcttctgcccctttctaaagtctattcatacctgtctctgtccctcctagatcctgaaagagatgtgcgatgtggagcaggtgctgtcaaagaagactcccccagctccctccccttttgacctcccagagttgaaacatgtagcaacagaataccaagaaaacaaggctccagggaagaaaaagaaacgggctctggccagcaacaccagcttcttctctggctgctcccctatcgaagaagaggcccactgaagttggagtcatcatctctacccccagtctggcttgggagatgctttcaggttgcagccagaaggggttttttaaatgacttctctggatttcaggtttcttgctgttgaaaaaaggaacaaagcgttactgaaaagaaggtaacctttgttggatgtgggccttagcctccaggtccagactactactctatgttctccagaagggtgctaagtcacctactgaagagagaaccaactgactttcctattgactcatcaggaaccagtcctcagtctggtcaagttgtttcttatttgtgagcagttcaggctatctcctgatggggatgaggccaaggctttcttatcttttggttgtctctgcttaatggaggagcctggcctaggatggaggcctggcttagatctttcattccacctcaggaatgaggttgtgatctttcctgtcctgaccctctctgaattatgtttcaatagtactcttgattgtctgccatgttgttgaagcaaatgaattatttttaaatgttaagtaagtaaataaaccttagcccgtctactgttt

SEQ ID NO: 411 - DNA, 30466 bp, Homo sapiens
attttgggaggccgaggcgggcggatcacgaggtcaagagaccgagaccatcctggctaacatggtgaaaccccgtctctactaaaaatacaaaaaattagccgggcatggtggcgggcgtctgtagtcccagctactcgggaggctgaggcaggagaatggcgggaacccgggaggcggagcttgtagtgagccaagatagcgccactgcactccagcctggaccacagagcgagactccgtctcaagaagaagaagaaggagaagaaggagaaggagaagggaaaaaagaatcctcatcattaatgcaagtggaaggaaactcttcaccaaagaattgatcacatcatgaaaggtgaaatcattacggaattgcttaaatatataatttgaatctggatttaaaaataataaatgtaagttttttctttaaaaaaaaaaaaaagtccattggttaaattcagcttgaatcctttgccactacatcaagagctaacaggtcaacaactgatctccacaacctcccacctcatttcctttctcagtccaggtagcaggaaaatggaaaaaaaaaaatgattttttttttccaaacactttgtcagtttccccagcggtcacctttgaaaagggaaaaatgtctgaaaatagacaaagctgaatataaacatcatttaattccccccacacagacagcctccgctcctgtgagggcgtggggaaaacggagtgggagaagggggctagcgaggaggaagaggcgggaggtgcggcaggggcacaggtgacgctcctcccgcctgcctagcagagctccaggcgcacatccgcagtcagccacctcgcgcgcgcctccaggagcaaggatggagaggctggtgagcggggccggggcttgggaaggagggcgcagggcaggcgatgttgagccggtggccctggggcgggcggcgagtggaaggcgcggagcttcggctcttgccacaatctggtccggggactagatcagcggtgttgatggcagcgcttttctctaagcgctttctcttgctgagaaacggattttgccttccaaagggtggtttacaggcagctgctggcgtccagattctccattccaattgcctgaaaaaaagatgcaccaggccggggctccgggggctcttgatccgcgctgacgaagctggcgcatcctccgggcaggctcggctcggctcactggctccagctcccaaaactggggaggcacagcctattttaaactgcccccaaaagggaaagagaaatgctgtattggttccatattggcaccaaaagctgcggcggagatacagatttccaggctcgctttctccgggagagctcctgcgtctcctctttgttatgcagcccctttctccctcctagcccttgcctgggggaagccatgaaggatcagttaaagctgaagctacacttgagagagctgaaatgctctgtgatcataatgctttgaagggttaaccccgggtatctagagaaacagacattttgtttattcggaaccagcttacaagacaaaaaacggagaaggttttcatatatcccattggtatatgaaatccaaatacaatggtattggtataagaatccaaatacagtgaatgcctcaagataattttttcatgtatggtttgttggcaagaccacatagccaatgatttcactgtctttcttaacaaaggagaatggtggtctgtgagctacggtctactgcaagctagatgctgttaatcttctttgtaactatccttctaaaaatgaattattacctcgttttacacataaacaggcggaaaggctgatatttccaagtccttgtgactacatgtggggtaatgtggatttggacatagaaacttgctgaggaagaggcatgaataggggcaatatagctaccaggtgggcagctgtctggtaagacccaggtttttgtgaaccctggactgcatggcaagggttataagtgggcttctttgttttcaggactgtagttccccctatatgatttgatcgattaatttttttagctacctaacacgtattggcatttactataacctaggctctatactaagtgctttaattgcctaattctcataataactatgtgagataagagcaacatttatttagtgcttatttctactggcagtattctaggagctttatatactacttcatttagtctttttaaccattagattggtactattacttttccggagtctcagagaggtaaaatgatttcttttgctcacaaatctagtatttgttttagccccggtcacctccctgtaaacatataaatactgttgttttcagattggtcgtattttcagttattctgcacagactcgaggaaaaaaaaaacctgtaaaataaaaatacgtatctatttaagagtaaggctttccttctgatttcctttgcctcaatcactgtgttttgtttcttaacattgctggctcccagtccacaatatatggtttggtatgtatctgctttctctcttgtcctaaaacacagattttctctatgagagcttgtccattctgcattcttcatcatggcctctggtagagcctggatttccacgtcagagaagcctaatggtttaaaaaatatcacatagaattggaatgccagtatctgtctccacaattgccttagctgaaaataaaacaaaatgtgttgggtgggcactggcaatggagcctgaggaaatatttggcctgattttttctgactttcctagataattagataggatggaacagtctcagtaatactgagaaaattatcgagttatatattttttttcacttcaaaaccaaagcctttgtgagtataatacccagcagtggatgggcagggtgagcagatctttgtaggctgtatgtattcaggcagctgaaccatcttgggtttctcaaagagcagtgactatgttattagtcttagacctatgaagacaggaagagaagtcacaaggaagggatagcatgcttatggtatgcttgggtatcgaataataaaatatatctgcaaagaataatttgtcctaatggcaccttcagatgatataatcttgaattctctgtagccttagagatgtaaggaaaaagcaacttacatcacaaagatcagtattactgtgtactatgatgccactgcatggggtccaggatgagagtctaagtgattggttctctctagctgaagacaagaagacactcaggtatgtggcagcacttgggataggccacagggcggcgagacatcattccttccaggacatctatcctgaaagatccatcaggaatactgtgatggagatagtgatggagactccttgtctctggcagttagagtgaatgctgaagaagagcccttttccagcaggccagtctctaacatgatcttgggtcttcacccagaccatgacagctctggtgctcaacacacacaaccacctccagggtacaagttggccccaagagagctgagacaatattggctctaatttttatcatctcattgatctcaaaccacagactctgaccaggacaattgggggccctctccttacagctacactcctaggaaagaccaccatcaatgattaccaggtaattttctacccctacctatgaagggacttggttagtaacttctcttgctagaggaaaaatgaagcttattatataagattaatgtttgtgaaacacctgttatttggaattggtttggtacttcctcttgaaatttccctcattaagtttaggtcgtggctgtttcataaggaaagaaaagggcatgtattgactggaattaaaattaacaaatccattgagtaggaggatattaaaattgagtggctcccattggacaggaaaaggaagagaaatccttgtggcaggtaaaggaggagagatttagatccttgagaactccattcccgacccgctgctcctgagcccacaggaagaaggccatcacaagacaataaaaatcccagagaaattgaaaggcaaacagaaagacccagcttggagtgataaggaaaatgaattccagcagggaagtcattgtatctaaaaggaatggcaaaaatagggcttagttaaggcaaacaccgagaatgaggggatgggattcccacaggtagaacaccaccctttagcaatgatcctgaccctaaagcaaggtcatttaagtgattatgggccaatattctagaaataagcttcaaattatagtagcaacagatggggctaaacaggagccgataagaacatacaaacaacttcagaaagggatgcccgtgatgggttcattaaggaaaaagtggtcaggacatcccgctaaagcaacaggattcagtggatattgaggttcttggggggcaatgagacaggcaccaagagaccactactttatggaagactatgatcatactgctaaataccataaaagaatagacagagccaaataagagactgtttctaatgaaacaagcagacaatgtcccaacctcaggaatttaactcagtctgaaaaagaagagtagtttcaaaactgtcaagcctgctttagtgctataatttttttcactgacaagagagaatgaaagactgatagctgggggagtggcggggggtgaggggtgttgacaggtagtaagcatgctggaaacagtgtctcaaggtgtggggtatatggtgggtatatttgggaagtagtcattttctctcaaactggaaagcagatgggtgtgttcagacaagatctggaagctgtggcatggcagacaaagggagatgggacccctttggcactggaggaagaggcttgaatcttcttggagcactaaaagttccaaaagacctaagcagaaaatgcttccgaagaggaggatctgtatggcaagatgactgtaatcaggctcataaaagtaagaccttacataaatacaagtgagggggaagacatttcatgtaggaggaatggctcaagcaaaaataccaaggcgggaaattgcgtggtgcgtttagaagtagaaaaggctagctggcagggaggggatacataggaaggcaatggaaatgaatttgcaagaatgaaaacaggctaagaactttgaacaattttctctagatagttaggggctatagaagaagatggcatcttgtacaaagaggaatttaaggaaaattaatctgtcaatagtgtgtaaatacataagctggatagtaaacttaactaagttagggactatatctgccttatgcaccattgtctccaaagtacctaccatagtgcctggcatgaagtcagactcaatagagatgattaataatagaataaatgaaagaagtatagttgtcccttgggacccatgggggctttgttccaagaccctcacagataccagttggtggatggtgcaagtcccttatatgaaatgctgtaatatttgcatataacctatgcatatcctcccatatatataaactcatctcttgattatttataattttaatacaatataaattctatataaatagttcttatgctgtattatttaggcaataatgacaaaaatctgtgtttgttcagtgcagatgcttttttaaaaaatatattttccatctgtggttatctgaatccacggatacagaaccaacagatacggtggaccaactatacgggcaaaagttcagttccaatagaagacaagactactgcacaaaacacctagtgttatgagctgagactagggtggtaaagaacagacacttcacatgggtaccaaggaacagacacttcacatgcgagaatctaatgtgtaaagtgactaattccatatctaggtaggggaaaaatgattcatcctggatgacttgagtgcctgggagataaaagtacaaaaaagtagctgttttgggtaaaatgacgattaatttgatgttattcataaatttaattattcagcattccttcatgttttttttattcaactgacagcatcttaggcagaaggaaagataaaagaactaatgtaggaaatagcttggtaatttcaagtcattgaaagaatggtgaagtggagcttggtgttcaaggtggaaagcacagtgacatgagattggatagcatgtttgtaggtgctgagctgcaggtagtgacagatggggtcatgctttattactagcagagcttctagacaatgactcaatggctttcagagattccttggctctgtggaaaccggtttaaatgctttttaaaaacagcttcaaaattgaatttaacattgttgcagggcaatgaagcagggattgctgtgtgaatagcagtttggtaattcctcacaacgatttggtcataggcaataacaatgtacttttgtgacgatgtgtcaaaatttttaaaccaacaaaactttatacataggggaggcaagatagtgtggtaattatggttatgagctctgaaaccagactgcctgggcttaaatcccttctctgtcacttcacagctgtgtgaccttgggcaatttacttaacttctctgtgcctcatattctttattttgaaaatgatgataataatagtgcttcctatatagattatatgaaatattggatgaaatgctttatctcaagtgctaagaacagtgcctagtacataataaatgttaaataaatgttagcattagtggtttagtaaccttatgcaaaatataagttggagtattattttaatgtatcatctggtgtgattttttattccagtactttatttttgtcctctggtctttcaaatcagacaattaagcttccattgccttagagaaggaatactaagcagaaaataaattttagtttcaaaagccaaaattttgcaataccaagagccttggcattccagtttcaaaagactaaatgctaaaagaccaaggatataatgttcatgctagaaagggttgattggatgaatgcagagtgatggaggaactagcttttctggctcagggagataaatattttgtaggctgggagagcaaaatgggactgattgatgtctatgctcagataccagtttgcatccccaaaataaggccctgtgtccaggccccagacatgggaagttcaggagagtagaaaatagaacctgcaagtagttgttgagatccaagaaaaaaataatacctgtgtctcacagtcccctaaagggactgtaggaagcagcatgcttgtccatcatggcaagtgaacagtaaaacagagatggattgatacacaggaatttaggcagaaagccttgtagaattttctttcatccagcacaaggggaacccagggacagcctggaagaacatgagcaagcaccagttcatcttgtgagcaataattgcacaaactaatgacagtgatgacttgaggggaacacagccattttagccaatgctagcataatagatggttgtaatcaatgattagcagtcctgtctcatagctgggcattttgtgaacccccaggaatgcagacgcaatgctagagattgggacaattatggggtattgtggtggtgagagaccgaattgacagagattatgcaacattgactggaagtaaattcttatctccagttggaatagtaacatgaaataaaaataaagttcagttaaaaacagataaaagttacattttttaatcatctctattatgaaaaatagaaatatagaaaaaataaaggaaaaagttacatttctttcctttgccccttagtatgaacatacatacagaccaaatgaatggatccatggcactattgcagagaaaagttcaactgcctctaccctgacttaccattttatagaaggatgatgcccagaataacattatcttaaatactcccaagatttataagaaggccgaggatttctgcccagacacatgaaaataaggcagcgaaggaaaaaattaaagccagtactgctttttaaaacatgcggtttatatgtaagacttgcagaattaaaatcaacctcaacaaaattcaaggcagtcaaataatgttcttgaaaagtggttaccctctgagttacatttttaacattaacagacatggattttttgggaagtggatgctgtataacatttgtattctcagcattttctgtatttatttaagccagtttgttttccccagtgatcctatgtctttgagacctcgctcttgacaatggtggcttcaggagcaaggccccaaattgccaggcattgctattgtgttgaagccacgctgctgcttttccctcctcatatcctgagcatgctttattatttcttccatttataacctctagttctgctcccacaaaaccaaaattctctggggggtaaaaacttagctacaacattccctgaaatagcgattagattgaagcttccttggatttgtccaaatccaaacccccatttctgtactttgctttctgtcttcaggtgatcaggatgcccttctctcatctgtctacctacagcctggtttgggtcatggcagcagtggtgctgtgcacagcacaaggtaaagaaactcaattcccctgcttggagcccagcaaacacaatttctggggtgaagacatttagccagtattgtttgtgctgtgctggttccatttgtctgcatgaattatttaagcatgtaatctgcctggaggagtggacgtggttcttttctgctttccacacttttgttttcgatgtagaagcacactttgatatttagaagccgtttccatagtagatgaaccagacttatgaaaaaatcctctattttaaaatgtcatttttcacttactgaattgaattacaaataatgatttcctctgtttttaaatatatgggaatgcttgaattcaatctttttggaaagtaatctggcagtaagccttaaaattggatgtgttacctttttacagaaaaatgtagaaaacaacgaaatgtagaagttatataggctcatattatctattgtataacaaatttggttgtgccatctacttatctaccgaagttcctagctcttcctcctcagttccttgggaggccacactcactttaccactggccttttcatcacttgcagtgtgatgttgctcagcatcagcctccacagatgtgggtgatgctggtgaagatcagataggcttcatgcccatctccaactctggtccacaacattcatcacaggacttatcaactgaccagaggaatctaagtgagattccatagaggtagcaaagaattgtaaatttcccctaaatgatttcttccatagtcaaaaagaaaaaaaaaactcatctaagagttgaactctagttttgagttccctttcactctgccttctaaaagcagtaatttcttcaaatctctggtctgcaaaatctcaacaaactttcaagaagtctcaatcctagcaacagatagtttcccagaacttttcacatcttccaagagtatacatcatttagttttgaatcatgcaatactcaggggttccagcctgtatttgttatacccatctttcattccctgatattgtgggggagttgcttgtttactcagccttctttttttttctacttatacttgtcaacattttatccagattatcagtctttaaaaacaagtctggatgcttgtgatcaagtttacattttgtgtaccattttattagtgtctttatctttattaattcactgcgatatttgaaagggagggtaggaggtttggaagtaagtgtattcatttttaagtatctcttcttttctattaaatgttgctagaattaaatgtttctctgagaactgtccttccttccttccttccttccttccttccttcctttcttctttctttctttctttctttctttccttctttctttctttctttctttctttctttctttctttctttctttctttctttctttctttctttctttctttctttctttctttctttcttctctctctttctatgaaatttcactctgtcacccaggctggagtgcagtggcacagtctcagctcactgcaacctctgcctctcgggttcaagcaattctcctgcctcagcctcctgagtagctgggattacaggtgcccaccaccacgcctggctaatttttgtatttttagtagaaacagggtttcactttgttggccaggttggtctcaaactcctgacctcaagtcatccactcgcctcggcctcccaaagtgctgggattacaggcgtgagccactgcaccaggcatgtcttacccatgtctatagatttttaacatattatgttctcattgtcattcagttataataatttatgattttttctatgctttctggtgtacctaagacttaaaagaagtatgtaaatttctaattttattgtattatgaacggtgttcaaggccatacgtagggtagcaacttttttgtagcctattttgagttcaatttggaggaaggttttatgtgtgttttgaaaagattatacatcctttctttgagtaaagtgtgtgtgtctgtgtgtgtgtgcgtcttatgatatctttattcatttagtatgagttattgggtttgtaaagtttattatttctctttcattgtattgactttctcaaaagtttggctatttgttattatgttgagattttccatcaaataatctatcatagtatgagttgctaatattggagaagggaagaaatttatatttatacacacacagagagagagatctacatacatataaagtatatagtgtatataatataaacatataaaacattgataatattaaatacctaaagtatatatataaatatatattgtttttcaaattttcttttctttgtgacatggacttaccttgtcacccaggctggagtacagtgctgcaatcattgctcactgcatccttgaactcctggccttaagcaatcttcctgtcctatgctcctgagtagccaggactacaagtacatgacgctacggctggctaatttttacatttcttgtagagataagggtctcatctcttgcccacgctgatcttgaactcctggcctcaagtgagtcttctactttgacttgccaaagcaccaggattacaggcatcagccactgtacctggtagtttttcaaatttcctatttaactttttttcctttaacaattgtttaaatatattaaattgaaggttctcggtatgattgtgaatttaaattttttctttgtaattctattagttttgctttatatatttcggagttatgttgttaggtgcataaaggtttatgattactataatagatctgattttagattgttccttttatcattttgaaaaatactttttcccttcttacagtggttttgtcttccattcttttttttctctccttttagaagtcttactgaactgattttggaacatttaagtctacttattgaatttttccttaatcccttccatatcattatctctttgtgctacattctagaataatttcatggcctgttcttactttttactaatttactcttcagtagcatctattttgctaagtcagcctatctgttgcaattttatattcctcattttctatatctctaatttctactattcataatgcttttattatgcttttattacacttatatcatcacatgtattcatgtcaaagtatttattgtcttatgatatctttattcattttgtatgagttattgggtttgtaaagtttattatttctctttcattgtattggctttctcaaaagtttggctatttgtttttatgttgagattttccatcaaataatgtatgatggtatgagttgctaatattgaggaagggaagaaattaccaccatagcatttagtgaaagcagagggtgtgtaaattattatttgtgtgccaaagcttcaagatcctccagaacattgtcccataaatctctttacctatgttcctatatacactcttgcttcctggaggcagacacctctgttccacctgcttcctttgtagattgtgtatgtgtgtgtgtttgtgtggaatgcatagggctgctccatcttctttacttacagtggtcactctgcctgttatcctttggccttttcctgctctttgcttctacttctccaagcatggacaagattggtgaagctgctatcctacctggcagtttacatcttcaatctcattgtacctacttcgcagcttacacagatcattcacaatttcttgtaactgagagttgctctcttgtttttctactctgctactattctttaaagattgaacaaacatatttgaacctatatatttctctggcatcacgtaggaatgtaaataaatgttttcttttttgcattttctctttcttttctatatttgacattgaatatacattttatttataatcaggaaaaagtgtatgtgtgttacaatctttaaatataaatgttcttttatgattccatagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatggtgagaatctctgagaatcattgtctgtgtctggaaatactatttgcaagaatgtttggaatatagccgtagtgcccagtttttcaggattttaaccacagaaagggtcatgagaagatagcctttcttgtctactatagctgtgtttatgattatttggagagttcatggggctacactgagttctttggctggagctatcttttctctgagggatcctgctgtcaacaggagaaatttgaggacaatggtgagggcaacaagttctccataagcagtgatatgattcagacctggctttgccactagcaatcatgcgaccctagaagggtcctatccactctccactggagtttcattgtctggacaataagtgtgaaatagatcatttctagggtcacttacaacttcaactttttggatctaaggacagagccagattggactagccttgagccagttatgattgtccttctcattttgcttggggagatagctctttcaggattgataagggcacatagagcagagccttttcatacctgaaatgatgccaactaaagatataactgggcaagagcattcttttaaaatccaagaggcttagtttgatgaaattcttcttaactgacacacagctgagatgaaaggttacgaagtgagaataagagattactttggagcatggcacacacggcagtagttttagggagtagaggacaaacttatggttattaggaatattaaggtgagagtttactcatgccaataatattgcccacagggaagaaaaggcttagtagatgagaatgcaagggagataggacaatgccaaaagaaatttcttttacttattttgcctataatgagtcctctctgtagaatcttatgttgtttctttcttgatttccacttctttcattctctctttttctgtttctcctccctgtctccttccttcctttcctccctctctgccttcctttcttctttccttcctcctaatttttctttttttcttgtgtcatatttttctcatttctgttcctttttattctcttcctcttttcctcacctttctttctcttagtctccttccttcactcatagacttttgtatttttttttcctgaaaagcagatgtctctgagctttaaagctagtaattctgttctcttccacactgaccttttccatccacaccttataactttcatgtaagccattctttgatacatcataggacctcaacactcagtctggcccatcaaccatattcatgttttttcatttctatttcccttcttccagcgctcacagacattagtaatcttagccagagccacagttccatagccctacttccccaacccagtgtcttctacctgcctcttgaacctataagcacagcccaggctttcagttagcactgccatttaattatcttgtgggctccaaagccaaccacagaaagacaagtttacatctgcttagaaaagaaaaattctatattccaacaaaaatgaactcactagtcaggggattttcaaaagggtacaggctacagctggcctgaaaataattttctcatgagctagttagtttttcttaacttaatcaggtgatttccagtgctcttccaacagtcatttcttaatttttatggttattagctacgaattccaaattttggttttgtgtagctcttccaaaaagggattttccagctctcctccatgcgtctaattcactggtccagctccaagaagaaaatggctatctctaagcagtagcctttctatgggctctctgttccaaaactgccctagtgcctctgataggtacaggacacatgtatggcagtgctggttggtggttattgtcaagccatttaagaggaatacccagaagaaggcagagatgctgcattgcccctggaagagaacagaataattaggactgtttgggagagaaaagtatcatctgacttctcaatactctatgtccatctgacaaattctgctacagacaaattacagaaagggtctttctcatcacaggtttgtactaggccagtctccatcctgcagatcagaaaattagacacaagaggaactggaaagtccccagtttgggtaggatatgccatgctatctttctagcctccattatctttctataagcatatttccttcatctctctgaggagactgcaggactcagaccaggtgcttaactgataacagatcatatttattttttgtcccagtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggtaagagaaagtgagcaaggtggctgtggttgtgtctgtgtgcatggacctggaaggcagtgaatgtcctgcagaggttttcagcctcttagcataatctatttggagaaagaatggggcaaataaggaaaaaacaaaacaaaacaaaaaaattgaagaaacaaataaagcaagttttactttcataaatgtggttcattgcccacacaccaaatgctgttgctgagatccattcatttatttatttcttccactctactaacatgtaattaggtctgttctgggccagactttgagttgaacatgaaaagtgcagcaatgagcaagactcagtctctaagcttctagtctactagggaatagagataaatggatgggcaattgtaaaactgtgcattacattctccagtgagaaagctatgatgcaccatgggaggattggaggttgggaaggaggggctcaatctgggggagatttggaaggtttcctggaagaagtgacatctgtgatgaaatcactgtataatctacactgtgagaaagggacctatctgaagtgctttcgtcacccattttaaagcaaactgcctcctatccaagtccctttttgctttcttgtgtttttgtctaaactactgtctctgggcctcatagatacaagaggtgagaatgacagaggagagaataaagggagcagagattataaagacaagaagttttagcaataatagccacgtcttttctctgtgtagttttgaagcactgactcttgatgaagcagtcagtaataagcctcctaaaaagtattactcctcttttttggagaaattatgagcaataaactggaaaagctttctacacccacctctttactgcagtggcctttggagtccctgaaaacccagactaatcagaaattggatatttaggtaaatttggtcaaaaagacttgcagtgttggatttggatatttgtgaagagatcttcagattcagccatggcaaagggtatatttcctggaaaaacaagaacctaaaaaagaatgtcttttttttttccaagaatgccagatttgacttatatcacttacagtgtttatataccacttgtataatgtttgtttattctgtgaacatttaccaaaaaacttccatgctcaaagcattatgtcaagcactggacctatagaaatcaaacaaatccctgtctgaggtctgaggtgttcagttaaataatgatgtgacgaatcccattatggaggtatggagaagatgctagagactcccaaatcaaggagttcctcatttgcctttgcattgcaacatgacactgaggaactgatatttaggctgagttgcattaaagacatagataagaagaaatttaccaaaaactttgagatgagttatctctgggggttgaaatcatgagattcatgtttctttctttgtacttctctgcattttccacaatttcctcaataaacatgtattcttttaatagacagtatggcaaagaatatgtgctttagaggcaaacagactttcaaccaaaccttggctatcccatttgttattctgattttgatctcagttaaattctcaaagcctcagttttctttaaatctgttagaaaataataactcttgggatgttttgaggattaaatgcgataagtttaaagctcttattacacagtagccagataaaacatgttagctattactaatatctaaatattattaaaataatatgaagtcatacgtataaacctacatatgtatgtatttaaggataattttaactaaaagctcaactctttttgcctcaacaatttcctcatgtgatgtcattttcctttttctttcttcaatatctataggctattggttttcagttccgctattgctaagcattgtttccctggtaattcttctcgtcctaatctcaatcttactgtactggaaacgtcaccggaatcaggaccgaggtgagttgtcacagggagttcaaaaaatgacataaattaaatttgatttttaatgacaatttgtgagtcatttgaagatataaataagggaatggcaacaatgtgttttgtctgttgtttccaaaatacagaaatgttgatactgttttaaaatgcgtcggggcattttcttgcaattggacattaaattggacatttctgctttttgtttgctaagatgacttaaaagctaatgaaatcaaacaatggtgatagaaccaaagaaagaagtctggcacccacacaaggccctttccactcattaatgagaaggacaatctcttctctttttatagcacttcacaggccatctgcccatttaagaggctgcaattgtccaattatgatcactcattaagtagcactttctgtgttatactcccacgatgcctcaaacactgtcagcatcatgcaagtgatccatacttacagtaactgtgtcatgccattctgcccttctagactgtaaatttctctttatctttcacaactatcacagcatcttatatataccagggtctgaataaatgttaatttactgaatgaactgattgaggacagagagaatttttaaggtgattttttttcaattccttttctcctattgtaaattcagtacctcataaacgccagtctaagatattgtgagaaattataaaacaagagacactataaagcaagagcagtgagctagatagagaggaagaatgaaatgtctttggtttctgtagacaatgcataatttattgaagtgaatacaaagctgcagtttatgttttgtgtaatggaaatttgctagggtgaaggggtgatgtgggagtttcctccatttcagatgactgaaggataggggtcaggaaagaaaaatagttggctttgatagctattttagactttgattaaaaatctcactcattttttcctttcattttatgttttatagaaatgtttccttttagttttatgtttatatttttatgtttttgttcatgtttcaagtttttgaccactttattttgcataatcctccagattaattcttgtgaatttataaaacacccaaaaagccttcagtgtcagtggcccttttgcaaaagtaggtaaaggtatttgttctgtccaggagagaagattacaaatcagttaatcttactacacataattataagcctgtggaactcataagtgctccacagaataaaatcaaagacagaagtctgtttgattctactttatccagaaatttttcttttccaattaggaaactgaagcccagagaggaaagctgacttccttccataagtttatacagcttcttaagagcaggctaggactaaaccccggtgccctgacctctgccaaatgttcttcctgtcattactgatgccccaatgtcttgacttgaaaggagctattgttatcagttgcattcacttaatctgtgcttactgtctatgcccttttcttttggaaagtgcaagcagacaagtataaagtatttaaattcatttttaaaagtccctcttgggcaaaagttttataatgcaatctactcaagcctgaggtaaattctactggaaagagacatgcaaaataattacccttgttcattaagcaagtcttggattttctgggaaatatagtcattcaatgccaatatccgattcttgaagcaaaaagaatcagcttatttctctgcccaagtttttcctcacttatgaaataaatacctgaacctatgttgactcctgtacgcatcaggattgccatttactgatgatgtcttcatgacatatggccaattgcattaattcctctgaatgactggatttttgactcatttcttttccatttgtgttgcttacaaaagttacctgaggctgggtaattcataaagaaaagaggtttatttggtttctaaaggctatacaagcacagtgccaacatctgcttctggtgagggcctcaagctacctccactaatagcagaaggaaaaggggagccagtgtgtgcagagatcagatggcgagacaggaaaataaaagagggtgctgccaggctgttttaccagctctcatgggaactaacagagagagaactcactcacaccaagggcattaatcaattcccaagagatcttccccccttaaacacctcccattaagccccacctctaacaccggggatcagatttcaacataaggtttgcaggatcaagtatccaaactacaacaactgatttagaaattttaacagccagataatttggcatcatacacttacagctagtaaaaccaagagtcaattatgctgaagcttaaatgctcagggctaagaaaatactggttcatttagaccaaacttcaggttatacaaaaagttgggacaaagaaaagagaaaggacagaaaatcatagaagatagtgacactttttatttctaccattaacaaattctgattgatattttgtgaggaagggaaatagtcctacacatttgccttccagttgttttcatccttacttttcttttctttctctttttctttccatcatctgaaaacataaaatttccaaatgagcaggaaaacacgattggtccaaaataatacaaaggttttgaacttggtgacctcaaaaatggtgatgtgaacagaaacactaaagtgaagaggtggaactgagagagagagagagagagagagagagtgtttagagtttgtagaaaagcaaaggagacagacgaataagtttttgaatttattgagtgtgagcagacaaagaattatcttcatgtagctgtccagtagccaataataaaaatctggtaagtaaggtaagtctgttaagtaaggtcaattctgtgttgggtaaatgaccaaaacagaagtttattttaggtcataatcactactcattgctcacaaatgcctaagcaaacttacagttactgatgttatttttacgtagaagttagacgaccattacttttcttgtgatcctgtataatgccagagagcatgacgttggttttttccaactgcgaagtagcacaggccatttttctgcaccactcctgatagaattatcacagttacttcccaggagactaccacagtaagactaataagatttcaaagagcattcttttctctttcatgaatccagcactttaaaacagtaagtgagaaagaattaaaatttcctagggaaattttccaccatctcgaaatacttctttctattaaaacccagtgatttcataaagttgtgcctttcacatatatgacaatgtagttaaatttggagttgagaataatcttttatttctcattagtcaacccaccaacaattacatgcttctcagaaacaataaaagaaacttcactttgaggcagatcatcatagacaatcacctaatttttaggcagctttattttgtttggtttggtttgctttgctttggtttggttgagtcaaggctgctttggagaacaatagaaaatttagacaatcatgtaaaatttatatgccaaacttcacttttttttcaagtactagctaatccatgtagaaatatgtttttcatctgcatgagctgtatatttatcttgatttccttctcttcacaataacctaacctatgaatgggttcctgacaatgtataataacaatggcaaagttaataaaacgtcatttcctggataacagcatgtgactttctcctattttaagcttaatacttaatacaaacaacaaaggtgttcgataaacaatttgtgatgatgtaattggtcattagttgaaaggggaaaacaaaaaatatctgttcacccctcctgaaataacaacctttgctttgctcagaaagcacttttgcttcccgtacaaaggctgtatgaatgggtagccctctgtccgggctgtatgaaataagaacctttgctttgctcaaaaagtacttatgcttccctgacagaggctggatgaatggcactacccaaccccaccccagtatcctcatagttccaggaggaagaaatgtgatgctttacatgagaaaagcgataaagaatcttcattgaactgcttagattagtattgctgggagaaatcttgaattccagggctatttttccgcaaaaattttacaaattttgggtgatttacctatcatgccaagatgacatacataatcttatcacaaaacccttagcaaacagattcttaatgcctggacattcttgcctggagctgttctttgctgttctctctaacatctaaacccacatgggcatagatgacccaaattttaagtttcagtctgtatgtggggaacatctctaggaatcaagacatctcagtctcctgcccaataattcaatgtgtgttcagtcctcaaatggcatactcattcccttggctttttggccatggggcttttcaaggagattagctgtcagtacctgttagactaattaatgaaaaacaaaaaggatgagaaaatctaccagctgaaaaatcctctaacatctctgctccttttgcattttagtttgcatatatcctttacctagtgtctattaccagtttgttttgtttggaaccgctgtgcatttcagtagtatagtcacacccatataataagcttgcctctaaacagatacaaggccctagcctctactaacaaaagaagccaactgtatgctatttaaactggaaaagattgggccacttaatgaaagtactcaacatggcttacagagggggaaacatcataaatgctgtattaattttctattgcttctttaccaaattatcacgcacttagcggcttaaaacaacacacatgtattatactacagttctagagatcagaagtccaacatgggtctcactgggtttaaaacaaggtgtctgcagggagacattcctttctggaggctctaggggagaatcctttttttccctctctctcttttcctgcttttagagactgcccactttccttgccttgcatcttcaaaaccaacaatgtccagttgagtctttttcacactgaatcactctaaatctgaaacatttgtctcctttttcctttataaggatccttgtgattacaatgggcccaactgcataatccatctcagggtccttaatttaatcacatcagcaaaattcctttagccatgtaaagtaacatattcacagattcctggaattagaatatggatgtctttggggtgccattattatgcctatcacaaatgctaagagggtgtgggagtgacttacttagagggacagctgtttactgacctcccagtggaagcattctctctctgtaattccatagcctttgctctgttcctggcaactctctatcaaagaacttcaaaacctggtcagaacctctgaccaggcaaggctttattttccaggattatattttgtctctcaaatctgtaatgcaaaagcatcacttctgctttcccttgttttctatcactaactataatattacaaaaactttttttttcttagaatctcagttcttgcatatttcctgcttctccctattcctaccttttcatagaggaagcaattctgacttcctttgtcttcgtcataagcatcccgtaaacacaagttcacagggaactgtgaaagttcaaagtgggaaaattatatttatcactatgtgtggtgatagtaggcataaccaaattggtctttccccgcttatcataacgtattaaaccgggaatttctcagtccctaatacttgcagagtcatgttatgaggtcattatagattttaggagcctcaatgcttttcatatcattttcagaattcttcaaaattcccatttataggccctaattgatttcagcagcccagatgcagtagagcagttcttccactaacaatttttttaaagacagagctaaaaatatatatatttgatgaagtatattaagtagaaaaaaatgttagaaatatcagaaaaaaattaagaaataaaagtatgttcagtacaatttaatttgaataattttaatctctaaaaataaccatattgtaaaaaaatacaatttcttctagtaaataaagaacaaatgagattttgtactacaaacatgcaagacatgttttgcaaaaatcacaacttcaatgttaagttccgcatttcatgaggcacaattatggaaatttatcaatgagaggctattaaaagagagcctcttgcccctctcagtattcaaactagatagaatttcatgatgactgaccaatgctgctagttctgagtctccgtggacactagtttataaatactccaaccttctcccttttttatacaataaagagaaatgctagccttgtgttttgaaagtcctttaaagagttcatgttaaatacctttgggattatgtacacaattgtcttttaatcttttttaaaaatattacttattatgaatttttgtttttatttttttaattgaaaacagaaattttatgtatttatggtgtacaacatgatatttctatatatgtatacattgtggaatggctaaatcaagctacttaacatgtgcattgcctcacatacttatttttttgtggtatgaacacataaaatctactctgtcagtaatattcaagtatacaatacattgttattaaccgtagtcaccatgttgtacaatagatctcttgaagttattactccttatctaactgaaattcttttcatcttaaccaaggccacatgaaataagaaactgaatgtgatatttatttctacaatatttctccttcaagagtttaaagttttcaactgttaattttagcaaggatgattgcaaatgacatataaaattggttgttttctagtcagtcatttttatttgcaacaatgaacaattacttagcgattttgatcaaatcctgtcctttacaaactagctgagtacctttggacaagccatttaacttccctgtgcctccttttcctcactgagtaagatggggataataattgtaactgtatctcataagaatgttgtgaagatttaaacgggaatacatacaagtgcttagaaaagtgcctaatggccgggcgcggtggctcacgcctgtaatcccagcactttgggaggccgaggcgggcggatcacgaggtcagaagatcgagaccatcctggttaacagcgtgaaaccccctctctactaaaaatataaaaaattagccgggcgtgatggtgggcgcctgtagtcccagctactcgggaggctgaggcaggagaatggcgtgaacccggaaagcggagcttgcagtgagcagagatcgcgccactgcactccagcctgggggacagagcgagactgtctcaaaaaaaaaaaaaaaagaaagaaagaaagaaagaaaaagaaaagtacctaaaacgaatgatacgctggaacactggcctgggaggagaggggcggagtgtttatttgtagctgtcgccaacttccgtgaagtaaatgttcccaccatagcaaatttcaagctactaacaatttaaccatcagcgtgagccaataaagctctagcacaccaatgcggcagactaagtttgtaacagatgttcatttttgtaattactaaatctaaggtcctttttcgttttatcgaagtatattttcatgaattgtacaaatgttcaaggaaggacgagtttagagaggtaaatggagggacaaacaggaattgtagcagttaggacagctttgaggaagatttcaggttatctgaatctgtttggacacatgggcatgcgtatttggaagggagaagaactcatacagtaagtcttaatgtcatcaataggttcttggaaactgcgagtttaagcaaaacggcatgtaacagaaccaattttaccacaggctaaatgatagaaacaagacttaagttcctatggcatatttctagtcacaaaaacatcaccaaacttttaataaagaccaaaacatttctaatattaaacattgaaataaatgtgagttatgcatacatttaagaaacagtaacaaaaacaagtgagataattattcactcaatgatttcagttcaagggtatgggtggccagagcctatgcagctcaggatgcaaggcagacactgacaccagacaggacgtcatcccagagcagggggcattcacacacgcgcacacacacgcacacgcacacacacacagttactcagactgggaccatttggacatgccaatttacataacatgcagtacgtgtttgggatgtggggggaaccagagtatccagagaaaacccatgcagacttggggaggatgtgctaactcccacacagtggtcctggatgggaatctgttgtttttctcatcaacattataacaacatgttgtggaatgaaaggatgttgttggaggacctgctatataagtcatttcagtagcagtcttgggagaaatttgtggggacccactggggagacagaatcagaaaatgtgcattctaaaaacgtgcgtatactgaaatgaacttgtgatgcctagatgaacttgtgatgccgaaaactgatttcctgctagtgcagttgtatctctttttgaagaagagaaactgttttgcttagacattttttttgtaggagtatgggaagaaaaattactcactgaagctagtgcgagtcaagggtagagggagggcagttcctgtaaggatgtgtataaatggatttccaggaaactaaactgccgcatgtcaggaagagcggctacctgaaggtgcttgtagatccaaagctgccctaggttccccatcagcactgattcatgagttttgcatctagtttctcctgtccttaccacaacttggctgttctgtcttctctgcactaaacaacttcttcactctctattccatatgttttaaacttatcttactatttttgttccctcataccttgcttcatagattacccaatccaacaagaaacaaaagagagaaagaaagaaaagtgagaggaaagaaagagagagaaagaaagagagaaacaaaacgaaagtatattcctgaaccacacaaaaagacaaagaatcacattctctacaagtgtcctgtgtttttgcaaattaaccggtacttcaggtagtccttaggtattctagagtttagaagaatcctaaaaggttttgctctggcaagggctgtgagtaaagcatggcctttgaggcgatggagggagaaagatatatagaaactttattttagagaaaggaaaaacttcttcagaccagatgcagaatcaagtaatcaaccattcaaagtcaggcttaatttaagagctttttttaaaaaaaacagacaaacaacaacaacaaaaatgtatactagtgatctttaaaggaaaccatgctatcatttagattattattctggattccagtcagtagttaggtcatataagaattataaattctgttattggtaattgatagttcaaaatgcatagtctcaccactcagggaaaacagcacttagatttcagaagataaaactttgtaagtggggatgaaaggagggcatggagggtgttcttaaatatttaaatggatgttcatgagacaaaaggactagacctggaagttattacatttaattctcatagcaattgataaggaaagtatttccatctgataggtgataaaaccaaattcacagaagttcaattcattcattttataagtatttattaataatttttaatatgcttggcattgtaattagcactggttattatactataatgaacaaaacaggaccttgtcattttaatggagatgacaggttagggggacagcagagaaatgacaagtgaatcaacaaataaggatactattaaaacacgagattttagcacaaggaaataatatagaataatataaaatatagcatgcaatgaaagaggataacttgaaaaggataccagttacttggattttgttagggaaggcttcgctgaggtggtgacttttaatcagagaccttcaaggagagaataatccagccatggaggagacaagggaagagtggtttttagcaaattaattgcaaatgtgaaagctctaaggcagaaaagtcattaatattttacagggtgcggtggcacatgtctgtaatcccagcactttgggaggctgaggcaggcagatcacctgaggtcaggagttcaagaccagcctggccaacatagtgaaaccccatctctactgaaaatatgaaaattagccgggcatagtggcatgtgcctgtactcccagctactcaggaggctgaggcaggagaatcacttgaacctaggaggtggaggttacagggagcagagattgcgccactgcactctagcttggttgacacagtgagacttcatctaaaaaaaatatatatatatatgtatatattttagagcagtgttactcccaatatggtctgaggatggttgcccatccaagaagtgttctttactagtctgaagtaaaataagtacataactgagaaaaaatgcttacactctatgataagaatttgacagtaattttatatctgttaaatctgataatttaaaaatgaattatgttattttatgtcatttttctagtaattcgtttttactattgaaattgaaaaatattgagccatgttgggagaagatggtctttccatggtccattgatatctgatgttagaaatattgggcaggatctaaaatgtgcagaactttgcaggttctggtaaacaattacctaagattacacagagagtgagaggtggtgccaagataaaattccaagtcttttacttcatcgtctatgtgccttgagaggtttccaggctcccagtatgtgccagaaagccactagcccttggaaaggcctctacttcgtgaccatttctaccctgacatccagtgagttattatccatcagaaacaaagcttacaaatagaatacattttgatcatttggaatttttgaacatattcctttacttgtagtcttaggtgattttctaaaccattatttcctaggattacgtatgcccttttatttttgcttcagttttgtttttgtttttggttgttgttgttttgttgtttttagagatagtgtcttgctatattgcctggggctggagtgcggtggtgagatcatagctcactgcagccccaatctcctgagctcaagttatcctcacgcctcagcctcctgagtagctgggactacaggtgcatgccaccatgtccagctatttttttttttatttttattttttgtagagacaaggtcttactatgttgcccagactggtcttgaacttctgggctcaaatgatcctcccgcctcggcctcctaaaacactgggcttacagccacaagccactgcatccagcctacttttgttcttgtaaagagtcatagtcccctcacaccatactgggtcagaaatgtctacttctttatctttgccaatgaatatacactagaataactctgtgtttcttaatctctctattatttatcttcttaaaatgtattatgatagaatttacaagtgtccaaagttaataccttgtttttcttttatccagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatagcaagattttcatgtgttatttaattctgtattgtttcttatatttgtagtaaaatattgaacaattaaaagtgttgactccaaa

SEQ ID NO: 412 - DNA, 10934 bp, Homo sapiens
gagtgtggccccgcctccacctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcaggtttgctttagagggtcggcgggcggagcttcggggaagaggagctctgggagagtcattccggccagtggccggagaccgtcgtcgctcttgggaatccttggccgcccagacagaagggaagtaggcgccggagagcccgttctgcattttgattcatctcgggccctgtaagggtcatatcttgtgaaaataacctgtaaaatcaatttaacgttcagtgcagcgtgtaaagacagctctaagaatttaaaagacgcctgagtcagaacatttaaatgcttgggtccctgtagcagcgttttaacacgtctgagtgcagagggtggagaatcgagcctgattgccgttcacgccctgtaacctttaagaagggtaaagaaaggcaccctaaaaaacgcaaggggacacttaccctagggggggacgaacagctagctttttggaatttgggttggtcttcatttccaagtgcgaaatttgcctgcaaaactttttatttgcagtcatagatcaacgataaacagaattgttaaaacactgaacttaactaagtagtggcttttgttgacaagtcgattgtgttattaattcttaatgtctcatccaaggcaggaatcgttatctcagttttgcaggtgggaaaagtttggcacagaaaaaagcattttccttaagttctcagaagcaacggccggccgagctgcaaattaagtcccagcattctgcctcctcagctgcgtccccctctagaccatgttagaaaacaaatgagtagttactttgatgttactcataaaacgatcgagtaaaccaaatgttctataaacatgaagcgttaaatcataataaccttcaatgcctgttcagctttgggaggctcagttgccctttggagtttgataccttgcagagaggaggggcagagcaaaaacatgaaaagtaatgtcaagggaaaatttttgtctcctgaggtcaaactgtgcccatctttactgcccctgtgttggtgtcattcctttcagcgcactccatgttctggcaaaacacccacagctcacgttctcgttgtagccacattacacctttgcattactcttttgccactgacctcactgtcagtcttcttgtcacgctgtttcctccaggtgctcttttcttaggctgttatgtgaaaaccagttgttcaagtgtggaatgatttgtcattcctgaaggatgattctagagttaatgataaaaaaaaaaaaaactaccaacagatcttagacaaaaaaagaagcacaaaaaaactattatggaatttgatagctgagttatttggggggaaaaagtagactttgatttttttcccttttcccccagttcactcataactgggaagctgcagctcagttttaactttggcataatggtggtggtggtggagaatcctcttgtttagactcagtgaattggaaagttctctttttaggatgctccttttggacagcttggagcaagtggaaacacatgtgtgcttagaatgtgacatgttttggcacttgtaaatctgtttgtccataaagcttgtgtaagagcttgggacccaggatgtgtggtataggccctctgtaaaagtcatccttgaggttcctttccagcttgtggacagcagaaatttgaacataaggtagtgtccttggagcagccagctgtttattcatctttttgttttctttcacttcttggttccacagattagaatcccaagaaaatcaaatggcatccggggatttctgctcacctggagaagggatggaaatacttcaacaaggtaagagtagccacttgcaaaaggtttgatgatttatccagagaggtcttatccaggttcttgccttttctagtaaaaagcatttattggctcacacctgtaatcccagcactttgggaggctgaggtgggtggatcacgaggtcaggagatcgagaccatcctggctaacacggtgaaaccctgtctctactaaaaatacgaaaaattagctgggcgtggtggtgggtacctgtagtcccagctactccagaggctgaggcaggagaatggtgtgaacctgggaggcggagcttgcagtgagctgagatcgtgccactgtactccagcctgggcaacagagcaagactccaaaaaaaaaaaaaaaaaaggatttataagtttccccagtatggttttcctcacagaagcatgtgtttctgaggaaactggaatacatgaagatccttgaacactctcttattggaaaacagactacactaattcctgttaatgttggttcaatatctgcttgtgtagtaggctaaaaactcaagatgctcccatgctgatgttagcaagcatattataaaaataagggtagccagcaaattccttgaaggtgtccttcctacctgtgtcttaaatattctcatatcttagtctccaaaatttcagatccttctatatcctgagttctttccatatctcagatcctttctatatcttgaatccttcaagagcttgcattttctatatcttgactatttccatattggatgcttcagtaccttagggaaaaagagagatttcttatttcccaaaaagactttgggtataatgttccaaagaatgaaaatttgggtgttttggcaagtagaggtaaaagaccccaacagagagcatatggaaaaagaaatggaaagaaagctccttgagcatatggaaaaaccagaggatctcaatttcttacacttttttctcatgcctgtgctgttttgtatctacatgggttactcaactctactgacaattataagtatttgggccagctggccaggtgtggtggctcatgcctgtaatcccagcactttgggaggccaaggcgggcggatcacctgaggttgggagtttgagaccagcctgaccaacatggagaaaccccgtccctactaaaaatacaaaaattagaggctgggcacggtggctcacacctgtaatcctagcactttgggaagccgaggcgggcagatcacgaggtcaggagattgagaccatcctggctaacaaggtgaaaccccgcctctactaaaaatacaaaaaaaaaaaaaaaaatagctgggcgtggtggcgggtgcctgtagtcccagctacttgggaggctaaggcaggagaatggcgtgaatctgggaggtggagcttgcagtgagccgagatcgtgccattgcactccagcctgggtgacagagtgagactccgtctcaaaaaaaaaacaaaaaacaaaaaatattagccaggcatggtggcgcatgcctgtaatcccagctactcgggaggctgaggcaggagaatcgtttgaacccgggaggtggaaattgcagtgagccgagatcacgccattgcactccagcctgggcaacaagagcaaaactccatctcaaaagaaaaaaataaaaaagaatttgggccagctgtggtgactcacacctgtaatcccagcactttgagatgccaaggtgggaggatcacttgagcccaagagttcaagaccagcctgggcaatgtagtgagaccctgtctgtaaaaaaaaaattagccagtcatcgtggtttgccttgtagtctcagctcctcaggaggtggaaggatcgcttgatctggggaggttaaggctgcagtgagctgtgattgtgccactgcactccagcctgggtgacagagtgagaccctgtctcaaaaagaaaaaaaaaaaattggttagttgaacgtttaacttactctaagtgtattctgttagtcttgtttatgcgactacatatcacatccaaagttggaacttcacgtgttgtgtttctttccccctacttcaagaactctattaattttggatgaatgaggcattttgtgtattgtgattcctactaacggtcccttaatttttattctatttgtctaatatgtaccaactgcatttccgtttcctaagatcttagtttattacttattcccccttaatatccttgtatataatataaatgcttgttaccttgaatattacccttgtttatttgtggatttttaaaaaatctcattagatttagcaatctttcctataaaaatcctaggggttttttggaagtattaagttatgctcagttatgtaaagtaagagtccacaccttttttgtttttttgtacctgtggggacatgatgttaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggtaagggctttgggagaagagataagaagaagggaaaatcctgagagagaggttcctacctgagattttttggatttctaggcatggaaggaagttcgactgcataagacaacatggttgaggtctgagattttacacagagtcattcaagagttgcttgtggactactatgtgaagatacaagacacaaatgtaacttctgaggacaaaaaggtgaggcaaaggctgggcgtggtggctaacacctgtaatcccagcactttgggagccccaggcaggctgatcacttgaggtcaagagtttgagaccagcctggccaacatggtaagaccccgtctctactaaaaatacaaaaattaaccaggtgcagtggcacacgcctgtaatcccagctactcgggaggctgaggcagcagaatcgcttgaacctgggaggcggagattgcagtgagccgagattgcgccacagcactccagcctgggtgacagagcgaaactcagtctcaaaaaaaagtgaggtgaaagaaatgaggtggggttggttaccagttacaggaatgaccaggccaactgtggctttgtctgatgatgtgatctaggggaagtaggagctttgagaaatggtttgtcaaaagagaaatggactgtagttatggggaaggagtggatgtgttatcagagtttgtaatagaaacattgacagaagtcactcgcagctgagttatctgaggggggatgatatatttgaggactttgaaaatatgtgaaaaactggttcataaggatggaagaggtggagtgggagaagttttatagttgcctctttttgttttttattctctctctctcagtttcatgagacccttgaacagcggctgcttgtaactgaactgatgcggctcttaggtcctagccaggagagggagatacctccactgctggggctggagaaagcggaccttctggaactcatgccactctcagaggttggcggggagatattggaaccaaataaatgaaatggtttaatttctcccatatctttaaaatgttttttttgtcaagctttattgtttttgtaaaaatgatacacattcagggtggtcagactcaaataagaaaaacgttacacaggagcaagtaaaagctgaaatactgcatctagaagcacaatattattataaacagcttgacataaatggtattatacccttcatgcttatatagagagtataaggccgagtgtagtgacttccgcctataatcgtagcactttgggaggctgaggtgggaggatcacttgagttcaggagttcaagaccagcctgggcaacatagtgagacctcgtctctaccaaaaaaaaaacaaaacaaaagccaggtttggtggtgcacacctgtagtcccagctactcgggagacagaggcaggaggatgacttgagggtgggaggtcaaggctgtagtgagctgtgatcatgccactgtactccagcctgggcacagagtgagaccctgtctcaaaaaaagaaaagtacagtctattttcatgtaatatattttggatttcttttcaagtcaatacataaatgtaaataagatgatagcttctatagcactgttagcaaagtatctaggcacatagtgcttagtgttatgtcatcagtttaaatctctgctaggattctattatatggatgtagaataatttgcttaaccttattggtggatattaaggttgtttccacatttttgctgttagaaaccacagggagatgaacatgctggttcatatgtgtctttacctttgtatgattatttctgtaatgctggtgctaaaagtgggattcctgagtcagtgcatactcatacagaatattggtacctaatgccaaactgctatccagaaaggtattttcagggctcctggatcccccatgttctcaccaacatggggtcttgacagtcattttattcttcgctaatttgataggtgaaaaatgagtctctctgatgtctcttgatgcattttctttggctattattgaggttatcatcatgtattcattggctgagacgtcctagtttttacagtctattcgcatttctgcctttacttctatgactgtaggattttgtgtggatgagggctcggctacagcaagaagtagaggagcagctcaaaaagaaatgtttcactctgctctgctactatgatcccaattcaggtgagtgctagctgtctgttctgctcacagctggacttcagggttcctggtctgctcttttgagaataatatattttgattttagatttgggacagaggtttagaaccatcagagatgcttatttgttttgttgctggtagaataaaaacaaggactttttgtttttttgtttttttttttttttgagatggcgttttgctcctgttgcccaggctagagtgcaatggcgccatttctgttcaccgcaagctcctcctcctagattcaagtgattctcctgcctcagcctcccgagtagctgggattacaggcatgcgccaccccgctcggctaattttgtatttttagtagagatggggtttctccatgttgattaggctggtctggaactcccaacctcaggtgatccgcctgcctcggcatcccaaagtgctgggattacaggtgtgagccaccacacccggccaaaacaaggacctttgtaaggactctttttattcagcaagatactgagtgggagtgtcctcctgctgcagggaaggatgagttctctcaggaggttcagaatggtttagggaggaaagttcagactcatagaacaccttatactctctgtataagcttggagggtataataccatttatgtcaagctgtttataataatgtgtttctagacgtagtattcatatttcagcttttacttgcttctgtgtaatgattttcttatttgagtctgaccaccctgaatgaatgtgtatctcttttttttttttttttttttttgagacgaagtctcgctctgtcccccaggctggagtgcagtggcgcagtctcacctcactgcaaactccacctcctaggttcacgccattctcctgcctcagcctcccgagtagctgggactacaggtgcccgccaccacgcctggctaattttttgtatttttagtagagacggggtttcaccgtgttagccaggatggtctcagtctcctgacctcatgatctacccaccttggcctcccaaagtgctgggattacaggcgtgagccactgtgcctggccctgaatgtgtatcatttttacgaaaataataaagcttaacacctgagtctgaactttcctccctaaaccatttcttttttttttttttttgagacggagtttcattcttgtcgcccaggctggagtgcaatggcgtgatctcagctcactgcaaccttcgcctccgaggttcaagcaattctcctgcctcagcctcccaagtagctgggattacaggcgcctgccaccctgcccagctaatttttttgtatttttagtagagacaggttttcaccatgttggccaggatggtctcaaactcctgacctcaggtgatctgcccgccttggcctcccaaagtgctgggattacaggcatgagctaccacacttggtctccttaaaccatttctatgacttaagaattaaggtccgggccgggcgcggtggcttacgcctgtaataccatcactttgggaggccgaggcaggtggatcatgaggtcaggcgttcgagaccaacctggccaatatagtgaaaccccgtctctactaaaaatacaaaaaattagctgggtgtagtggcgggtgcctgtaatcccagctacttgggaggctgaggcaggagaattggttgaacctgggaggtggaggttgcagtgagctgagatcgcgccactgcactccggccgaggtgacagtgagagactccgtctcaaaaaaataaaaagaattaaggtccaaatccggaatcaaaggtaagagtgaagataatttatttaataattatgagaaccagatgccctccccccccccgcttttttttttttaaaaactctgtcacccagactggagtgcagtggtacaatcacacctcactgcagcctcgaccttctgggctcaagtgatcctctcacctcagcctctcaagtagctggcactacaggcgcatagtatgcctaactaatattttagaattttttttatagagacagagtctcactatgttgcccaagccggtcttgaactcttgggctcaagcaatcctcctgccttggcctcccaaagtgctaggattgcaggcgtaagccaccatgctcagcccagaatggggccatttttaatagattattagaagaaaacctgtcataaggcaggatttgtgggtctagatacaggataggggcactggaaggttgctttacagggattgtagcgattagggttttcctgtcagtcctctgcccctttgctcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtttatcagggcatgggacagcccctttcctttatcctgaccccaggagcacttttggggaagacaaagattcctgatctaccctcctttctactatctttatttatgccctcttcttcctccatcttgggctcaggtgcttctccgctgcctcactttgctgcagaggcttcttcaagaacaccggctgaagactcaatccgagctagaccgcatcaatgcccagtacctggaagtcaagtgcggtgctatgatccttaagctgaggtgagctgtgacccctgtggatcttaagggattctgtctcacgttatcagccctctatcccttaccctaatctctttcctctcccttatcctagcgccttgtgggtatccagtaaatgtcacatagcagtattagcttttggattacccaaaagctttcaacatccttgagacttttcttttacagtcttctgaaataggcactttactgtgagatcaattgctcgggaattcagagtgaccttgtttatcctatcagtgcttagcccacaccttgaccgtcggcaggtactacgtccattcccaaccctgctgctatcagggaccttcctgccttgacatttctttcttccctctgtcaggatggaggagctaaagattttgtccgacacttacactgttgagaaagtggaagttcatcgtctgattaggtgagaactcctaagagtctggtacagctgttcacaggtggttctcacattccctaaactcgtttatttaaagatgttgccatttttggctgggcacagtggctcacacctgtaatcccagcactttgggaggccgaggtgggcagctcgcttgagtcaggagtttgagaccagcctggccaatatggtgaaaccctgtctctactaaaaaatacaaaaattagctgggcatggtggcatgtgcctgtaatcccagctactcgggaggctgaggcaggagaattgcttgaacccaggaagcagaggctgcagtgagccaagatcataccactgcactccagcctaggtgacagagcgagactccatctgacaaaaaaaaaaaaaaaaaagtttttcatttttgtccactactttctgaggagcagcacccttatattgtgccttctctgcccgggctcttagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattatatctta

SEQ ID NO: 413 - DNA, 49750 bp, Homo sapiens
agcactgctgggctggagacggcgggagccgctgctctccggctgagggaatcagagacagctccgtccctagtggagcgcaggggaggcagaagtcatgacaggcgaggtgggttctgaggtgagtttatgcacacgccccccacgggggcttagaaggccgggcaccgagaggttaggtggggccggggtagaccccgctgacccgaggcgcccgggcgggaggactgcggctcccggcgttcgccgcgccggctcccgcggcctcgagactcggccgggatgggttccgaccgggcatcccgtcccgccgccgggcttcccgcgcttcgggctccgtggccggagagctccaggtctctgcggcgcgcactgccggcagcccagcccctcttcagccggttcctgccgccagccctcccctttggcgcgtttcctgtcgcggaagctcctcccctcagggtgctctgaaagccgggaggctctagccgaacccggccgcagcggtgcggggggattctccgcagagagagggcgagcgagggtgttagggagttccacactgggcctgggaggggccctggaggtcatcgcgcgcaggccctttgcgttttccgaccgggccccgagtggggaagtcaccgctggggctcctggctggtggctggcagctccctggcgaaattgggcatagaaaacagatgtttccagagctgtgtcctttctgggccggattcgggcaaggcactcccgccttaggagcaaaatttaaaggggcgccaaaaccctcaatcaaactcatattttaatgcaatatttttaaaaaaccaaaattaatgcaaaaactttttatgatttgatattgaacaaaatatcagacgtttaaacaaagacgagatccgaccagtcatttgcacgaccttgcctcaatcacctcaccctaattccatccctgtttccaataaactttatttacaaaagcgggcatattatttacctcatgagctgtagattattgatttaattttttaaaaaatattgcattaatgttattcattttgattactgaattttttgagacctcaccccaccctgttactggccctgccctttgacgttgctgcaaattgcctagaagataatcgtcattcaaagcagccctattccttgagctgtctggttacctaaattcggtttccacactcacaaacagaagtaatagttttactgctttggattgttgagaggatcatcagtgcatacatattaattctcagcaatcccagcacttcgggaggctaaggccggcagattgcttgagctcaagagttcgaaaccagcctgcatagaaaacatggcaaaaccccgcctctacaaaaaaaaaaaaattagccgggcgtcgcctgtggtcccagctactcggtcccagctactcgggtggctgaggtgagagaatcctttgggcctgggaggtcaaggctgcagtgagccatgatcctgccactgcactccagcctaggtgacagagtgagacactgtatcaaaaaaaaaaaaaatttgtaccttgcattcaaatcaatttaataatttttttttttttgagacggagtctcgctctgttgcccagactggagtgcagtggcacaatctcggctcactgcaacttctgtctcctggattcaagcgattctcctgccccagcctcctgagcagctgggactacaggcacacaccaccacgcccagctaatttttgtatttttagtagatacggggttttactgtattggccaggctagtctcgaactcctgaccttgtgatccacccacctcggcctcccaaagtgctgggattacaggcgtgagccaccatgcctgaccaatttaataattttttgagaaaccactcagctgaggccttgtgccctgttacattactgatgttcatatttctccctttattaataagttgattcagagccctgagaacactaaggaggtagacttggcatctagggttagctttaaggtcactaactgatcaagtcacctaacacacccctcctccttaggtttttatttgcgactttttaaactgtcttatttagaaattttcaaacctatacaaccgtagaaaggatggtataatgaacccatcaccttacttcaactacagtttgaatatctctcgtctgaaatgcttgggaccagaagcgttttgaatttcagattcattttggattttggaatattcgcatacacataatgagatatcttgggggagggacccaagtctaaacatgaaattcagttatatttcatatataccttacacacatagtctgaaggtaattttatacagcattttaaaataatttcgtgcatgaagcaaaggttttactgcagctcatcatatgaggtcaggtgtggaattttcatctagtggcatcatgtcagtgctcaaatattttggaattgggagcatttcagattttcaggttagagatgttcaacctgtattttcaagtcatggccaatcttgttttattcatacagctacccatttttcctctcacaggattatttggaagaaaatccaagatatcatattatttgaaccacaaagattttagtgtgcatatctaacaaacaagagctttccaaaaatagatactacgatattattaccacacctaagaagtatctagtcagtgttcagatttctttgactcagagatatttcatttatttttatatgccactttagcataattatttacatttttagttttttgaatcatcatccgaagttggcattttgtaattgtttatattatatatgtgtatatatgcatatatgtatgtattttaagatatacatacatatataaagcatacatttatgtatatagaaatatacagggccggttgtggtggcttacgcttgtaattccagcattttgggaggctgaggcaggcggatcacctgaggtcaaaagttcgagaccagcctggctaacattgtgaaaccccgtttctacaaaaaattagccgggcatggtggcacgcacctgtaatcccagctactcgggaggctgaggctggagaatcgcttgaacccaggaggcggaggttgtagggagccaagatcgtgccattgcactccagcttgggcaataagagcgaaactccgtctcaaaaaaagaaaaaaggaaatatacatatagccgggcgtggtggctcacgtctgtaatcccaccactttgggaggctgaggcgggcggatcacctgaggtcaggagttggagaccagcctgactaacatggagaaaccccatctctactaaaaatacaaaattagccagacgtggtgacacatgcctgtaatcccagctactcgggaggctgaggcaggagaatcgcttgaacctgggaggcagaggttgcggtgagccgagatcgcgccgttgcgctccatcctgggcgacaacggcaaaactccatctcaaaaaaaaagaaatatacacatagcatatagaaatatacatacatatataaatatatagaaatatacatacgtacacacatatatacattcacttatgtgttaactttctttataggtttctctccctctcttttttttttctttgcaatatattgttaaagaaaccggccgggtgcagtggctcatacctgtaatcccagcattttgggaggccgaggtgggcggatcacctgaggtcaggagtttgcaaccggcctggccagcatggtgaaaccttgtctctattaaaatagaaaaaattagctgggtgtgttgatgtgcgcctgtaatcccagctactcaggaggctgaggcaggagaatcgcttgaacccaggaggcagaggttgcagtgagccgagattgcaccactgcactccagcctgggtgacagagcgagattctatctcaaaaaaaaaaaaaaaaaagagagagagagagaaagaaaccacccagtttgacttgtagaatttcccacgtctagattgcatatctgtggtattattcaacatgttcccctattccctctatttcctataacttgctagttagatctagagacttgataggattcaaatttgattgttctgtcaggaatactttatggctagtattgggtacttctattaggcagcacataatgtctggttgtttctcttttggtgatgttagcagccattaatgataattgcctaggtctgttatttaattgagggttgataaaattgtgataatctaattctatcatttattaattcattaggatatttctctaaatagaaacttcccctcatcaattgtatggatatattggggaacagttcacacagaaaaggcataataaatgcttgattcttttcatttttttttttaccgttactaaaagagttggttctgttagcatccttcaaaggtgaaaaatgaacttttgtttgtttgttgtccagtaattctaaatgtcatcccttcaaggaaccattgtatttggttctttccttagttcaggttgatgatcccacgatgatttgtgtgtcattatgtacttggagctttcggtcacctgctggttgatataaagtatattgtcattttctaggttcacctagaaatcaatgacccaaacgtcatttcacaagaggaagcagatagtccttcagatagtggacagggcagctatgaaacaattggacccttgagtgaaggaggtttgtaatagtacttttatttttaggaataggttgcgggagcctcagttgtaagtagattggattgatttcattattctcttgatttattacattattaatgccccatccttattgtttgttttattataaaagcaaaataacagtgcttgtacctttttgaaactatgttatattgttgaatgtctaatagctaccatattgcctggttaattgcattcatcctataataaaaggaattttaacacctgccggaggttagaacaactttacacattgtaaatatacgtaaaattacatttcccagtaagagacatttttcccagggaaaatgtttttcaaaatgtatttttagatttgctttgctacaatcagttcttaacagtagtcacgtaatttcacaatgttatatatcacttgtataaaaatatatttttgaggagtagtgggactaggaggaagatcaaatgatggtataattaaaagaaaattgtttcctccagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacaaaaatcaaaaggatttacaaaactgtggcagacagtgatgaaagttacatggaaaagtctttgtatcaggaaaatcttgaagcgcaagtgaaaccttgcttagagctgagtcttcagtctggaaactctacagactttaccactgacagaaagagttccaaaaagcacatacatgataaagaaggaactgcaggaaaagcaaaagtaaaatcaaaaagaagacttgagaaagaggagagaaaaatggaaaaaattagacagctaaaaaagaaggaaacaaaaaaccaggtacattttaaagaataatttgctattgcttgggtaggttaacattttagaaaaggttgctgttagtacttgaggttgtttctgctctctgactattgctttgaattgactattttgtgttgagaattattctcaataggtatgtgatttaaaactaactggtcttggccaggtgcagtggtgcatacgtctaatcccagcactttgggaggctgaggccagagggtcacttaagcccaggagttcgagaacagcctaggcaacagagtgagatcccatctctacaaaaaatttaaaaattagttgggtgtggtggccgtagtcccagctgtagtcccaactacttgggagggtgaggtgggagaatcacttgagcccaggaagtcgaggctgcaatgaagctgtaattgtaccactgcattccagcctggatgacagagtgagaccctgtctcaaaaaaaaaaaaaacaaaaaccaaaaaaacaaaacttattggtcttattctattttgggtatgcagaggacatttccaaataaatgggtttctgattttctttatgagcacatggagtaattctttgctgtctctgagctgatgaaaattaactgaaagaaggcttttttatgcatctatcagtcagtagtcttgtttgctaactagaaaaaccatcctcaaatttataaactagttgcttaacaagtattttacttcaaaaaaatatttactgtttattaagttagttttagacagttgcataaaatcacaacttggacttcaaaggatacatgtgagttagaaaccagtaagaatgttctagattttatatgcttgtctgttgatgaaacatgggctttttctggcctgatccaaattgccatatgatgttgtgaaatactggatttttaaatgattggattatgctttttgtttatgtattacttaggaagatgatgtagaacagccatttaatgacagtggctgtcttcttgtggataaagacctttttgaaactgggttggaggatgaaaataactctccattggaagatgaagagtcattagaatcaataagagcagctgtaaaaaacaaagtaaaaaagcacaaggcaagtaaagcatgattgcaataagagttaatcaactgcttctgacctttgctatatttttaatttactgttggaaccttaattttttttttaactgaagaaaaacttgtgtcagttgacttaagtgtttcagctgttaattttggagacttgcagtacaagtgatagacatgctaacttctttggaaactagtgttttgttattacccttttaggaatgctgaaaaaaaaaaccactaagatatttgatggtgtagtaagatgcaggtaaataatagggaagagatgtaaattttgcaatcctatagcctttgagaaatgaaccctatagggtttcaggaagggtatcaaagagaggcatcagtcaaaacattgttgtcccgagtgtttggaagcataatttttcttcctaagatttttttttagcttcctgcgagttattatccctctttagggaaagatgtaagcagaggtaaaagaaataagggtccagactccatctgaggtatctgttttctaagcataataggatgctgtgtgtttaataatttctagttgatgattattgatttattaatgtagcatgatgtggtgttggactacaaaagtagtcttcagctaaagcatcctcttatttgaatttcgtttttgtcctaatcaacctgccatttcttttagaaaaaagaaccatctttggagagtggggtccattcatttgaggaaggaagtgagttatcaaaaggaaccacgaggaaggtgaggtagagccctgtatattagtcacactgatctctttacacaggagattatagatttcttagggataaatattttattttgtctatcatatttttctgttacccatcatattgctttgtacatagtaggaacaaaatatggattggattgaacaaattctctgagacttgggaataaatgaattccttgagtttatactgcatttgggcttactcatgcttactatttcctttcctcttttcttggagagagcaaactcttgagtgatgaatatctatctttctggatattcatataattaatgtagtctcacttcttgttttctttaaggaaagaaaggcagccagattaagtaaagaagcattaaaacaactgcatagtgagactcagcgccttattcgaggtaatgcaacccagtaaactttgaggcaaaatcacaacatttctttgtaagctcaacttggatgttggggacttttatttttttaacacttctaatgtgaactcaggttataatattaagtttagaattgatcttggtgaaaggccattgttctaaagcccttggaacattagtataaactgaagaaattttcagaactgtagtgcaggtaaggaggaaattttttaatggttgtctatggactgattgtgtcaggattctttggagaggtagtaatccctccctatttgcagttttggttacctgtgtcagccatggtccatggaacttaaaaatatcatccctttgtccagagtatcacgctgtatacattacctgcctgttagtccgttagtagccctctcagttatcagatcaaaaaaacactgcatggtttagtaccatctgcagtttcaggcatccactgcaggtcttggaatgtgtctgtctggataagcggggactactgtatataaatgtttaggtcccacagagattctgattcagtagattcgaaatgggatccaagaatctgtatttctaaaaaacttcctggatcattttgatttcacatctaggtttaaaagccactggtcttcagggagcttttttgtacttagctcctctgcctttgttaaaggggagttttctatttctagtgatggctttggttattatgtttagttaactgaatatgaagtgacatttcagaatatacagtatatatatttgcttgttttattccattttatagagtctgcactgaaccttccatatcatatgcctgagaataaaaccattcatgatttcttcaaacgtaaaccccggcccacttgccacggaaatgccatggcactattgaagtaagaaccctctttccttattataattttcatgaacatttagttttgtagcaaacatctggcataaaaagttcagatttctcactcccttaaaactgatttaactgatatatactaagggatgagaatgtttcacatttaggataattttcaactccagctcaatttctcttctctaggtcatctaaatatcagtcaagccatcacaaagaaatcatagacactgcaaatactactgaaatgaacagtgatcaccatagtaaaggttctgagcagacaacaggtgcagaaaatgaagtggaaactaatgcactccctgtagtttcaaaggaaacccagatcattactggatcagatgagtcttgcaggaaggatttggtaaaaaatgaagagctagaaattcaggagaaacagaagcagagtgacattagaccttcacctggggacagctcagtgttgcaacaggaatccaacttcctcgggaacaatcacagtgaggaatgtcaggttggagggcttgtagcatttgaacctcatgccctggagggtgaaggcccccaaaatccagaagaaacagatgagaaagtggaagagcctgagcagcaaaataaatcatcagcagttgggccacctgaaaaagtgagacggtttactctggatagacttaagcaactgggagtagatgtttccattaaaccacggctaggtgctgatgaagattcctttgtgatacttgaacctgaaaccaacagaggtaatcctttacattgtggggagcctccctggagtgattatcctggtagcttttgattattgactactgtcgaggacagagaacacaggaggaaccaataaccactttgatcttatcctgcagttgttccagatatgggcagagtcttttttagagaaatttggcagggtatcagaatgatctaagccatgtttaaaatggaagtctgttggctgggtgcggtggcttacgcctgtaatcccagcactttgggaggccaaggcgggcagatcacgaggtcaggagtttgagactagcctggccaatacagtgaaaccccgtctgtactaaaaatacaaaaattagccgggcatggtggcacgcatctgtagtcctagctactcgggaggctggggcaggagaattacttgaacccagaaggcagaggttgcagtgagccgagactgcaccattgcactccagcctgggtgagagagcgagactctgtctcaaaaaaaaaaaaaaaaaaaaaaggttgttgatagttaatataaaaaagaggtacattgctactgtgttatggtatttaggaatttattatttctgcctttccaatctgaaattaagttttttctgtaatcctgagtcaaatcttaagacattgatgaaaacatcatttagttttttactgctaaagagaaacattttggttcacttaaattatctgtgaaaccgaatttcttttgttttcactcattcaacaaatattaaagtatctactatgagtaagttgctgtggggcataccaagataaatctgacatttaaggtatacttaagatgcttttactctaatgggcgagataagaagtatgcaaataagaagtacaaaggagaaaatggtaaatgatgtctttgataatgaatatgtcattgataattggaaaataaataacatgaagaaaaaggaaaagtattttcttaaagaacatttagaataaagtactgtgggaattcagagaagcataaatttcttccaatgaatagttaaaagacagcctgaagaataggtggattaattacttgttcactgccttccctttatactgtgagttggtatcttctgccttgttccctactctatccctagtgcttcctcagtggacgacacattgtaggcacttgtatttatcaaatgaatgaatgatccctcaacactgaactcaagtattaccacattgaataaatttcctgactcttagatagagctggatgctccccactctgccttgaggcagtatggaatggtggttaagagcttagactttgtagcaagaccaggatttgaatctgaactagcatagtaattgtttaacattgtatacgccatttgacctcttcaagcatcttttgtttaaaaaagagaagaaagccagacacagtggtgcacacctgtagttccagctactcgggaggctgaggcacaagagggtcacttgaacccaggagtttaaggccatcctgggcagcatatgaaatcctgtctcaaaaaaaaaaaaaaagaaaaagaaaaaagcactatatgacttgtgggctatggtgaagatttgttgaaataatgcatgcaaatggatagtataaacaagcactcaaaaagttgttgctgcttctactattattagtgaaatggttcacatcaagactttttttttttgagacgggctttcacttgctcttgccacctaggctggagtgcaatgctgcgatctcggctcactgcaacctccgcctcctgggttcaagcaattcttctgcctcaggctctcaagtagctgggattacaggtacccgccaccacacccagctaatttttgtatttttagtagagacagggtttcaccatgttggccaggctggtctcaaactcctgaccttaggtgatctgcctgcctcagcctcccaaagtgctgggattacaggtgtgagccactacactcagccaagactctttcattaaaccaagcatagtcagtggcttatgcctgtaattctagcactttaggaggctgaggtgggaggattgcttgagcccaggaggtcaaagctgcagtgagttgtgagctgaaattgcactcctgcactccagtctgggagacagaacgagaccctgtctcataaaaaaaaaaaaaacacaaaaaaattatctttcattaaacatcttattgttggcaggtgctatgtcagtgactatatctggtgtgtaaaatatgctcagtgagtctgttaattgaatgggttgactttggagatggagaggatagaaagagcaccttgtctcattaaaacaaaaagaaaaacaaaacacacacaaaaaagattctgtttcattaaacagcttattgttggcaagtgctatgtcagccactgtatctggtgtgtaaaatatgcttagtgagtctgataattgaatgggttgactttggagatggagagaaggacagaaagaactctgcatggtggtgcgtattgggaagatgtgaaagtcactttgaccagggctggaggttcaggtggcagagttgtataacagaactagcatagctccattagcaaagaagcatgagaataagctgttgtccggaacactgagggaaagtttttgttatatgggactaaaagttacctaaacagtcctagactgataggaaagggagaaacattttttgagtaccaactatattagacactggtacattctttgttagttgtctttcttaattctcacagtgccaggtattattttgcaaaatgaagagactgaggctcagagaggttaggtaatttttccagcattatacttggcttataaagggacctacacagtggctggcatataatgagcacttattttttaacttggaacatgttttcctttagaaataattgacacgaaatttgggtttccagaccagccataatatacatgaagttagaatcaacattcattcattcattcatgcaataaacttttatttagcactgtgttgggtgctgtgtatacacgtaaaacactccctgctctcaaagaaattgaagtgtaataggagtgatagacaggcaaacagaccattacaatactggatggtaagtgctgcgatcaaggtatataattgagggtgcattgggaacctagaggaagggtaccttacttggagcctagaagtcagggaagtttctgaaatgagctcagtagagataccaaggcagagaggtgagggagggcttttttggtggaggggttggacctgcagatgtcagagacaatggaaagcacagggtgatctccctggctgaagtgaagatagcaaggacattggtgatcagagcccagatcattcagggtttttatgccatgctaggagcttggactttagctctttgtaagtagaggaccactgaaaggttttcagcaaaggaaatgttcaatcagatactcactttaggaagttaaatctggtagctgttgtggtggatgcattggaaggggttaagagtaaaaacagtgggaacagctcagtttctttacctcatatagaataaggtttccatgagaaaatgcatgtaaatttaaattttgtgatgtcagaaatacattatttctgttgcttgcaatagcatatggaataatccctgcctctaattcctctactttctggacaagagcaatgtgaatgagaacagttcttatgctgctgatagagataagctaggaaagagacttttcacttaagagaggagatgagaggtgatggaggatgagaggtgatggactaatagagatgaatggaggtagaggaacttgaacaggggttttaggatgaagacagtgatggttgcatcatgtaataaaggccaaagaaagtggttgctccaatgggttgggggaggaagagctttgaggatcctagctttctccagttatgaatgaagatacctcttgcctgactactattttaagtcccaggtaatcttcccacccaaccatttctcttaccctagtggcacccataataacctgcctatttctgttcccttttccctgctaccacctgttgctttcagctttactgaaccactgcaaaataggaggcagacttacagcttgtctctctactcttttgtttgcaatgtaaacataccatcctttagagttgggtttttgctgctaataatgttggggtttcaggataaaaagatttccttcatttttctctttttctagtaagaccgtctagaggaaaaaaacacatctagatgctagtcacaaaaacaccgaagtatgatttgagtgcattttagaaaattagtcaagtttcatgcctatagtcccagcactttgggagactaaggtgggaagttcgctttgaggccaggtgtttgagaccagcttgggcaacatagcgagttcctgtctttacaaaaaataacaaagccagatgtggtgacatgcacctgtagtcctagctacttgggagggtgaggtaggaggaatgcttaaacccaggaggtcaaggttgcagtgagctgtgatcgcaccactgcactccagcctgagcaacagagcaagaccctgtctctaaaaagacaaatgaaaagtggctgggcacaatggctcacacctgtaaccctagcactttgggaggctgaggagggtggatcatttcagtccaggagttcaagaccagcctggacaacatggcaaaaccggtctctacaaaaaatacaaaaatcggccagtcgcagtggctcactcctgtaatctcagcactttgggaggccgaggtgggtggatcatctgagatcaggagttcaagaccagcctggccaacatggtgaaaccccatctctactaaaaataaaaataaaaaaattagctgggtgtggtgacgcatgcctgtaatcccagcttctagggaggctgaggcaggagaattgcttgaacccaggaggtggaggttacagtgagccgagatcatgccactgcactttggcctgggcaacagagtgagactccgtctcaaaaaaaaaaaaaaaaaattagctggatatggtggtacatgcctatagtcctggctatctcaggaggctgaggtgagaggatcacctctaagcttggggagattgaggctacagtgagagccaagattgcaccactgcactccagcctgggcgacaaagcgagactccatttaaaaataaaccattttatcatggacgagaaggccgcctgaaaatatccagtgtgcatcaactccaaaggaactttctccttaaaactgccagctctcatcacagattccattatgatatgaagtgttaagcagagtgagtagggattggttccaggtaacagctagctgagggagaaggaaattctaagatattgcagtggggaagaggggtaagtttatatcactattggattgctgaacttactgttcccagtatatatatatttccgtttgtatacaagttgagcatgtggtactggggctgcagtattttctttctcattgtaccaattgtactagtgtaacagttttcaccaaaaaactttttacagtcctgctgcttagttatatcactgactggattgtcattttattttcccttcttgaaaaaaattgactttgcctatatttagtaagattgccaataatgaaacattcaaaatagggaatttgatcccagcactttgggaggccaaggtgggctgatcatttgaggtcaggagttcgagaccagcctggctaacatggtgaaaccctgtctctactaaaaatacaaaaaaattagctgggcatggtggtgctcacctgtaacctcagctactcaggagactgaggcaggagaatcgcttgaaccctggagatggaggttgcagtgagctgagatcacatcactgcactccagcctgggcaatagagtgagactgcatctcaaaacaaaaacaaaaaacagcaataacaaatagggaattttaaaaggagaccaaaacccatgaaaaattaagcccttgaatagatgagattataatcttttttcctaccagtttaatacttttaaagaatttttaaagaatgttcaaaagaattgcacatatttagaaatttcaggtataaatttctgtctgattttttaaagtctgatttttgaaacgttgaggaagaacagttgtggcagtcaattagtttgggttaagttgtatgaatttgactcaggagttagtagcaaggggtttttggtttctctgtgtatgtgtggtttccctcataattgttgagctaaaaaaaacttagcttataagtcttaaaggaaagagttttgagcatggcaaactgacacactggttggcgtttgggtttagaactggaagccttgaagcagcgtttctggaagcatgctaatccagcagccaaacccagggctggtcagacagtgaatgtgaacgtcatagtgaaagacatgggcactgatggaaaggaagagctaaaagcagatgtggtacctgtgactttagcacctaagaagttggatggagcaagccacacaaaaccaggtatttgagcccacaggttttgttttttgctttttgctttgtattctaacagatcttcaaggctattgaaaaccttataatgaaaagttatagaatctttttccttggaggctttgcagagcagtatctctggcatgattcacgtgtagcacacctagaggtgtggggtggacaagctggctttattttttttttagatatcatttgtcttattataaaaaaccccattatagacaaatatatagaataaatgaaaaacttaatcttctatcagagacaggttctataaccatatcgtgtatccttttaaactctcttctttgcacatatgtatatgtaatttaaacaaaaacaggctgggtgcagtggcacatgcctgtaatcctagcactttggaaggacaaggcaggaggatctgttgagctcaggagttggagaccagcctgggcaacatagtgagccctcatctctaccaaaaaaaaaaaattatccaggcatggtggcctgcacctgtggccccagatacttgggaggctgagacaggaggatcatttgagccaggaggttgaggttgtaatgagtcatgattgtggcactgcactccagcctaggcgagagagtgagaccctgtctcaaaacaaaaaacccaaaacaaaacaacccacctataatgtgatcataacatgcattctgctttgtgttttagaaatgtattaaggacagctctcacccctcccttgaaatcacaagtaatatatcacatggaaaacagttttaaacactgaaaaaaggtatcaaatgaaaaactagtcttcccaaagataactattaacaatttcttgtatgtctttataggagtatttttatccatataccgtattttgtgaatgtgtgtgacattgaacatttactccctgtcaggcattgctctaggtgctttatatgttttatctcatttaatccttacaaccctatgaggtaaataacattagtatccttattttgtatatgaagaaactgatatgcagagcacttaagacacttgctcaagtttacacagctaataaatggtaggaccagtagtctaatccagaccacctaactccagagctcagatctactttatattgcttttgaggcttttttttttttttttttttttcctctaagacagagtcctgcactgtcaccctggctggagtgcaatggcacgatcttagctcactgcaacctctacctcctgggttcaagtgattctcctgcctcagcctcccgaatagctgggattacaggtgcctgccaccatgcctggctaatttttgtatttttagtagagatgaagtttcgctatgttggccaggctggtctcgaactcctgacctcgtgatctgcccaccttggccccgcaaagtgctgggattacaggcgtgagtcactgcgcccggccttgaggctttttttaaaatggctgcataatattccattgaatgaatacaacatgactcattaaaccatactcgtattgacagatgtcttgtttgttccagttgttgctattgcatacagtgttatattatagtgccagatatatggtggtatattagatgaaaattccttacagtggaattgtcatgatatatatcacattttgatatatatcatccagttgtctttcagaatggttgtaccactctgaatcacagtgtatgagttcctgtttcctctcaataggtattatcaaaccttctaatttttgccaggctaacatgtcgaaaatgtatctcgttattttgatttgtagctcttcaattagaagtgagattaagcattacttttaatttattaacaatatatgtttatttttcgtgaactgccagttcatatcattagctcattttactcgagtcgtttctctttttctttaatataggtaaatttatcaatgtttttcttcatggcttttgagccacagacttgaagctctactccctacccaccttttctctcttttgaacaattattttataatccctgagtagtatactatctagggtgcagaagttctctttgatacttcaattcataataatactcttgtgttcaaataacaaaaaagcccagaatactagagtctcagattttccttttgggatgtgactagaatatttctggagttgcctaaaatgcatacctaattattgtattatgtctaaagcatttctacatatttctgttcaggtgaaaagcttcaggtgttaaaagctaaactgcaagaagcaatgaaactccgaaggtttgaggagcgccagaagcgccaagcactgtttaaattagataatgaagatgggtttgaggaagaggaggaggaagaggaagaaatgacagatgagtctgaggaagatggagaagagaaggtagagaaagaagagaaagaggaagaactagaggaagaggaggagaaagaagaggaggaggaagaagaaggaaatcaggaggtttctggcaattacgttgttttgttaccttgtcatggtgaatatgagagaaaaagtcagacttgaaaaagagtataataagcatgttcaattgtataagaggttttaggggcatgatgagggtaactacctcatatatccctaaatcttaggaacttcagttctgtcagtaccactgaatatctgtagatcatcattatatatctgaatacagatattcagtggtactgacagaataccattgcctgggcttccacctgtttatatattttaatataataatgctaatattaaaaatggctttgtattcgtaggaaattttatctttgttgtttatttaggtttctctagcagattaaaaagcagtcctaaccttggctagattgaggcctggagtaaattcttagggaggtagaggcctttctgagttattttcgttctttgtagaagaaggcatttgtagaagggcctcttgcccttgttccgtagtactgttttctgcctagggaaaacaggtgatgatacgattgttaagtattaaaaaactttcctttttgggccgggcagggtggctcatgcctgtaatcctagcactttggaaggctgaggtaggtggatcacctgaggtcaggagtttgagaacagcctagccaacatcgtgaaaatccatctctactaaaaatacaaaaattagctgtgtgtggtggcacacacctgtaatcccagctactcaggcaggagaattgcttgaacttgggcagtgaaggttgcagtgagccaagattgtgccactatactctagcctgagcgacagagcaagactgcatctcaaaaaaagaaaaaaaaaaaaaaactttcctttttgtatgctgggatcactttattttattttattttatttatttatttaaatttttttgagatgagggtctcactatgttgaccagactggtctcgaactcctggcctcaagtgatcctcccatcgttgtggcctcccaaagtgctgggattacaggcatgagccaccatgcccagcaacttgagttattatttaattttgggtaaaggagaaagaaagcaatggctgagctatacagcctgtctcagtctgtgcttggtttgagatcagtagtcagcctgcaatcttagactgattaattaacctcttactgcctcaataaaatgataatccagtcgtcctttataatcttagcaatttcgggagggtagaaggtaaaaaaaaaaaatagaaaaaagttctagaagtgtcagggaaaattatgttgataatggtcatatggaacttccttcaagtttacctttttgaatttaagatgtgatctgtaaccaatcagccatatttcaggctaccagtgtatttgcttttaaatgttttgacttgtattttttgttttgtggtggcctgattggtaaagactgcagaattccttcttagtagtgaagaaatagaaacaaaagatgaaaaagaaatggataaagaaaataatgatggcagtagtgaaattggcaaggcagttggcttcctctctgttcccaagtctctctcatcagattctactttacttctgtttaaggacagctcttccaagatggggtaagtgattctctctaagaaaacttaaaattgccttggatttgcccctcctgtaaaaactaggaacagatactgaaccaatttactttcttattttgcagttactttcctactgaagaaaaatcagaaacagatgaaaactcaggcaagcagcctagcaaactgggtaagtagtgattcttgtgcagaacttaacatttcttttgtccctcagctttgatatttaaggactgcagtacggtaagtttccatgtttttaaatctggtcacttcccagtttcatatgtagctatgaaaagggtttatgaattagaatatttttcttggtctattttttgcagtttatttatagtagaccatggtacataatgtccttagtgaatgtgtgttgattgagtgagcaatgaaatgtttctgtatgtagatcaaaggaagacgtataattgattggacaatgaagagtgtgatcataggcattaggaaggataagagaaagaagagaactttcggccaggcgcagtgactcacgcctgtaatcccagcactttgggaggctgaggcaggcggatcatgaggtcaggagatcgagaccagcctggctaacatggtgaaaccctgtctctactaaaaatataaaaaattagccaggtgtggtggcacgcgcctgtagtcccagctacttgggagggtgaggcaggagaatcgcttgaacctgggaggcggaggttgcagtgagccgaattcacgccactacactccagctggggtgacagagcgagactgtctcaaaaaaaaaaaaaaaaaaaaaaaaagaactttcaagtgtcacttagctcagagtaataagccctgattatataatgctatcttagtactgtaatttacctttaacttaatgttttggaacatataacttgaggggtttgcctatgaattttatctgacagtttcatcctcaactctttttcctaaacaaatccaccttatttctgtaatcatgtgcttaaaaggtgtttctctttctttagatgaggatgattcatgttcattgctaacaaaggagagcagccacaatagcagctttgagctgattggctccacgattccatcctatcagccttgcaacagacaaacaggccgtgggaccagttttttccctacagcaggaggattcagatctccttcccctgggctatttcgagccagtttggtcagctcagcttctaaggtaagatggtaatggtttttctaatctcctcctctctttgcttcccacattgctaaataaagtttgtcccagccaaccaactcccaccacgttggtactgagcttatgtgtgttcagtttaaaaaatccaccccctttgtgtattaaaaacaagcttcatccagtattcttactttcttggaggtatttttctttatgcttctcatggctgtgtattgtccccctcaactacaatttcctgagagtagcttaaatattgcaaatagcaacttttgtggttgtcatgacaatgactgacatttgtaaaatgttttgttattgtttgtttttgtttgtgtgccagagttcagggaaactgtctgagccttcacttcccatagaggattcccaggatctgtataacgcctccccagagcctaagacacttttcctaggagcaggagacttccagttctgtttagaagatgacactcagagccaactgttggatgcagatgggtaggtagttttgtgtttctgtgggcgggaatggtgctgggtactgcttaattttgtttaaaaataagtgagcttctgtcactccatctgtgctttctcttctgagaaagagaaggtgtacagaccattagtattacattctataagtttgaacaaagtctgtccagaaaataaacataaatagctcttgctaacattctggtccttcaatttctgtcttatttgaaatgcatagatcttgtattgtaaggtcatcaaatttccctgtatccatcctgctatgttattattgttgggtaaggttgagaattcacagactggtggcacattacaggacataatgccaagccctgctctagcatcatctgaagctaaaagttatcctttacactttaccttctgagtaacattttattctttcacaaaacttttccctccctctttagattaacacaagcctaaagtttgaatcttttgctttctggtttgagattcagcttttaactggtgtaggaaatgaattcagaggtttttcaccccctactttgccatttctctgaggaatttttttttatttttttttttgaggcagagtcttgctctgtcgcccaggctggagtgcagtggcgcgatctcggctcactgcaagctccacctcctgggttcacgcccttctcctgcctcagcctcccgaatagctgggactacaggcgcccaccaccacgcccggctaattttttgtatttttagtagagacggggtttcaccatgttagccaggatggtcttgatctcctgacctcgtgatccgcccgcctcggcctcccgaagtgctgggattacaggcgtgagctaccgcacccggccctctctgaggaattttttacactattcgttgtgctcattggttcttaggttcttaaatgttagaaaccacaggaatcagtaccaagctttgaagcctcgattgccattggccagtatggatgagaatgccatggatgccaacatggatgagctgttggatttgtgtactggaaagttcacatctcaggctgaaaaacatctacccaggaagagtgacaagaaagagaacatggaggaacttctgaacctttgttcaggaaaattcacttctcagggtaaatatccaaccgagagtatcaagcttaccacacccaagtatcagtgcccttgaaaagaattccctgggcgggtggggtggctcatgcctgtaatcctagaactttgggaggctaagttggatggatcgcttgagctcagaagtttgagaccagcctgggcaacatggcaaatccccatctctacgaaaaaaaaaaaaaaaattagccaggcatggtggcacgtgcctgtggtcctagctacttgggaggctgaggtgggaggatctcttgagcctgggagatgaaggttgcagtgagctgagatcacaccagtgcactccagcctgggtggcagagaccctgcataaaaatagaaaaaaagaaagaaagaaaagaagccccttaccctcaggtgaaaagttcacagaaaacagggctgtgatggaatctgtgtataaactgaattcactgcttagtgccctgatatttagaactcttactttcttagagtggtaaagtatcaacttaagactactttaggccgggcgcagtggctcacgcctgtaatcccagcactttgggaggccaaggcgggggatttcctgagctcaggagttcgccaccagcctgggcagcacggtgaaaccccgtctctactaaaatacaaaaaattatctgggcatggtggcccgtgcctgtaatcgcagctacttgggaggctgagacaggagaactgcttgaaccccggaggtggaggttgcagtgagccgagattgtgccactgcactccagcctgggcaacagagagagactgtctcaaaaaaaaagtcttgaaaaaaaaaaagactgctttagctttgcccatatatcatttatgattaatgtatgtacaaagtttagaacagtgtctgatgtataataaatttcatataaatgttaacttacttcctgttccctgcccccaatacacacaactgctagatcgaacataagctctatgagacctgggatagtggtttgttcattactgtatccctggtggcctggcacatatggcacatagtaagcactaaataaggatttgttgaatgaatagatggtaggctcttcttggcaagcttaccttagaactgtatcgagctggcatgactttagatggctgggaaaagagtataaagctatcattccttggtgacacatcttttccttgttgtgatgtagatgcctccactccagcctcatcagagttaaataaacaggagaaggagagcagcatgggtgatccaatggaagaagcacttgctctttgctcaggctcttttcccacagacaagtaagtctcagattgctgggaatttgggaaggcctggccttttgataaaatcaaaataactgatcatcttaagggctttgcaccttttctgagaatcttgcagtggatttgagtctcatatatgcctagtaagcaaattataatgctttggtggagaacagggtaaaaaaggcaagaatatgaaagctatttaatatcattaatagagaaatgccaatcaaaaccatagtgagacacccattaagatgacttttatcagaaaaaccccaagagtgttagtgagaatgtggagaaattggaaaccttgtgtactattggtgagaatgtaaaatagtgcagctgccagggaaagtatgatggctcctcaaaaattaaaaatagaggccaggcacggtggatcatctgaggtcaggagttcgagaccagcctgaccaacatggtgaaaccccgtctctactaaatacaaaaaattagctgggcatggtggcgcatgcctgtaatcccagctacttgggaggctgaggcaggagaattgcttgaacccgggaggcagaggttgtagtgagccgagatcatgccattgcactccaacctgggcaacaagaacaaaactccgtctcaaaataaataaataaaaatagaatgaccatatgatccagcaatttcacttcttagtctgtaccccaaaaaagtgaaagcaggacttgaacagatatttgcacccccatgttcaaagcagcattattcacagtaagtagtcaaaacatgaaagcgacctatgtttattggcaaatgaatgggtaaacaaaatgcggtatatatgcaaaggaatattcaacttaaaatggaaattctggctgggcatggtggctcacacgtgtaatcccaacactttgggtggctgaggtgggcgcatcacttgagctcaggagtttgagaccagcctggataatatggcaaaaccccatccctataaaaaaaatactaaaattagctaggcgtgtgccggcagtaccagctattcagggggctgaggtgggagaattgcttgagcctgggaggtcaatgctgcattgagccatgattgtgccactgcactctgggcatcagagcaagaccctgtctcaaaaaaaaagaagttctgacacttgctacaacatggatgaaccttagaatgttatgctaaaagaaataagccagtcaccaaaagacaaatactgtatgagtccacttacatgagatacttagagtagtcaaatgcatagagacagaaggtagaatggtggttgccagagactgaggttataaggaaatggagagtgtaatgggtatagagttttagttttgcaagctgaaaagagttctggagattgcttaacaatatgaatgtacttaacactacagaactatagaaagatcgttaaaaaggcaaattttatattatgtgtattttaccacaattgaaaatttaaaaaattttcttcctgtttattgaagagattattggtgataataaaagttttaaatttggctgggcgaggtggctcatacctataatcccagtactttgggagcccaaggcaagcagattgcttgaatccagaaattcaagatgaacctgggcaacatggtgaaatctgtctctacaaaaatacaaaaattagctgaacatggtggcttgtatctctagtcccagctactcaggaggctgatgtgggaggatcacttgagccctggaggtggaggttacagtgagctgagatggtgccactgtattccaggtggtgtaagagaccaagactgtctcagagaaaaaaaaaaaattaacacacacaaaattttttttaattcataacttggctgactacttgtagtttgctttcaacaacttatttattgattcattgatttacattttagggaagaggaagacgaggaggaggaatttggagactttcggcttgtttcaaatgataatgagtttgatagtgatgaggtgagtatgaagggaacaaagtaatcataactgagctccatgtattgctgccctcaagtgtttttttcccctcagttcttgagaattctaagtttggcatcttatcagaaacaatttcctagaatgaggtatttgggcagatgtttataaatccttttttcattgaggacgcattttattctgcttaatttggatatgatgctgattttgtaggatgaacacagtgactctggtaatgatctggcactggaagaccatgaagatgatgatgaagaagaactcctgaagcgatctgagaagttgaaaaggcaaatgtacgtgttattaatatgtccattccttcaggtgtatttaaaatttggtcactaggccaggcatggtggcttgcgcctgtaatcccatcattttgggaggctgaagcaggcggatcacctgaggtcaggagttcaagaccagcctggtcttggtgacacaggtcaagagatcgagaccatcctgacaaacatggtgaaaccctgtctctactaaaaaatataaaaattagccagatgtgatgacaggtgcctgtagtcccagctactcaggaagctgaggcagggagaatcgcttgcacccaggaggtggaggttgcagtgagccgagatcgcaccactgcatttcagcctgggtgacagagcgagactctgtctcaaaaaaaaaaaaaaaaaaaaagttgatcacttaatatgtcctgtgtgctaataactgtgctttacaggcattaacatattatcttatgccaggcacagtggctcacgcctgtaatcccagcactttgggaggccaaggcaggcatattacttgaggtcaggagtttgagaccagcgtgaccaacatggtgaaaccctctctactaaaaatacaaaatacaaaataaaatacaaaaattagccaggcatggttctgggcgcctgtagtgccagctacttgggaggctgaggcaggagaattgcttgaatatgggaggcggaggttgcagtgagccaagattgccccactgcactccagcctgggtgatagagcaagactccatctcaaaaaaattatcttatgagtgggtactattattctcctcattttacagttgaaggaactgagcctcagaaagattaaatttacccaagatcacatagctagaaggcagcagaggctggattcaacttagattaggtgaaatctcccctaacagtcagttaatagtttgccactttttaacttaaatcctcctgcctcagcttcccaagtagctgggacaacaggcatgtgccaccacacctggctaattctttctattttttgtagagatggggccttgctttgttcccaggctggtcttaaactgttggcctcaagtgatcctcctgcctctgcttcccaaagtctgggattacaggcatgagccaccaggcccagcttttttttttttttttttttttttttttgagacggagtctcgctctgtcgcccaggctggagggcagtggcatgatctcggctcactgcaacctccgcctcccgggttcaaagcgattctcctgcttcagcctcctgagtagctgggaatataggcacgtgccaccacacccagctaatttttgtatatttagtagagacggggtttcaccatgttggtcaggatggtctcgatctcttgacctcacgatccacccgccttggccttccaacatgctgggattacaggcgtgagccaccccacctggccggcccaactcatttttttgatatgctgttctggtcatgaaagtaaaatatttattttaggatatttaaaagaatacaaactgggtgcagtggcccacgcctataatctcagcactttgggaagctgaggcgggtggatcacctgaggtcaggagttcgagaccagcctggccaacatggcgagaccccgtctctactaaaaatacaaaattagccaagcgtgatggccagtgcctgtaatcccagctactcaggaggcaaagctggagaatcgcttgaaccgggaggtggagggtgcagtgagctgagattgtgccattgcattccagcctgggcgacgagagaaactccattctccccgacccccgcaaaaaaagaatacagaaagatataaataaaaacttatccatgtccaccatccaggatataaatgaaagttagtttgttccccttaatcttttttatgcatatatttttatatagttgagatttgtacaatctttctatatgtataattttgcatctttttttttctacttagcatatccagaaacattttcctatgatgttaaaaaaagttttataaagataattctaataggtatttaatattatattgtatgtgaatgatttggaattcacatataggacatcatattgatccctattagatttatatggttgcttttatcccatcatttcattctattaagattcactttgggttctaatttatcacctatcaaattaactctcatacagctttaggttatccatagatttttctaaggtagtggttcttctctgcagagctctttgttcaaataaaatcttttaaagaatgacagataaaagttgaactgttcaaagatggtaagtgggaagtttgggaaacttagtgactagtggcctctgaaggaattttccaggaactctaggatttagaacaacttagctttaagaaaatacagtataggctgggcgtggtggctcatgcctgtaatcccagcactttgggaggctgagatggacagatcccctgaggtcaggagttcaagaccaccctggccaacatggtgaaaccctatctctactaaaaaaacaaaaattagccaggcatggtggcacgcacctgtaatcccagctactcgggaggttgaggcatgagaatcacttgaacccaggaggtggaggttgcagtgagccgagatggcatctctgcactccagcctaggcgacagagcgacacttcatctcaaaaaaaaaaaaaaagagaaaatacagtataggtcttcgataaaaatcagttttcagaaagccaccaaacttctgccattttggaccacatgggaccaaggtgactttgaatccagggtgacaccagatttattctccgggggagctgaagtcataagaagtaactagtcgttttgattaccaggagctctgagccttagtcttccttctgatgtgggggtcaagatttgttaggctgtaagaagatcccagtttattacctttctacaccacaccatctctagtttgtctcttaaagctggtgtgctcaaatgcaaaatgaaatagtttgaaccttccagcaggtattctaatacatgtaaaagagattaagagttttctggctttcaaatcacccaatctaagttgaatccaggctctgctaccttctagctatgtgaccttgggtaaatgtaatctttctgaggctcaattccctcaactgtaaaatgaagagaataatagtacccattcctatgataatatgttaatgcctgtaaagcacagttattagcacacaagacatattaagtgatcaacttttaaatacagatgctccacatcttacaatgggactatatcctgatcaatccatcataagttgaaaatgcactttcatattatccagatataactccatcgtaaatcgagaagcatactaagtgcgtatcacattcatgtcatcgtaaagttgaaaaatcattaagtcaaaccatcataagtggagactattacaaaaaaatttaaatattatcaaatgtattatgtttattattattagaagtgactctgttctgcttttctttgcttccatattctgtgagtatattcattgttgcattttctaatcctcaaaattgctttctaggaggttgaggaaatacctggaggatgaggcagaggtgtcaggaagtgatgtgggaagcgaagatgagtatgatggggaagaaattgatgaatatgaagaggacgtaattgatgaagtacttccttctgatgaggaactgcagagtcaaatcaagaaaatacacatgtcagtatcccaataagcccttctgagtaatagggtacatcttaagacaagccctgtaaccagccagaatggtccttgttttgaacaccttatttctcctgttgcaggaaaactatgttggatgatgataagcgacagctacgtttataccaagagaggtaccttgctgatggggatctgcacagcgatggtcctgggcgaatgaggaagtttcgatggaaaaacataggtatcttggttgttgtctttaaaagcaatcagttacgggctgagcatggtggctcacgcctgtaatcccaacactttgggaggcagaggcaggtggatcacaaggtcaggagttcaggaccagcctgaacaacatggtgaaaccccgtccctactaaaagttcaaaaattagcaggctgtgatggcacgcgcctgtaatcccagctactcaggaggctgaggcaggagaattgcgtgaacccgggagacggaggttgcagtgagcagagatcatgccattgcactccagcctgggcgacagagcgagactccatctcaaaaaaaaaaaaaaaaaagcaaacagttacaatgcatatttgtcgagtttcagatggcaaatggcaagcaaaactataacaggctatgtgaagacctagttgtaactgttttctgttaatggatgggaaaagtttacatcattatatagtaaatgataagggtttattttttgtctgtccaagcaccctctcctgtgaggactgccgaatgctgattaccttcactctttgtttagatgatgcttcccagatggacttgttccacagagactctgatgatgatcagactgaagaacagcttgatgagtcagaagccaggtggaggaaggagcgaattgaacgagagcagtggcttcgggacatggtaggagttcacctactctgaccctagtttatgagactgtcccttagcttgtcatgatagtttcaaaatcttagcttgtcatgatagtttcaaaatcttaggcaacatattgctatctcttttaatccttgagctatcttttgtgttttgagaaggctataccatagacagttctcttcatgtttgtctaagattaatttttttttgtctaaagcagcaaaggctgcaaaaaggaaaacaaataccccaggaactctagtttcacaatccaggccatgctaactatttaggaaggttatagacttttaatgctgtatatatatatatatatatatatatattttttttttttttcaggcacagcaggggaaaattacagctgaagaagaagaagaaattggggaggacagtcagtttatgatactggccaagaaagttacagccaaagcactgcagaagaatggtgagctcttgtttctccttagggtctagccccctggattgttagtggtagagctttggaggtgactctaaccttcaggagctgttgcagcttaatcataagcttgtgtctaatactgtcttaaagaggcttcacagaggtggtgggagacagtgtacttagatcttagactattgggcagtagagactgtattcatgagtatatgtggctggttttactttatgttctaaggctcagagtagttaattctggctttctctagttgcccaggattgtatacctaagtgttagaggtaggatttgaatccaggaatatttaactccagaaatgaagctcttcactattccctacactgaccacttctgtttttcttaaatgattactgttcaacttagttgtgtctcttcttggagccaattattatagtttgaaagtcaccattatatagaacagagttcccatggctttagcatattgatttagttacaagatttcttagcttgtttagatttaaaagtaattctaatcagcttttcccagaataggcctctctgtcttttctttccagccagtcgccctatggttattcaggaatcaaagtctttgctcagaaatccttttgaagccatcagaccaggaagtgctcaacaggttggttgggaaccttgttaatctgacatcatagtctacaggttataaaggcccaggtccagcttagagaatagtctctgtcattagaggaaggaggtggctgcagggaaaaagttaatgtcaaaggagtctgctatttcttttctatttgaatagggtaggcatatgtaccctcaatatctagggggaagcagggagggaaggacttttcattctttagttggcacttgggatttgataccagatgactcttctttcctcaggtgaagacaggctcactgctaaaccagcccaaagctgtgcttcagaaactggctgctctctctgaccataaccccagtgctcctcgaaattcaagaaactttgtctttcatacactttctcctgtcaaggctgaggcggcaaaggaatcgtctaagtctcaggtatggaatttgagaactaatatggtggcttcccaaaccagaatttattcatttatttaaatttaaaaacaaaaattctggcttaacctctatgctgcaatgttgaaatcttgcactccccgataaggtacaagagaattgctaccccagtcggtaatcaacttttaaacttgccgagaaagtttatctttctttctttttttctgttgttaatcatccacaatttatgagttgcttgagagctaattgaaggtaaatacttgtatgaaggtctttagctggccctgactccctctctgctctctaggtaaagaaaaggggtccatctttcatgacttctccttcacctaagcacctcaaaacagatgatagcacttcaggattgacgcgaagcatcttcaaatatttggagagctaacaccatcaaaggtgccaaaatctacattgagactgctttgagaagtttctagcactgaaagttggaattgacactccagccaatgatccttccttctttcataatcaatgcaataagattgcagacagaaattccagtgatttctactgcacagctctggacatctcttttcctagtattattccctgaattggccactgatttcaattctgcagtatttacaacatcaacaactcatggaatacttgggtgaggtttcctttttttttttttttttaagatgggagtctcactctgttgcccagcttggagtgcagtggcgtgatctcggctcaccacaatctctgcctcccaggttcaagcgattctcctccttcagcctcccgagtagctgggattacaggcatgtgccaatacgcccagctaatttttgtatttttagtagagacggggtttcaccatgttggccaggctggtcttgaactcctgacctcaaatgatccatccacctcggccccacaaagtgctggtcacatgcatgagtcactgcacctggccttgggttaggtttcacttcctccattagacatttgacattttattgtagcagctttctgggttaatatctctttgtgattgatagaagtggttggaagaggaagagtagggaaaagtgtgacattacagattaaacagtgaaaatcagtaccataatgactcctttacacccatgagatacgtaccatgatgaccagggctcggtgaaagaaagatttctttttttttttttgagatagtctcactttgttgcccagtctggagtgcagtggcgcaatctcggctcacggcaacctctgcctcccgggttcaagtgattctcctgtctcagcctcccaagtagctgggactacaggtgcatgccaccacacctggctaatttttgtatttttagtggagacagggagtcaccatgttggccaggctggtctcgatctcctgacctcaagtgatccagctgcctcagcctcccaaagtgctgagattacaggcgtgagccactgtgcccagccaaaagaacgatttcttagatggaggacctaggaaccaacagatgggctgctgtattactcttacccctttcattttcctgtatgcttcttcccaaggcagcatcaaattttgaattaatttttgctgcttaataaggacttaaactggtacccaagtcagaaagactctgcctctaattttctggggcttggggatgaagataaagtgttacacccagtgtttgtccaccacagtctgtggggcagagagacccttcctgggactgaattctcaatttgaagcactgttgttcaaagatctcccttctgggtctgacaagaagaaacataacccttatttattgcattcttctggcttacatacattgccctcactaatcaatggacatttcagcatttcattactaattttgagagaaggccaccatggaatttaataaaaatattattgaagagaattgccatcattctccattttccctgaactaccacaagcttctcagaattttagacaaatgtttttcccctcagaactgagcatcagtgctgctttggaaaaacattccatgtgaatactgtggtttcagtgtcaggacctgtacttgggcagttggaagagagtgtgccagttttttactgggagatgggaacaccaatttaattgatgcaattaggttgtaggttttttacagtttttcttttcttttctttttctttttcttttcttttcttttctttttttttttttgagacataggctggctctgtcacctaggctggaatacaatggcatgatctcggcttactgcaacctccgcctcctaggttcaagcaattctgcctcggcctcccaaatagcagggattacaggcacctgccaccactcccagctaattttttgtatttttattagagatgaggtttcgccatgttggccaggctggtcttgaactcctgacctgaggtgatccacccgtctcggcctcccaaagtgctgggattataggcatgagccaccgcacccggccggttttctacagttttctaatactcaagatgttgactttgacaatacttatgtttgtatacttgtaatcttataatggggaaaatgtgtataaagatgttttaatatgtatgtagtttttcaataaatcttaatgccttgaagggaagatttgctgtccagcttgaatgctcattcttgggtcagtgcctgtctaaccttgaggagcatttcattttcaggttatctccatcccagggaaaccctctgggtctaaactgagaagctgctgcaattgtcccctcactggcttctcagtcctagtgaattgatcaagttaacttaccaagtggtttgggttcagctcaggtgaagaggataattgagtttacataaatggtaccttctattatagctctttgtttaaaaaacttattttttagagacagtctcattctgttgcccaggttagagtgcagtggcacaatcatagctcactgtacccttgaactcctgggcttcagcatcctccttcctcaacctttggaatagctgggccacattacaggcatatgccaccatgcccagctaattattttattttagtagagacagggtcttgctgtgttgccccagctgatcttgaactcctggcctcaagtaatcctcccaccttggcctcccaaaatgctggggtcacaggctcagccaccatgcccagcctgttacagctttgattggcctttctctttagctaagtttgtatgtacttcattttatccatgggttcaagatacatgtttttgcctctttctttgaactctctaaacagttcccaaggcaaagtagcccttgctgggcaaaagagaactgagcaggaaggctagatatttcttccctcttgtttccctacatgtcttttgaggagagatagaaaagacaattggaattgacaactgaggataagaaaattcagccaggtccggtggctcacgccagcactttaggagactgaggtgggtgcattgcttgaactcaggagttcgagaccagcctgggaaacatggtgaaatcccaactctaaaaaaaaaaaaaaaaagaaaaaaaaaagaaaattagtgcctgagaaatccagggagaaaatggtttctgggctgggcgtggtggcttatgcctgtaatctcagcactttgggaggctgaggcagctggatcacctaaggtcaggagttggagaccagactgaccaacaaggtgaaaccccgtctctactaaaaatacaaaaatcagccaggcttggtggtggcaggtgcctgtagtcccagctacttgggaggctgagacaagagaattgcttgaacctgggaggcagaggttgcagtgagccgagatcacgccactgctctccagcatgggcgacagagtgagactccctctcaaaaaaaaaaagaaagaaagaaaatggtttctgattgaggctcctgggagaaagcactctttggagaaagaaaacttgagtcaaactctgggttacttttccttatgccaggatggctgctataaagtaagctaagccttgatcttggtaacaggattgacatggacagtttcaatctgacccatatgccctttgcccaaagcactgagccagcagcatcagttatgttttaatgaaattgaagccccaggacctgccactatggctctgaggaggactcagcttcactagcttggaaattacatatttggagggatgagagcccatgagtgtgggagatagggtaggctcagtgtcagtgtttttgtttcttccttgttccatacacttgagtagggatacatggtattaacctctttaaacaggtctctaatttcatctcattaattcacagttgcacagccatactagggtctcttccataaaccataagattttattcaccaaagctctagagacaaggtactcagatctctgtggcatccctcattttctcaactgcttctctacaaacttctcctcactttgagagtttctaatgctcaggctgggagactttttagggggtgtttttggtttttatctcctagggttatgtctaatcactcttgtggcatcctgtcctgggatttgtgctcctaaggatagaggagagtatttctgggaggagtgttcccatgatactatttgattatgtcatccttgagatggtattgtatcttctacccttatatcctactcatcgcctggcacacagcttggaatgtagtggtgcctaccacagtttgaataaataacactacacctttcagagcctctgtttataaaatgaggatactaagtcatggctgtctcagagttgctggggggcttcagttggaaaatgtatgtcagtgcattatgtcaagtgccactctgtaagcataagaaattgccagtagctcccagaaaaaagaaattcacctcctttgagaatgaaagaaattaccagtatcacaattatatcatatattgtaggccacttctgaaaggcccattgtttctcaaatatctcaaacttaaaatgaaaatgtgatcttctctaaaaacctgctcttcctcctgtatttgccatttcagtaaaaggtacctccatatatccagtcactcagactggaaatctggagagcattcttgacctgttctttaatcctgtaatcagacaatttccaagttctgttatttctacttccaaattgcatctggaatcagctcatttcttccagctctatggccagccccctggtccaagattccacaatttctttctagggtcctaccgtagcctcctgacccccccacttctgtttttgcttccttttcatccaatctgcacagcagccagaggcgacctttatgtaaatataatttggaggatgacacttcactacttaaaatcttttaatgtcttccgctgcactcaaagttcaaacttctcatggccgatgcatgacatagctctgcctcccaacctgctgtctactcttctttctcatgacatgcagcctcaggagcatctaaagtgtcctctttccctggaatgccctcccctacatccatcctccttctttgtctgactaatgcataattctcaaggtgttagcttaagcctaatttcctcagagaagccttctctgaccattaacacccctttcttttttctttctttcttttttttttttttgagacagagtctcgccctgtcgcccaggctggaatgcagtggtacgatctcggctcactgcaacctctgcctcccgggttcaggcgattctcctgccccagcctcccaagtagctgggattacaggcatgcgccactacacccagctaatttttgtattttcagtagagacggggtttcactatgttggtcaggctggtctcgaactcttgacctcgtgatccgcccgccttggcctcccacagtgctgggattacaggcatgagccaccaagtccagcctaacacccctttcttaattaggttacctttgtataagtttcctattctttttttttgagatggattctcgctctgtcgccccggctggagtgagtgcagtagcacgatctcagctcactgcaacctttgtctcccccgttcaagcaattctgcctcagcctcccaaggggctggggttacaggcacgcaccaccacacccggctaatttttgtatttttgatagagacggggaaggtgttagcttaagcctaacttcttcagagaagccttctctgaccattaccactcctttcttaattaggttacctctgtttgagtttcttgttcttttttttttttttttttttttttaatatggattcttactctgtcacccaggctggagtgcagtgacgtgatcttggctcactgcaacctcggcctcccgggcaatcaattctcctgcctcagcctcccaagtagctggggttacaggtgtgcaccaccacatctggctaatttttgtgtttttagtgcccagctaatttttgtatttttagtagagacggggtttcaccatgttggccaggctgatctcgaactcctgacctcaagtgatccagctacctcaggctcccaaagtgctgggattataggcatgagccaccacacccagccttaggtttcccattcttttgggtctgtcatcatgatgtgttactttaatgttcgttgaggcttgctttccctactagactgtaagtgctgtgaaaacagagcatatccgttttgttgaaaaatgtatgctttgggtagcaccatgcctggcacataaaataattcaatgaattttttgagcaatgagtgatgggaggcctggaagagctaatggtgaaaagcatagagctgaattatatacagaggagctttctagtgcaggacagaatagaggtgtagagctttagtccttgctctttctgcagcttgtaagcatcatgactttgggtaagtcagtctcttttttcctcaactggaaaatggggctcatgtgaaatgacttggtttagctcacagggtatggttaggatcaaaggtacaaattaatgtgaagtgaatgtacatatttaagaggctgcactaatgcaggctaactcactgctgaggaatgggtagagctgagtgggaaggagaagccaagccccaacaaagctccatagtccaccattggtggctagctatgtgctgagacttgttatagcagtagaaatggaggcctgtgtgtatgcctggactccagtgaactggggagatagacgtggcttgtgtatggctggtgtcacctcagattttaccttttgagaccaaggtgcctggtttctgtccccagtagttttattgtcttggtctgtaccatccacgtccttcccatcccctctttttgtcctctctcctctcaccttaaaggtttttcattttcagtttattgatttagttctaccctgtggtgggattcataatgggaaaagggagtttgaagtagctacagcctaagggtgattggaaggagttggggtggacacctgagttccttcccttcattttagagagaaccgtagtccgcggaattcttgatggctggtgggctagatgtagggttgaagaggcagctcccagctccaggctggagaattattgcctagtccaaggggtagaaagtgctgaggcagggttgggagtgagccgtggtttgggttttttggccctcatctctttttctcagaggctgaaggaaggaaaaaggctgactgcccacccttctgtttgtttgtcttgtctaatttaacttacgttatttatcaaaaagacaggttatttggaaaaccagatggacctaggcaaaaatcatctgggttttccaaacgtgaaaaattaggttctgggggcccagcaggaaaggcgtgtgtgtgtgtgtgtgtgtgtgtgtgtgtgtgtgtgtgtgtgtgtgtgtgtgtgtgtgtttgaggggagggtgaggttgagtgaatgtctctgtagttagacccagaaattgttccatgacttccaagcatactccctccttcattttccttcaagttctttatgattagaatctaaatgagaaaattaaaatcttcatgttggttgctggatgtcttaattgaccaaggattagaacccatcagggctatagaagaacagcagctgacagttttctctatctttccagccctcagtcccttacacagagtgggcaggttagtgagaggtgcagggtactgagagttttctgaaacagaaacctgtgcttcttgtcccttcaatgttattgttccaaagagttgcagcaaatatggaggttagacattagggaagaacttatcatcaactttctgatgatcaaatggctaaaagaacactgaggatccagggctgtctctccattgactatccagggaaggagctagcccagttttcttttgggcaatggtggcttgctctgtagctacaaccaggaatttgtaaaacttgtggttttgggccaggcatggtggcacatgcctgtaatcccagcactttgggaggttgaggtggggggtttgcttgaactcaggggtttgagaccagcctgggcaaaatggcgaaaccccatctctacaaaaaatacaaaaattagctgtgcatggtggcatgcacctgtggttccaactacttgggaggctgaggtaggaaatcacttgagcctggaggttgtggctgcaatgagccaaaactgcagcattgcattccagtctgggtgacagagtgagactgcctcaaaagaaaaaaaaaaaaaaaaaaaaagcttgtggttttgttaccttgagcagcaacatttttaggaaggaattaaagcaggaggctattgaggcatagctcttggctgccatagaggaaatgttctggctgaaagcagaaagcaagccatccagttcatacacatatgcacacacacagaagacagccaagaccctttctggcctgagaaatctttggcggcagcaatagcacttgtcccattgtgagtggcatttttttcaaagtgtcattggactgtgaaagctacttaataacttgatctcatctgaataatctgagttaatactagcttcacagttgtgaggattaaataaaaaaaaattgtaaagtgtctgcctcaaggcctggcacagagtaaatctcaacaaatgctcgttgaatgaatgaatccatgaatctgagcattaaggcccccctcaccgtttccaaggatcagtgcataacagccccggtaactgagacttgtagactgtcccaactgagcctgcagcctgaggcatgatctaaacctgctgttcctttgacaaatatttgatgagttatggtgtggagggtggacccttccatgaaggccttgttggcctagctgttggaagcactatgcagacagtcttccagggtgggaattgcctcagagagcaccttgcccaaggtcaaggatagcccacattcaatggcaacaggtgtgtaacggcctggccttcttagcttattttgggtcaactctgaagggccattctagcttcagagctccctgtggggttggctgaggctgtcactggcttgtcttgtagatcagcctcttcctctggccactcctgctcattctcattcttccacagctgttgatcccaaaggaggttcttaataaacatccagcacattaaacagtctcagagttggcttcctgggaaatccaagctatgaatgcactagtcctggtggccaagcctttagaacaacaaagaacggagactcctttgcaatggatttccagcgttggaggtgtggatactgtctctttatgcccaccagagggcagcagcatcctagccacctgcccttctgaggctccaggagtgggcttgaagccttttccccggcaacttcacgccccacaccagtattgggcaggatcacctcccttagggtgttcaccctcctgactaaaacaacaaaactttcttaaactgtccaggccttagttttgttagtctcaagctcctgtaccaccatcactgaaggccaatcagtcttcctactgtgccccttcccctgctcctcgtccggcaagctccgtgcctgggatcccccacctctcacacttaccacccacaatagatttgttttctgtgtgacaaggtaattacaagcttggggccagtaggcccaggggccagtctgaggatggtcacttcattctggctctccctgttctgctaacggtattgattttcagttttatttattatgatgatgtgtgtgtgtgatctggccctggtgacatgacatatggaggcaagagggcgagagcaaatttccttttgtcacaatttgacttcttgaaaccgcacccccaccaccaccacccagcattgtttatttacaggttttagcatctttgcttacctgtcttcattctgtcccctcatccccaaagatttctaagagattcttctgggaattggagccagatggatgtgactacaagaaggaggaaagggtctgggaagaggagtgacagcagcaagcatactaccttttgttagcagccattaactcatccagcaaacatttactacattcccatcacctgtcagttacttctaggctaagctccccaactccctgctgggggccatcctggagacaggttttgctatgcgctttttttttttttttttttttttgtctgcatctgtttctatgggtgtgtgaggaaaacctggccagaaagctttgagagagtgagattgagtttgggtgcaaccaactcaaagaacgatgcttgcctgaatttaaggctacttaaggcctcccgtaatgtagtctacttccttacgaggaagaggaagggcaagcttgaggcaaaacattacaagtgggagggggcactctgaactgcaatgattgccgtgggaatcagctgaggctgagggcgatttgtggggccatgtttccccagcctgtcttctctgtgcgtgccaggagaatgaataaatcattgttcaggggcgggatgcagctgccgagctcctcccctcggcacatgccccaactccagctcctccattgagggctgctggagcagagcggtttatacacccagctccccaaatcctattgaggcctccccctccgcacgagccaccggctccaagcccattcaggctggccctttgtgctgggggttaagtggttacatgtggggggcacccagaaaggaactgtcaggccttgaaaggctgtgctgatacagtgccctcctactgatgaatggggtgggtggaggagaggtgggcggccggagggtggggtgggggagagggcatggggattatggagcccacagaggcagctgctaggaagggggtggaacaggcacccccttctctctttcctccttcacttcagcttctccgtctagcttactccctctgttgtgggcactggatgatcaagagccttgggaccttggatttggcttttctgatgtcctggtgaccgcttgagtgcactggagagaaagaatttatattacctttcattcttccagcagctccgaaaagacctgtttctcccttttcccttggaaggggtgggtgagaaggggaacagtgttggggacagggggaggattcatttcctaggttcatctggtgcagtggatttgcagctgtgccctgccgaacttttaaaagcttctctgaagttccctcggagcccttaggtggagggtttaggggaagacagatctcaaactggatatattggaaagattttgttgaggaaaaagaaattacttcaaggctctaaaaatgctttaaaacttctaattgaatgtaccgccttgtcattttacagctgggaaaacagccaaaatggaagataggggaatgggcatattttacctaaggtaaacacatagtaatttcttgatagactaaagaggcactttacctttaagaagcagtagagaaatggatgaacaaaacaagtaggtcatcagcttcctaggccttcctttcccaagatgaaccaattctggggaataatgttcgttccaatctgccttaatggctctttggcatgtcaaaggtcctctggggttgtgcctggtcttgggagcccaagtgacaatgttcaccactatgttattgaacaatttttaaggcatattattttatttagcccaaaaaggttaaaatgatttgatttgcctaagttcccaaagccatgtggggaagttgacagatgatgtgacctcaggaagagagaagaaagcaggttagcaacgtagtttgtaatccaggatcgtgctttgttctgatatggaaactctgagggcttcctcagttacttccctgctgtccccaggatggagcccaagctccttgggatggtgtcaagaactttcacaactgggccaactttatcttctagcctcaccttacctccatttcccaccgagctccagccacactggcctacggggtgtttcctgaactcactctgaaaatgcagtctcctatgccttctcttgctttctcttggtgagctcttattcatccctcaaggcctggctcaaatatcacctctgtgctagctgggtttagtggctcatgcctgtaatcccagaatgttgggaggccaaggtgggaggatcacttaaggttgggagttcgagaccagcctgggtaacatagcaagactcccatctcttaaaataaaaaaaatcacctctgtgaagcctttccttacccttttctgggcttactacttttgcctcctggctctgttgcagggcccattacattgttatagcccactcttctgtctattccttttctttgagacagggtctggctctgtcacccaggctagagtgccgtggtgtgatcttggctcactgcaacctctgcctcccaagttcaagcagttctcgtgcctcagcctcccaagtagctgggattacaggcgtgtgccaccatgcccggctaatttttgtatttttagtagagacggggtttcaccatgttgatcaggctggtctcaaactcctagcctccagtgatctgtccgcttcggcctcccaaagtgctggaattacaggcatgagccaacacaccatgacttctgtttccctttctaaacaaggagctccccaagaccacgaccagttctgattctgctctgaattcccaacacagtacctggcacaaagtaagcactctgtaactgtatgatacatgtaaatgaatgggtgggaagggacaaggtctttgaagctgaaacaccttgatcttacccacccctttcttcctgagaatactgatattgagaaattatccacctatgaataacccttaggcctgtcctatttcctggatgagaaattcctctcatcttctctggtctccttgcctgacaccccaggccctgggacctggatctggctactcactgctagcctctcttggctctgacatctgtttgccaagaggcttacccgctgtccatcattgggtcttgatggcatggccttttgcaaagccctgttcaggctgatactggccatctctggaggtttctgtgtccttgccacttaagttcctggcatatatgtgggtaggtgaacccagccacagataccctttcacttgggggtgaattattctctggtgtcctcactggaaaagcctctggcaaatgaataacaggcatctctatagctgcttttttgtcttcctgtggacatggacatccctgcatttggagcttttttttcttcaggttttgagctctgaaaattatggagtgaccaggactgctgtgtgagcactgactgtattaattatacagtgctagaatattccatacaacactgcccttgattaacaaaactggctacaggctgggtgtggtggttcacgcctgtaatcccaacactttgggaggccgaggtgggcagatcacttgaggccaggaatttgagaccagcctgggcaacatagtgaaaccctgtctctattagaaatacaaaaattagccggtgcagtggcacacgcctgtagtctcagctactcaggaggctgaggcatgagaatcgcttgatcctgggaggcggacgttgcaatgaatggagattgcaccactgtactccagcctgggcaacagagtaagactccgtctcagggaaaaaaaaaagaaagagagagactacaatctgatttcctttaaatgaattcacttgacttagcaggtattgtattatttaggaataactagctttaggccaggtgtggtggctcacgcctgaaatcctagcactttgggaggccaaggcaggcagatcacctgatgtcaggagtttgagaccagcctggtcaacatggtgaaatcctgcctctactaaaaatacaaacattcaccaggtggcgggcacctgtagtcccagctactcaggaggttgaggcaggagaattgcttgaacccaggacgtggaggttgtagtgagccaagactatgccactgcactctagcctgggtgacagagagagactccatctcaaaaaaaaaaaaaaaaaaaggaataactagctttttagaacaatggaattgatgactcagctattccaggctggggtgctgccctgcagagcacgatataggctttatttattttattttaattttttttttttgagacagggtcttactctatcgcccaggctggagtgcagtggcacgatcttggctcactgcaatctctgcctcttgggttcaagcgattctcctgcttcagcctcctgaatagctgggattacagacgcgcaccaccatgcctgtctaatttttgtatttttagtagaaacggggtttcatcatgttggccaagcttgtctcgaattcccagcctcaagtgatccgcctgcctcggcctcccaaagtgctgggattacaggtgtgagccaccacaccaggcccaatataggctttaaatcaatgtatataatgctttgtcctttgtggccagaatgcataacaagaagaggtagcggtggttgtggcaccttatatgatttacctaaggactaagagttttcttcctgtctctgagattctgggtattgcaggtcagaaggtgatagcatcggccaggcacagtggctcacacctgtaatcccagcactttgggaggtcaaggcgggcagatcatttgaggtcaggaatttgaaatcagcctgaccaacatggtgaaaccctgtctctactaaaaatacaaaaattagccgggtgtggtggcacgcgcctgtaaccccagctactcgggaggctgaggcaggagaatgacttgaacctgggaggcggaggttgcagtgagctgagatcgcgccactgcactccagcctgggtgacagtgaaactctgtcttgggaaaaaaacaaaacaaaacatggtgatagcatcatgggaggaatgtttcttctaaccaagaaacacaaagatgattccctgggatttcggctcctggtagcactagaggaataggagaagggggtggtctcagtgtagactggactgatcatggctaccaaggagaaagggagttactgttacctaataagtgttgagaggtgcgtgaatggaacccagagaccctggggtcaccaccttgtgctattgtagtaatcagcattctttcaattgtcggtgaaagaaattccactcaagttaggcttggcaaaataaggcatacaaaactataagtttagatgcaggaaacagggtctgcaacattatcagaactatctctcatctctgtttcttccctgcctcgtcttcctttaatttcgtttcagaagatcccagagaaggactctgactggctcacctggagtggagctcctatccctggattcttcaggctttcatttgacccacatggttaagctgggagagacagagtccaaagagaggcggagaagggctattctgggcagaacaaacaattgatgactttatggctctgtggtctgggcagaactgcataaccctagatcaccaaagctgagagcctttaggagtgaggatttgggccaggcatggtggctcacgcctgtaatcccagcactttgggaggccgaggtgggtggatcacaaggtcaggagatcaagaccaacctgaccaacatggtgaaaccccatctctactaaaaatacaaaaattagctgacgtgatgcatgcacctgtaatcccagctactcaggaggctgaggcaggagaatcgcttgaacccgggaggtggaggttgcggtgagccgagattgcgccactgcactccagcctaggcgacagagcgagactccatctcaaaaaaaaaaaaaaaaaaaaaaaaagtgaggatttgggtcaccccaggctgaaggccaggggaacctgaagtggataagggaagggagaagacttaggccacaggatctgatgtagaaatggggctgacgtctccacctgtattttcttagctggaggagtgtgcaaagtttgaattacttctgccttctccttcttatttccttttcccttttaaaatagtcatcataatcataaaaatttcttttcca

SEQ ID NO: 414 - DNA, 41154 bp, Homo sapiens
actacccagactgcctctgcttcagccatcgaggactcgggcggaactaagctacaaatccttcttcaaaccacaccaaaaacctattgcaaacgtaaatgctgccccattgggtatgtgactgagtttaatgtatggttagaagtatactttccctgagggttcccagtgggaggcagtaggcttctcttcccaaagtaaagatgtccgcccagcgtcgcttttctgggtaaaagcgagtcagagttgaagggggcaacagtgtttgcgttcggcctcagaggtgacgcttctttgggggcgggctggagttttctggccgtgaatggcagagcgctaatggccgcctccaatgtggcccaatcagaaagaaaggaaggctgggaactaagaagctattggttggtgatccctggaccaatcggaggagccgtgatttggcgggagtcttgaccgccgccgggctcttggtacctcagcgcgagcgccaggcgtccggccgccgtggctatgttcgtgtccgatttccgcaaagagttctacgaggtggtccagagccaggtgacgcccagtccgggacccccgccgaggccttgccggtggggaagggatgagggggagcgaccgtgggtgaccgggaggcaggggagggccggggttcgggtcgccgtgttcagccggtctgctcttccccgatagagggtccttctcttcgtggcctcggacgtggatgctctgtgtgcgtgcaagatccttcaggtgagttctgcggaccctaggagggcggggccggcgcgcgaggtgagggtgctgcgtgggggcgcagggcgggcagagtgtcaggatgggtgctgagggcttagggtgggagagggagcagggcaggaggtgaacagcaagtgagaggagagagactcggaggagaggttgcctccctgtcccaacggtgtggggtgggataaaggattaagtaaaaggtaaagagactagtttgtatttttgcaataagctattaatattaataggtgaacacagcagttgcatttgggggaaactttggatctgtcgtggcctctcaaatgggggatttgagagagaggaatctgtgacaactgtgggtatagtcgtgtcacaggtgttgctgggaatatgggagcccctagtctattagggaagatcgttagtttggttttgaatagggcatagtatttacgttgttttggtcaggcccttggatcaggaacttttcagaaggcctggaagttaaatcggcatttctccccgatgttttactttggtaatttgcaaaattcacagaatggtatggtaaacgctcatatccctagcacctagcttttcccgtaagcatttcactagctttaatgttatcccgtgtcttttgtctctcaacccgtctaatcttcctcagtttcttttcaaggtaaattgctaatgtcctaaataagataggctttgaaaacactctctctccaggccttgttccagtgtgaccacgtgcaatatacgctggttccagtttctgggtggcaagaacttgaaactgcatttcttgagcataaagaacaggtattgaagatgcgttttagaataacgtggctttttactcaattgtaatttcttgacacagcattctatttccacgatagattaagcgtgtatttaagtatcagctacattaggcaatatggaagagaaaaacatgctgtatttactggtgacttaccacgcccaagttgtagaagcaaaattgacagcaaaaaaagataatgaatgtggatagccccaactttgaacttgttttaacttgttttgcagaaatttgattgtaaggtgcttggaatctagcagtttttaatatggtctagttaaaattattttattttattttggtttatttttttattttttattttttttgaaacggagtctcgctgtgtcgcccaggctggagtgcagtggcacgatctcggctcactgcaagctgtgtctcctgggttcatgccattcttctgcctcagcctcctgagtagctgggactacaggcacccgccaccacacctggctaatgtttttgtatttttagtagagacggagtttcaccatgttagtcaggatggtcttgatctcctgactttgtgatctgcccacctccgaaagtgctgggattacaggtatgagccaccacgcccagcctttatttatttatttttgagacggaacctcgctttgtcactcaggctggagtgtcatggtgcaatcttggctcactgcaacctccgccttctgggttcaagcgattctcctgcctcagcctcctaactagctgggattacaagtgcccaccaccacgcctggctaatttttgtatttctagtagagacggggtttcgccacattggccaggctggtctcgaactcctgacctcaagtgatccgcctgcctcagcctcccaaagtgctggaattagttaaaattattttagaatacactactattttatgttatttctctgagaaaatgcatcctggtttccaacttaaaatccaggaataaatttaaacaatagatgccaggattcctcccacctctgcatggggccaaatgagagatgggacattgtacaccccacagagaggggatgggacatggaagagggtccctggagtccctagccatatctaggattgttttggcagagacaaatcctctcctgatgttcctgttattatgtcaaggacccgcaccagcttggtatttataaggaaagaaagtgctatagtgatagagtgtgataaaggacttaatatttaagtacccataaagtatttgctaaaaacttaaacctgtacgatgccattagcctggagaggcacgcagcatagtactgtgaggtctggagagacccaatcacgtgctcgaagtcttggtctgctcctcattagtttcttgagcctgtccacgagacttgggcttgctgagtctcagcgtgctcctggggaaaactgggagccccagggcccaccctgctgtgtcaccatgctaaagcacttagcatgccagcctggccattttttggagtcccttgccacgtgggcctcgccacatgtcagggactgagtgagtttaagcagaacaactcagaggcttagtgatgaaggaaaaggggcctcctcgatatagctactttacaatatcttcctttttttcagtttcattattttattctcataaactgtggagctaatgtagacctattggatattcttcaacctgatgaagacactatattctttgtgtgtgacacccataggccagtcaatgtcgtcaatgtatacaacgatacccaggtactttttgtgctatgccctcaaactgtctgtactttttatgccatgtacaatgtctcacctggtgttcttggtaaggtgtgtgtctgactaccctgtgggactgggaacagcctgaacacaagaacttggtctttgtcatcttttttttttttttttaaggagagtctggagtacactggcacaatcatggctcactgcagcctcaaactcctgggttcaactgacccttcctgcctcagcctccttagtaggtgggactacaggcacatgccaccacgcccagcaaatatttgtttttatttttgttgaaatggagtcttggctgggcgcggtggctcacgcctgtaatcccagcactttgggaggccgaggcaggcggattacgaggtcagaagattgagaccatcctggctaacatggtgaaaccccgtctctactaaaaatacaaaaaattagccaggcatagtgttggacgcttgtagtcccagctactcaggaggctgaggcaggagaatggcatgaacccaggaggcagagcttgcagtgagccgagatcgtgccactgcactccagcttgggcgacagagcgagactccgtctccaaaaaaaaaagaaaagaaaaatcagcctggagttgctttcagacaggagttttagtcaccacttaggggttacacatcttcatgtcctatatcagacagaggccaagttgtggggcgttcattttattggtgtatgacgtaagaggatgctgtgtttccagacttaagtagactagatggttctcaaagaactgttttcagattttcataatttctgcataccacgtatggtgtaactctggtgcctcactggtaatgaaaacaagaaaattccttagaagcctggaactcttgttaaataggtagctatttgtatgaacaggaaactgagtcagcttattaggaaatgataagattctgcagaagaacatattgtatagttttccgtagaaagaggagaggcttaattcctttttgttttgaacttagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggtgagtttgggtctctcacagctatcccagaggaacttgcactcccagaggtcggaggtcatcctgaagcctgccaggccaaggtgtactgagggcagtgggaagtggaaaagttagcaggcatggatgctgaccctgggctctgctgtcccctggttatgtggcctcaggcaggttactggacttccctaaatagtggcttatctgtccaataggatcctgtcagaagaaatgaaatttaggacagctcagctctgcggctagatagcaaaaaaataatgtagagaagcaataaatagtgtaacccccaccccttccttttctactgtcttctagcatcacttactatgcagtcactgcagaggagcaatgtgggtctgcatcccttggccaggcccagtcccagacaattactgcaggggaggtatcttgtatgtgaagataccagtggttttcaccatgtggaccttgggtctgagctgcttagtgatctggggctgggcccagtggcctacccaacactacggcttctgcaagatgtaaaatgacaggcagaaggtggttgttcccatagcacggagggccacgtgatgcttttgaagatggcctctggctcctgatcttggtgtgtgacctagaatttgcccccgtaatgttctagggtcttcccttcatcctcagcctgacatttcccggtaatgtgcttttgggaagcctttttgagccatatttgagatgttcaagacattcttcatttggggaaggggcaatgcccttcaaactgaggcatgcttctctcttctttctcacctttgtcacccctttcactaggtttgggtgtctcatagggaacctcttggacccactgttatattttcttacctcttgcccagctctttgttctattttttggaagactttttgttttttgttttttttttgttttttccccagacggggtctctctctgtttcccaggctggcctcaaacttcgggctcactcgatcttcccacttcagcctcccaagtagctgagactaagcacatgccactacactcagcttggtctttatcttctaatctttggtttgtgaggggtcctttttgttctctgaatttttttttatatagcattcttttaactatcgatgagctgcatttcattggttcccaaatgtcagtatccaatgggatttcccgggaaacattcatgttctacagataagtcttggaattttccactctgactaataaacaaatattttttaagcacttactatgtgccaggtaccagttaggccctggggtgcgggtatgagagcaaagtcctgcctttgcaaagctttccattgggggagacagatactgatcatgtaaatgagcacaattagggaaagctttcaggtatcaaacatgagttagcaggggatggagccaagaggattcctgggcagagcatccatagacactgcagctctgaggtgggaaggaaagtttcaaggaaggcttggccagcagtgccaaaggaacaggcaaatgagaacagaccagtgggtttggcaataaagagaaggtaggttgtcttgatgagatacaggaaaataatcagcgtttccttttacatacttaacacatcaatttggaatttgtgtttgtaaatgtttaacataatattcatggattataataggcataatttcccaccaactttttattttgaaattttttgaaatgtatacagtggttgaaaggatagtacagtgaatatccatgtaccttcaatctagagtcaacagtggatcatgactgtaggtggtctcagctacttgggaggccaaggcaggaggattgatgaagcccaggaatttgagaacagcctgggcaacatgaagagaacctgtctcaaaaaaaacaaaaacagtttttcacatttgccacatttgctttctttctgtgtattcttttttctgtattatttgagaatagattgcagaaactgatattcttttttattttttattttgttttttcttgagatggagtctcactctgtcactgaggctggggtgcagtggcacgatctcggctcccttcaacctctgtcttctgggttcaagcgattcgcctgcctcagcctcccaagtagctaggattacaggcatgcactgccacagccagccagaaaccatgatattctacacattctttcataagcagctcctaagaataaggacattcttccccataaacacaatgccattgtcatacataagaaattaataatatcctaatatcatgtaatattcagcccatattcaggtctctttaattgtcctcaaaatatattttgcagctatttttatttctgaactattctccaatcaagattaagacatttagctattcctctttactgtcttaacctagaaccataccttacctcttttttttcttttgtttttaatgacattgaaggccagttctcttttctaatatttactactacttgtttcttcatggagtactttaacttgcttctctatccctgcattttctatgatctgtaaattaggtctagagcgttgattttaataacattaagcattcttgagaagaatactttttatataattaaaacctgtgcatgatttataactaagtatgtgtatattagaggtatatatatatttttttgagacggagtctcgctctgtcgcccaggctggagtgcagtggtacgatctcggctcactgcaagctcctgggttcatgccattctcctgcctcagactcccaagtagctgggactacaggtgcctgccaccacgcccagctaattttttatatttttagtagagacggggtttcaccgtgttagccaggatggtctcgatctcctgacctcatgatcctcccaccttggcctcccaaagtgctgggattacaggcgtgagccaccgtgcccggctgctttttagaggtatattcttagaaatatttttaccagcctggtgtggtggctcaagcctgtaatcccaacactttgggaggccaaggcgggtgaatcacctgaggtcaggagtttgagaccagcctgaccaacatggagaaaccctgtctctactaaatacaaaaattagccaggagcaatggcagatgccggtaatcccagctactcgagaggctgaggcaggagaattgcttgaacctgggaggcggaggttgtagtgggccaagatcacgccactgcactccagcctgggcgacagagcaatactcttgtctcaaaaaaaaaaaaaaaaaaagaaatatttataccagactggacaacatagcaagacactgtctctacagaaaaataaaataaaaattagccaggcatggtagcatggtcacataggcccggctacttgggaggctagagtgggaggatgccttgagaccaggaggttggttgaggctgcagtgatccatgatcacatcactgcactccagcctgggcaacagagcaggacctcatctcttaaaaagaaaagaatgaaatatttttattaataagggtgcacattcaaagaggtttagagacaataggttataaataattgttttaaggagttctgctataggccgggcgtggtggctcacgcctgtaatcccagcactttgggaggccgaggtgggtggatcacgaggtcaggagattgagaccatcctgctaacacggtgaaaccccatctctactaaaaatacaaaaaatttcccgggcatggtggcaggagcctgtagtcccagctactcagaaggctgaggcaggaggatggtgtgaatccaggaagcagagcctgcagtgagctgagatccaccactgcactccagcctgggcaacagagcaagactccgtctcaaaaaaaaaaaaaaaaaaaaaagagttctgctgtaaagaaaagaggagacatggggtcgagaatcatttttacttgtcttttaaaggttggatgttagagctggaccccagcaaagatgagagtccgctataaaaataaccataattatacttaatctacaggtgctataatatcgtggctcaggtcacgggtttcaaattttgtatctgctataacagctttgtgactgtaggcaagtgacttaacctctgtgtgccattgtaaaataaggagaataactagacttaattgttttggttcctactgatgtttaacaaattactccagaacctagcagcttaaaacaaccttttccttatgctcatggattctgtaggttaggaatttgggcagagcccagtgaggatgacatctttttgatctgtgatatctgggccctcaggtggggactcaatggctaagaactggaagcatggctcagacatctgctgggagggctccaaaccaggactactgagccaagcacctgcagggtctctccattgaatgtgacttccttacaacatgactgctcaggcttccagcatgaatattccagtcacccgggcagccactgcatggctctcccgaccagccttggagtacctcagcatccagtagccacaagggaggggacaggaccccaccatgcattgtggcagggtcaaagaaatctcaggctgtgggaattttgttactttattgaggcataatgtctacacaattcactaggtggtacaattcaatgagatttaacaaatgtataaagatgcaaccaccatcccaccatgatagagaacaattccattacccgcaaaaagtttcctcaccaggaccatggcttttttttaattaaagtttttcttttgagataattacagattcacatgtagttgtaagaagtaatatagagagatcacttatatactttgcccagcttcccccaatggtaaaatcctgtagtataatatcacggtcaggatgggaggctaaggcaggcggatcacttgagcccaggagttggagaccagcctgggcaacatggcaaaaccctgtctctacaaaaactacaaaaattagccaggtgtggtggtgcacacctatggtcccagctacttgggaggctgaggtgggagaatcacctgagcccagtaagtcgaggctgcagtgagctgtgagcacacaactgcattccagcctgggcaactgagactatctctaaagaaaagaaagtctcctttctaaatttataaatcatgtgatttttcagttggcactctaaaggttagaaatcactgtgaaagttctgccagaaactgaatatgtctattccatttatgcattcagaaactgccaaaataacccatgggtattgctttaaaaaaaaaaaaaaagatacagaacatttccagcactgtaaggatccctctgttgcccttttatagccacacccacttgtctgctgcctggtaaccactagagagctccatttctgtaatttcatttcaacaatattatggaaatggaaatggaattatacagtatgtagccttttgggattggctttttttcgctctgcataattcttggagattcatccatgtttgcttgtatcaatggctcattcctttctcgtccatcagcattgtgcagttttcagtgtataaattttctgtttttgttagatttatacctgcataaaaacaaacaatatttattatttctgcgtgctagccataaatacgtggacaccaaaatttaaaatacagtatcatttgcagtcagtcaaaaaaatgcatagtctgctgttgttgggtagagttttttagaaatgtcacttacatactgagagttggtggtggtgttgagttctgtttgcttgctgcttttctggctagtaatactttcaactcttcagaaagggacattgaagaccccaactctgattatagatttgtttgtttctccttccagttctatcactttttacttcacgtatttatagctctcttgtgcgcacacatttaggattgtggtgtccttttggtggattgacccttttattcacttagtgtcccactctgtctctggtaatttgctttgctctgaagtgtgatttatctgatattaatattgccactcctgctctcctttgattaatgtttgcacgatatatcttttcacattctttagtttcattctgcctatattgttacatttgtagtgaattttttaaaacagcatacagttggctcatatttttaaatcatgttttttaaagccattctctatctcttaattgataaacttagcttacttacatttattttagttactgacatgttagggcttaagtctgacattttattttctgtttcctggtctctgttttttttattctatttttttcttgttctttgttatttgtatttttatttttttgagatggagtttcgctctgttgcccaggctggaatgcagtggcgcgatcttggctcactgcaacctctgcctcccaggttcaagcaattctcctgcctcagcctcctgagtagctgggactacaggcacgtgccaccacgcccagctaattttttgtatttttagtagagatggggtttcaccttgttgggcaggctggcctcaaactcctgacctcaggtgatccgcccacctcagcctcccaaagtgctgggattacagccactgcgtccagcctgttttctttctttttctttcctctagtgtttgtgagtctatctccttgtatagattttttagtggttgtttcaggttattacattacatatccataacttatcacagtctactggtatcatcattttaccagttgagtcacatgtagaaaccttatcttcttttttttttttttttgaggtggagtctcactctgtcacctaggctggtgtgcagtggcacaatctcagcttactacaacctctacctctcgggttcaagcagtactcctgcctcagcctcccgagtagctgggaccccaggtgtgtgccaccatgcccggctaatttttgtatttttagtagagatggttttcactctgttggccaggttcgtctcaaactcctgacctcaagtgatccacctgcctcagcctcccaaagtgctggaattacaagcatgagccactgtgcctggccttgtcttctcttaatgtcttttactctgccccatttataatataattttcttaaatatttcctccacatatacagtgttataatttttgcttcagtaattaagcataattacaaactcaagaggataagtaaggaaagcctattgtatttacctcatttttgcttactgtatttttttcttcctttccagtattctaaggtttcttttccatttcctttctatttaagagtctcctttaaccgttcctttgggggagagctactggagataaattcccttagttttccatctttgagaatttcttgatttttttttttttattcctaaaaggtacttttactggatgtagaattctgggttaatacttattttctttcagcatttggaaaatactgtgccacttactctggctgccgtgatttctcatgagaaatcctctgtcattcaggctttatccctatcatgaaagtcttatttttctttggctgtttttgagatattttggttttgtttgagtgttcagaagtttaattaggatgttaggatgtgtcttggtgtggatttgtgtctatcctatttgtttctcttatttttttgagacagagtcttgccctgtcacccaggctggaatgcagtggcacgatctcagctcactgtaacctccacctcccgttacccagcttcttgaatctgcaggtttatgtcttttttttttttgaggcagagtctcactctgtctcccaggctggaggacctgcaacctctgcctcctgggttcaagcaattctgcctcagcctcctgagtagttgggattatagacatgtgccaccatgcctggctactttttttgtatttttagtagagatgaggtttttccatgttggccaggctggtctcaaactcctggcctcaagcaatctgcccgcctcggcctcccaaagtgttgggattataggtgtgaaccaccacacccagccagcaggtttatgtcttttgccaaattttcagccattatgtcttcaagtgtgttttcagtgcaccctctttctcctcctccagggcactgatgacgtgaatgttagctcttttgttgtagccccacaagtcccagaggttctagtttttttggtctattttttctcggttgttcagactgggtaatttctgtctttctgccagttcactaattcttccctctgtccccttcattctgctctcgagcctatttgctgagttaatattccagttgtatttttcagttctaaactttcttctatatatatatattttctttctttctttcttaaactttgtttagaacacttgtctcttctttagatctcttatttctttgctgaggcttcccggctttcatttgtttcaatcgtttgtcattgctcgttgaagcatttttatgatggctgctttaaaatcttgggcagataattctaacaactctgtcatcttgctgttggcatcggtgggttttcttttttcattcattttgagatcatcctagttcttggtatgatgagtaatcttcaaatgaaaccaggagatttttgtattatgtgatgagatttcgtgtcttctttaagtcttctgttttagttggctttctctgacacggctcaagcaaggagagtgagtgatgccaggtagaggtaaaagatcaggttccccacctgatgtctatcacctggggcagtgaaggtccaggcttcccactttgctgcctcttaccctcctagcagggaggggaggaatttctcattactagaaggtgggggtggaagtctgggttctcccaccattggttctcccacccagaggtggggtgtggacttgtcaccaaccagcaggggttgcagtctcagttccctccttggcctctctgataccaccagacagagggcttggggtgccttgctacagcttcgcaaggatgggagcctaggctcccactgggcctttgctggggtggatatggatgttcttggtggtgttggctagagtagatgggctactgcctaaaagctttctgtcttgggaggttgctccttcccagtcctttgactagacagagcagcttttgtgggtttttttttttgttgttttgttttgttttgttttgttttgttgtctgcacctgttggtatttctaggttgctggcttttcagctccaactctggcatatatgaaccagaaggaaaactcaaggaacactgtgttgttcctcatgtcccagagtccctaactgctctgccttcacctctacctttcagagtcttactttgtttttttttttttgttgttgttgtttgtatgtttctgaggcagagtcttgctctgttacccaggctggaatgcagtggcacaatctcggctcactgctacctccacctcctgggttcaggcagttttcctcctcagcctcccaagtagctgggattacaggcatgtgccaccacgcccggctaatttttgtattttaagtagagacggggttttaccatgttggccaggctggtctttaactcctgacctcatgtgatccgcccgcctgtctccaaagtgctgggattacaggcgtgagccactgcgcccagccttactttgtttgatctatgatgtcgaagggttttcggtatatttaatgaatgtatggggaaaaacatatctactccattttcccagaagcaggagtctcgggaccatggatttctaaacctaccacattattccaggcctttgttgtgaagattaaacgaggttgtgcctgtaacattagaatagttcctaacgcatggtagaatataagaaatgttagctctcatccatcctgatgtggaagctggtacaaagtgggtgtgagcttaccttggatcccatagtgctgtgggtgacagcagctagggtggatgaacacagttttgcctggagcaggtgcttgggaagcccctactctttctgcccatggtgtctggagagctgggagccagaaggggtcacagccatcccttgcctccatgcctctcttccgtaggaacaggctgtgctcggggcactggtgtgaccgtgttctctctcaggggtctgggcctactgacttctgccaaattggaaccttcttgggctgtggggataaattcctggtgcatttgctccaccttttgttctctttgtccctgtatcaggagatagtggagcaaaccatgcggaggaggcagcggcgagagtgggaggcccggaggtgagtctgtgcttccagctgctcccagcaccagaagcccacttgcctgggggtctgtggtgccacccatacctctgacttcctgtctcaggataatttattgagtttagaacctttgggccagtggctctgggagtgaacctgtggccgctgcattggagaagagctccaggttgttcgccggtcccatgagtgacaggacagccccaaggtctcccaggtacatgccatccattagagaccatggccctggctctttatttttatcaagtttttccaatgtagatactttgatttacaaattatttataagaagtgctctaaaatgaaaatattggaaaggttattctagcttgaagtgagcatgcagcagcgcccttgaggtgggtcccgggggaagcccttgctggatctctcatggaaggtctcccaggccatccagctgatgttccccctgtttcagctgagggcatgcactcctgccgctgccacaggaggaaggctgccccctcggataaggacaacgtaagacaggtgtggtggctcatgcctgtattcccaacactttgggaggcccaggcaggagaatccaggagagttcaaggctgcagtgaactatgattgtgccattgcactccagcctgggtgacagagcgagaccttgtctctaaaaacaaaccaaaaaaggataatataaaaccatttcaggaagcataaggaaagaaaagtgaaaataatccataatcacactgcctaattaaaagagattctgggtttgggtttctattcctgggttatacatacttgtgcatattttacatgatacatctgattttgcatctttctacttaatataaccatttaaaatagttctgaacaggctttctaaacagcctagtacttaattggcagtttcccttctttttgaaatgtaggttacttccaatattttgccattataaataaggcttcagtgaattactttgtgcacacagcaagttttgtcttgctttttcctttgaattgtaattatgggacaatttctctgaaatggaattctgaactataccactttacatcatacattgccactggcagtttgtgttaatttcccaacgttacacatatacattctgctaaagagtcaataagtggccaggtgttgtggctcatgcctataatcccaatactttgggaagccaaggtggaaggactgcttgagcccaggagtttgagaccaacctggacaacatagtgagactttgtctctattaaaaaatttttttaaaattagctgggtgtagtggcacatgcctgtagccccatctacttaggaggctgagttaggaggatcacttgagcccaggatgtcaaggctgcagtgagctgtgatcacaccactgcacttcagcctgggagacatagcaagaacctgtctcaacaaaaaagaaaaaaccaagagtcaatatgtgaaaacaaatagtaccatgatttaatttgcatttcattgaatactgtcaagtttagcatttttccaaaatatttggcttcctgtactgctacttcctgttgaagacctgcattttatgtcattacagaagagacatcctctttgactacgagcagtatgaatatcatgggacatcggtaagtatgaataggtggaactcactataaagttctgactccaggggtcagtgtcctcaaatgtgaagaagaaacgtagattttagagccacaaaagcctggtttgaatctgagctccatgtcttccccctgtgtgaccttgggcaggtgttgcaagctctctgagccttaaacatctcctcctctgtaaagagaataatcctcatttcagaggtaattattaaaatggtcgtttgcacccaataggtgatcaaagaagagcagcgtttatttttgttcatcaaaaacacagaatgagtttgtaccagtctctgtgcgagaagataaaacgctatagacttataatggcccatcagtgtgtgtcttttacaaaacagaatttagtgtagaaaacctactatgtcaatagtgttgagcagagctcaaggccttaaggagccctagaaaataagtttcaataaaacatcctgtatttagtcttagaatttaatactgggaccttgaactctaagcaccgtatttccagtgtcccttttattgtcaaggttccattgtcctttgaaggatcatccttttgctgtctctgctcagtccttgctaatggaaaattctaaacagttggtggggagggtgctgatgctcacttagagaagataactccctccagatatatggggccagttcccttggaaattctctccctggaggaagcccgcatctcacggcaaaggggatcttagggtcttctggtcagacaccagtcttcctcaaggtcttttaccaaatagagaccctctgcttatgggagttaaatgctccgatgtggacagccctgttggaaagagaggtgctgaggcccctccctctttaatattcaaataattggacccagggctctgcctcacctggccttcctgggaatgtgtttgaggacgccagccaagcaggaggagtgtgcggatgcagagccaggcaaatgatggggtctcctggcctttgggattcagtgcctgccttgggcatcactgaggaacacagggagatacaaagaggccccagccagtgctgcacccgggctgcccctaccaagtgaattcttcccttgctacaggataaaatatacagacagtaatgattttaggtagcaaaggagttactttcagtcttcctcttctcagtttagcgtgtactcatcccacatgtcgggctggaatccacccacatgccctggccaggtagaccctccatccgcaggggtttgccagggcccttctggctcaagtccagtctggctgcatggcccagccccagcacatgcccctcccatgagccttagacttctctgcttccttacagtcagccatggtgatgtttgagctggcttggatgctgtccaaggacctgaatgacatgctgtggtacgtagcccctgcggcagctgtgtgggagtatttgttgccttggtcagtgccacataagcagctctgtcctcccacagggagggtgtttcccttgtccccaccaggagtgtcagatgcagcccctttctgggtatgtgtgtgattttggtctttttcctaactgtgaagccctgggagcttcacacaaacatgggacttggagtgtcggagaatgcagaggaagagaatacagtacagcttcaccttccccactcctgctgctcagcctgtactcagtaaagtcaagtgacaggaggagtgtgagatttgaaggaggcagcctttgcagtggctcacatccttaattctacatccgtaatcccagtactttgggaggccgagacaggagcatcacttgagtgcaggagtttgagactagcctgggcaatgaagtgaaaccctgtctcaaaaaaaaaaattgtctgggcatggtggctcacccctgtaatcccagcactttggaaggtcaggaattcgagaccagcctggccaacatggtaaaaccctgtctctaccaaaaatagaaaaaaaaaaattagccaggcgtggtggtgggtgcctgtaatcttagctactcaggaggctgaggtaggagaatcgcttgaatccggaaggcagaggttgtagtgagccgagactgcgccattacactccagcctgggcgacaagaatgaaactctgtctcaaaaattagccaggtgtcatagtgtgtacctgtagtccaagctactcaggaggctgaggtaggaagatttcctgagcccagaagttcagggctgcaatgagctacaattgtgccatcgtactccagcctgggtgactgagtgagatgctgtctgcagaaaaggaggcagctcttgctaggcatccttgcagtcctggcacacggtggcaaaatttgatgtaggaagaaccatccctcctctgagtccgctgtgcgggctgcacctggcatgaccgagcacagtggggcccagtcactcttgctgtgggctggccgtcatgctggggaagccaggccttgcctgggtctcaggtaaaagatgagcctgaagatgggagccttgaaggctcaccagaggcctaaacactgctactctacatcctgctactttaagctgcaggatgagtagatgtgaacacaactagggccccctgtgctgggggcatgtgccatgaggggctcagagagatgaagtgataccagggtcaccaacagctcagcacaggcctctgccatgatactgtatcaactccactccgagtgttggggtcaggagtgcaggacaagagcagagcatggcctaggagtgggtgggagtgctggctcctattatagctgccatggctctcctgggaggttttcctcctctgagtacctaaagctcccacagtggcagacactgcactgcaaggccccaattacccttctaacctcttcacctcaaggagagaggccacctgactgaggcaagccagggtctggccccactggcaggacattccccagagtgctgagcttgggcccgttccatcatctcactccatcccccaggcctcattgagcccaggtgggctataggccggctccactgccttctcttcttccaggtgggccatcgttggactaacagaccagtgggtgcaagacaagatcactcagtaaggacacactcccttgccttgcagggtcagccctgtgctgtggccaggtgcacagcctgaccatagccactaagtttttagcagggtccctgtagggtcctattgagaagtgaggactggccctcctccttgggcccaagcatttgtcactgaggaagggctaactgagtaccagccgagtgaccgtggccttgtgtggcgtcttcatctggcaggtagagccagcctccccagttctctcccagtgccctgcttgtgctgggtgctaccagcagggccaggcttagaggcaggtgctgaggtgtggcccttgcagtaggtggggggatgggggaagacaacacaggagcaggttgggggcgggatgagagcccctagtgaggaccctgagtatcttgccaagcagtaggggtttgaccccaaaggtaaggggaaggctccaaaggtaaggggtctggtgtgaagcagaaccccttttgccctcagtggtgggctccccatctgatagactgacggtgagctgcaaggctgcctcagaatgcagatgctgcagggcgaagtgggggttggcttcttctttcatccctgctaatgcacgaagtggcccaaccttctctagtggccatcaggcagaatctcttagggattggcatggacctagaccccaacatgctggtcctctcctaggggacccatgtagatgtccccaggctgtcacctggcacagccctaggcgcagcctccaattgggtgctggtctcctcatgcagtttgaataggccccatgccactatttcctgcctccccagccctgcccctgtctggatcctgcaataaggcccacaaggcaggagaagcccaagtttcaggcctggagctacggcctggacaggtcaccttggcacagcccactgccctgttgggccctgagtcccttcgtgtgttaagagtagcatggaatttgtgcacagataatgtaggggctagaaacaccatggtgtatgcactgataggcactgttcctggtctgtagcagtctctcaggtgaggcccccacggtcactgtcctggttggtggccctttggaacctagagtggggtcttcctgctctcattgtgctcagtggcacttcctgtacaggatctgtacctgaaactgtccctataaactttacaaaattaatgagggcagggggaggggagaaatgaaaatgaacccagctcgcagcacatcagcatcagtcactaggtcggcgtgctctctgcctgcttcctcgtagctgcttggtgtctcattgcctccgaaacatgtagaccctgtcacaagattgtagttcccctaactgctccatagatcacaacttgaaccttaggaaatgccgttttccctttgagatatttctttgggtcccacatactgatggagctactgactgagctgctccgaaggaccccacgaggagctgactaaaccaagagtgcagtttgtacaccctgatgattacatcccccttgccccaccaatcaactatcccaattttccagccctccacagtctccctaaaagccccagcccaaaactcctcaaggagatggattgaagatctcctcccatctccttacttggtgccctgcaatcatgaaactcttcctctgctgcaaactctgctgtctcagtgtaacaggtctgttactgcacagtggacatatggaccgcctggtcctataacacattttggaggccgggcgcgatggctcacccctgtaatcccagcactttgggaggcagaggtgagtggatcacctgaggtcaggagttcgagaccagcctggccaatatggtgaaacaccgtctctactaagaatagaaaaattagctgaacatgatggcacacctgtactgtagtcccagctactcgggagggtgagacagaggaatcgcttgaacccaggaggcggaggctgcggtgagctgagatcgtgccactgcactccagtttgggcaacagaacaagactccgtctcaaaaaaaaacaaaccaaaacaaacaaaaaattatggagagcctacctgaagccccttatgggtatttgcctgcggctaggtgccccttcactgttcggtgggcaggacctagagacaagcccaagtggccactgggctccattgaaatatgggctgttgctggtgccctgcctgttgacggagcagtgtcaaccttcggtgcataaactgctcgcagcaaagacagtttctggttttcaaaggcattagaaaagttttctccatgcaactggcacccctttctcttctgatttgctggcctccttggaggtcttgtggcctcctcagaatcttgtgacatattataaccctttcttaactggaaatgacccagacacccaacaagcatctaaaataattttaggattttaagctgcatggaacgtttgcctagaagcattcatacaatttacatttcatgcatttttaagtttgcctagattacttatgaaaactgagagacaaaactagtcatcatttcaaattattttattgttaacctttttctttttttgaaatggggtcttgctctgtctcacaggctggagtgtgttggcatgaacgtaactcactgcagctttgacctcctgggatcaagcaatcctaccaccttagcctcccatgtagccgggactacaggcatgtgtcgccatgcctggctaatttttttgatttttttgtagagatggggtcttactttgttgcccaggctgctctcaaactcctaggctcaagcaatcctccctcctcagcttcccaaagtgctgggattacagatgtgagttgccacacctggccttcttaatcatttttatagcctgtgaccatcagatgttcacctaagaaccttaaagttaaatgcatgtgtatttttgctgacaactcagaagattcagctgttatcattaaaccaacaatattcatcttatttgtcaaaaagtcatacaaagatcattctggttttggttagttttacagtcttaaaaccttttatgcaaagtcctgacaccctaaatatccagtagagacaaatataaaatcgttcagtcaataaactcagaaaaaagatgtacgctgatagttttgaagacgtttctatttttattttaccaataattttaaagccagcttatttactaaagatcatttaagtcacatgaagttgaaaaatatttgaacttatttactttgtttatgagcactcatttatttataagccaatttggtagcatgtaggcacaacacataacacaacatgtacatacatctaaatttattttaacccacatacacacacatacaaaggtacagcttttactgcagaactctagccatgagacagcagtacaaactcaccagtttataaaagagggctggatccaaattatttctgacaaaattggaaccattcacataaataaactttgtttatcccagtaggtaattcagtgaaggctgtgaactaaaattttgaataaagcagtttctatagcagtttgattttaaaaacttaccctttctttttttctccagtttcaagttttcaatgattacattttagctacaactggctgagctgtataagcaaaacaaaatctccaagtagctctgaataataccatagacagtgagtcttttctcaataccagtagcttaataataccagattcaaagcagacagaaaagagacaggggtgatggctcatgcctgtaatcccagcactttgtcgggggtgggaggattgcaggaatccaacctaggtaacatagaacccctctctataaaaataaaaaaaaaatcagctgggcatggtggtgcatgcctgtggtcccagctacttgggaggctgaagtgggaagattacttgaacccgggaggtcaaagcttcagtgagctatgattgtaccactgtcctccagcctgggcaacagagtgagaccctgttttaaaaaaagaaagcaggcagaaactttctcatagtttttccacaggaatttcttcttttagtgggtaggttacccactgcactatcctgatgaagatgtacgtctcttgtcttcccagtttcacaagatgcagcccagtgcccagcttggagtaaccaaatcaatatttctcattccagctgagacgatatacacacaacaaaaatgcagacactgatcattccactctgcgcccagatttgacgtggcgaggctcatacttgcccctgtcagcccccagcacctttgatctactcaaagttgggaggaattacctccaaccaggagttcagcgggtggtctctgggcaagatgaaaaagtatatggtcaacctgagttaggcctgctgagctgctgctagcaattccttcagggatccctttcacaaacataaacctacataacaagacaaagacaaacaaaaggccttccgaaatcaagttccaaatttcagaagtcaagaggatttctcccaagcagtgctctttggtctccttccaatgcagaggaagtcccctcaaacgaggcccttcctattattagggagggtcgacaagacctcagaagaggcctcgagacttcagagggagccacaaaacctttgaagaggccacaggacctccaaagaggccagcaaatcagaggagaaaagggtgctggttgcacggagaaaacttacctaagatgcctttcaaaaccagaaacttgctttgctgcgagcagtctatgcaccaaaggttgacattgccctgtcaacaggcagggcacgggtggcagcccatatagttcaatggaacccagtggccgcttgggctttgggcttgtctctgggtccttcccactgaacagcgaaggcgcaccaagccgcaggcaagcaaatgcccacaaggggctcgaggctagactcaccataatgtgttataggaccagcaggtttgtatgcctgctgtgcagtaacagacttgttacactgagacagcagagtttgcagcagaggaagagtttcatgattgcagggcaccgagtgagaagatgggaggagatcctcaaatccatctccttgaggagttctgggctgggcttttttggttttgtttgtttgtttgtttttgagatggagttttgctcttgttgcccaggctgcagtgcaatggcgctgtctcggctcatcgcaacctccgcctcccagattcaagtgattctcctgcctcaccctcccaagtagctgggattaccagtatgcagcaacacgcccggctaattttgtatttgtaatagagacggggtttcttcatgttggtcaggctggtctcaaattcctgccctcaggtgatctgcccaccttggcctcccaaagtgctgggattacaggcatgagccactgtgcccggcctgggctggggcttttaaggggactggagggtgaggggctggaaaattgggagagttgattggtggggcaagggggatgtaatcatcagggtgtacaaactgcactcttggtttagtcagctcctcgtggggtccttcggagcagctcagtcagtagctccatcagtatacaggacccaaaggaatatctcaaagggaaaacagcatttcctaaggttcaagttgtgatctacggagcagttaggggaactacaatcttgtgacagggtctacatgcttctgaggcaatgagacaccaagcagctacgaggaagcagtcagagagcacgccgacctagtgactgatgctgatgtgctgcgagctgggttcattttcatttctcccctccccctgccctcattaattttgtaaagtttatagggaacatttcacccactctgctgtggatccctgtcacttacggagtctgtcatcttggctgtatgggctgtggcctctgcggtgcccattctcaggaggtgtgagacccatgaggaccggaggtggacaaggctagagaccacacccccccgctccatccaatcatgttttcctgggtgcttggtttctatgcaggctgcatgtccttagtccctgcatgggaacagctcctgtggtgagcaggcccctgaggaaggccttgagcgggaatggagcctaggcttaggctgcctggtaagagctggagggaaccagccgaggcttgtgctacttttttttccagaatgaaatacgtgactgatgttggtgtcctgcagcgccacgtttcccgccacaaccaccggaacgaggatgaggagaacacactctccgtggactgcacacggatctcctttgagtatgagtatccttgtggcccagcctgaggggcacaggcagcacccctgctcagcaggccttgtttgctttgtcaccctctgtgggttctggccacatccccaggagggaaagcaggtggggcaggaagttttgggggaaggggctgtggtgtgctaccccagctcatctgtgtggctttggcttctaaatgccagagctgagtttggaagtatcacccttctccagcacatccctgtaaagtgcttattgtgggcctggctctggacatggtagcagtgcgggcagtggttcacgcagtcaggaaagaaggcagctgccatgtaatcacacagcgtgacgtgtcttttgagaagcacatgggacattggtggagtgctcagaaaagaccatggggagaccacatctcacacagtctcagccacactcagtgtggcagctgctgtactgagcacaggaggggctgggggactggctggggtcaggtgtcaggaggccagagcaagccttgtgagccaagggcagcgggaggctgtggagtgaccagagtttgagtcagggtttttaaaaggtcccttggctgcccagtagaggtaggttgggggcaaggagatggtcactgctttccaaggccacacaatagtggcttggcccaaactgcagcagtggctgtaagcagtcagatagcatgatgtcagggacggagctgccctgtctctgcactgtgatggctgggaaggaggaagagtgagggtggacacgtcagtagtcaggtggccatcggagcctggggagcggggtggagctggctgaactcctggggaggggagccgctgtgcactggagctggtcccatcatgtgcgtggcagggtgggctcacttacccagggaccatgggagtgtgtgactgagacaggagggagggagtcagggagctgaggatgctggggcttgaggaagctgctggagtgtgggcagggagcatggtggtctgaaggcctgggagttcccaggagttgggaggggcagtggtgggaactgagcatgccgaggaagcaggcaggaccaggctctcgtcctgtagaggggaaatccaccgtgggggacagtccacactcacaactgcgctcacggtgccaggggcagtgatggatatgtttaagaaaagggctgaggaggtcgggcgctgtggctcacgcctgtaatcccagcactctgggaggccaaggcaagtggatcatgaggtcaggagatcgagaccatcctggctaacacggtgaaacctcgtttctacgaaaaatacaaaaaatcagccaggcatggtggcgggtgcctatagtcccagctattcgggaggctgaggcaggagaatggcgtgaatccagaaggtggagcttgcagcgagccgagatcgtgccactgcactccagcctgggcgacagagcgagactccgtctcaaaaaaaaaaaacgaaaaaagggctgaggatgggggcgcttcgtggatggggtcccagtggagggctctccggaggaatgggttgtagggagggctgggctaggtggagcaggaggtgcaggacgacaagctggtgacgcccagcctcctacgtcatgtgtggccatgactgctccatgtgaccacagcacctggactttgcagacccctgtgctccagattctctgcctgtcagacggatggtggtctatgcctgtcacttcacaggctctctgtatgggtcagcttaagctaagaaggtcaaagggctccaggtcactcttgggatacctggttttgcaggcaggcctggtgagaaagggccccgccatcagagtggcccacctgctggagttacgagagtgctcagggcggccagtgggtgcttgcatgctccttgactgcaggcccagcctccgcctggtgctctaccagcactggtccctccatgacagcctgtgcaacaccagctataccgcagccaggttcaagctgtggtctgtgcatggacagaagcggctccaggagttccttgcagacatggggtgagtgactgcctgggcctctgcagtgccagccctggccacccccaagggaaaagcccctctgctttgttgtgaccaacttagttataaaatgcagcctgttctgccataagctccttgccctagatcccagaatatcttctgaatgctggtgcggggacatcctcgcttgcccttggtttgggtttctttccaccctgtcggtgtgtggtgacctcactcatgtggcttgggcttgctctttccagtcttcccctgaagcaggtgaagcagaagttccaggccatggacatctccttgaaggagaatttgcgggaaatgattgaagagtctgcaaataaatttgggtaaacacacatttttctggatttatcttcattacatccaggttcattaaagtgaagggttctactttaactgtgctcctaaaataatgcaaaaaaaaccaacgtgctcctaaaataatgcaaaaaaaacaacaacccgagaatgtacaaatgagtgttatctgagtctggccattcctgaagtcttgagttctttttgggttaaaaataagacttcttcaagcttgtgaggtttaggatcctaggatccttggatcctagggctgctgtgggacctgtgaggtcgaccccagtctgtttcactggagacagcaaatgggccacagggccaggttcaggtgaactctgcccgaccaagtccatgggcactcctggaggcccctggcttctcccaccccagccagctggcatgctaaggtgtgagagaggaccccacacaccccctaagccagccataaagctgttgacaagaaggcacccggccactctgggctgcagggctggtatgtctggacgttctgacctgcctcatcctctgagcagcatggctgtgctggaagcattgacttgggcctgtgagggacattagcacatctgttggcctgcctggcagtgagagcttgcccacaatttgagggtgacagctgtgtttgctcccatgacaggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggtagcaggagggctgtgggtttgcctcatggggccaccactggttctcacactgcccagggaggtcagttacggggaccccagggctgtgggagtgactgtgtcctgcagaaactgcttgggtgaactggaatcacagtgccagtgtggtgtgcacctgacacattacctgcccctcttcagtatttgtcactttctcttgaatcttttttggcttttttttctttttgatttttaaaattttctctttttttaccttttgtatctcttaacaaaaggcattatttgttatgtatattcgttcttgtgtttaatcttatagttgtcatttctcaattttttaattttccaattctttcttatctcacttcctgagatgtcctatatttttccatgtcttttcgcttgttttgaaatggaatgtgacaatttggatcttttttttagcatgtctgtctagtgtcagactaaagacatcagagaaaaatatctccaaatacactgaatttatttgggaattagaaaagaggattatagtgtctgcgatgcacagctatggcaagccaaatatgcatccaaagagaggaggctaaggggacacttttattggcaaaaggagaagttcacgaaagctagcttggaaacaattcattggtttcagagactcagagccagagttggcgtcagttcagtggtgaagatgcattactgggcaagtgttatattttaagagcatcttatctgaattgttgcagtcctaaagaagggatttcttgtggggttatttagaaagtctttgagtctttattccagacatgcaagcaggagctctccttggtgctttcccagctttaatttgtttgggcctgtcaaaaagtgatttcatcctgggatctgcaactttcacattagtgtactttcattatccagagaggtgttattctgtcccttattctctttttttctaatagtgactttgaggggatttgactttgctacttctctcatgctttttatgtataaatttcatttccctgactttttaggaggaggaggcatgattcagacagcttttctggcttcacagagctgccacttctgttgcttttgtgcagtggtaaagatgcatatgtatatatgggggcctgctttctgggatttcctggttctgctcccaagcacacttttttttccactgctttattgagatacaatttgcatgccatacaattcacccatttaaaatgtacaatgtgatggcttttatttattttattgttatttttttagagacagggtctcgctctgttgcccagggtggaatgcaatggcatgatcatagctcacagcagccttgacctcccagtctcaagcaatcttcctacctcagcctcttgagtagctgggacaacaggtgcatgccaccacgccttgctaattttaaaaatttttgtaaagatgtatcactatgtggcccagactggtctcaaattcctaggctcaagcaatcctttcacctcagcctcccaaagtgctgggaggaacaggcatgagccactgtgcccagcctgcaatgacttttagtaggttgcagttaggttttgcaaggttgtgcagcaatcaccactatctaattttagagcatttttgttgccccagagagatcctcccagcctctggcaaccaccagtctcccttttgtctttatgaattggctgttctgagcatttcatacaaatgggatcatataagatatggttctttgtgaccgggttcttcacttagcatcatatttgcaaggctcatctatattgtaggatgtatcgggattatatgtcttttccctcgtccgccacctgagacagagtctcactctcgctcaggctgtagtccagtggcacgctctcggctcactgcaaccttcgcctcctgggttcaagcaattctcctgcctcagcctaccgagtagctgggattacaaacgcatgccaccaagcctggctaatttttgtagttttaatagagacggggtttcaccgtgttgttcaggctggtcttgaactcctgacctcttgatccacctgcctcggcctcccaaagtgctgggattacaggcatcagccaccatgcccggccagtgtctttttattataaataatattccattggatggatatattctatttcatttatccattcataagttgatgggcatgtggtttgtttccacctattgacaattatgactaatgctgctgtgaacttgcatgtacaagtttttgtgtagtcatgtctttgtttcttttggttatatacctacatgtggaaatgctgggtgacatggtaacactaggtttcaaggaactgccagatttttgaggaactgccagacttttccacagcagctgcaccattttacattcccaccaggagggagggtttcaatttcttcacatcctcaccgacacttgttattgtccatcttttggattacattcatcctagtgagtatgaagtggtatctcgttatggttttgatttgcattttactgatgactaatagtgttgagcatcttctcatgtgcttattggtcatttgtgtatcttgttaggagaattgtctattcaagtcctttgtctttttttttttttttttttgagacagggtgtcactctgttgctcaagctggagtgcagtggtgcagtcatggctcactgcagcctcaaactccttggctcaagccatcctcccacctcagcctcctgaataggtgggattacaggcatgagctaccacacctgctaatttttaaatttttagtagagatgagatcttaccatgttgctcaggctggtctcaaactcctgggctcaagcagtcttccagccttggcctcccaaagcactgggattataggtatgaaccaccgtgcccagcctaaaacttttatatattctacatacaaatcccttatcagataagtaatttgcaagtattttctcccattctgtaggctgacttttcactttggcagtgtcctgtgaagtataagatttgttaattttgatgacatttaagttacctactttttcttttgtttcttgtgcttttggtgtcatatctaagaaaccattgcctaacccaaggtcatgaagatttcacattattttttctactaacactttaatagttttagcccttacattaggagtatgattcactggaggttttttttttttttttttttgagacagggtcttactctgtcacttaagctggcatgcagtggcatgatttccactcactgcaacctctgcctcccaggtagctgggactacaggcatgtgccactgcacctggctaatttttgtattttttgtagagacatgttggtcaggctgggccccttactctttactatagtctccttacacttcagcaaggccccttgctctttaccatgcccccttatactttaccaggctcccttgctgtttaacaggaccccttgctcattaccaggactccttgcactccagggaggctccttaaactttcccttggcccactgcactcacctgctcttgcatagggcaaaactctcagtttgggccgctgctctccagttgcctggagttttaagtcttcttaggtctcactacctcttggctttctctcgcactgatgtagatagtatacctgtctggctgttcatggtctctttttacctgcttacactttggggtttgaagtgttcccttgttctcttaatttgttgcaaatgtgggtcctaggtttttggttttgcaatctagttgctctacttttatctagaaatttgggaaaatccaaaaactattttaccactgttgctgccatcatcccagcattgatgggtaggctttagacattgtctaccaacttcctgctatgacaaaggagcatttatcccactcttgtccaccttccctcctgttggtacagttttgccactatttttaacttctttgtaactttaacatatttatgtcttctttcatcactagtatctcgtctccctactttgtaagaaaaggatatttaaaacactcttagtccattttgtgttgctataaaggaatacctgaggctgagtaatttataaagagaaaaggtttatttgcctcataattctgatggctggaatgctcaagattgggcatctgcatctggtgagggcctcaggctgcttccactcatggcagaaggggagctggtgggtgcagagaccatgtggcaatggaggaaggaagagagaggaggaaggtactaggctctttttaacaaccgtcacgggaactaatagagtaagaactcacttacaccccctagccccagggagagcattcatctattcatgaggggtctgcacccatgacccaacacttcccactagaccccacctcgaagatcttggatcagatttcaacatgaggttttgaggggacaaatgtccaaggtgtagaaacagccttactttgctcttcagtgctgctcagtactttctgaaatttgtgcttttacgttttcaagactgataacaatcttgggttagagaaaaagatataaattgtcttatctttggttacaggttgattttaaaagttgaaagtaaacaaatagttttactttattgtgctaataaactattccagagacaatcatgtgtagtaatagattactatctggcacggctctttgtttttcctgctgtttttaattgcctcctttatcacatccatttttttctcctccaaactccttccagctgtttttctgtgagcccctttttgctggagagtctggggttctgtcttcccaccacagcctggacctacagctctctagacctgctttccactgtccccatggatgtccaaatcttggctgtgcctcttagtttagtccaatgtttcttgggatcttcatctttgtttcatttactccctcattaaattagagcacagttcttaagtaacattcaaagaaagggcgcatgtgagataaactttctgagttcttatatatctgacaatatctttattttactatttctttactattccccccacagaaaacatccgtgttttttattcttgcttttcaggcttcctggaatgacgatgctctgtcttatttttttgccttacattttccatagctttgtcttgttatctatgttgaggaagtttttcttgactccagacttggagtggatgttttatcttttgcaactgttttaatttccatcaacatttcctagtttttaactcttcctttttcatagcatcctgttcttggtttaggaatgtaagagttgcacacatctctctgaagatactaattagagttcagtttaactttctttagttctccaaattatctgtttcttcagggttatttttttaggccataggcatttctcaaatggtctgatgtctttcatattcaagaacgggattgtggacccttggctgggccatgggtatctgggcacagctcactggtcataagacatcgtttcaccttagcaggcaggagccaactgtgacactttgggactccccactgtagggcccagaggctttgcttgaggattctacttattcacagatggtacatttcatatactcagaggggagcctccctttttgtggggaagagtaaaaatctatctgttgggtttgaggggatcccttgtccaacctccagcccttgcccaagcctcccctgtgtcagagtcctcctgggccttcaggatcttccctttgttggcttttagtttcctgtcttctgatacttgcacccgctccacctctcatttgcattactgtgggtttatacattttaaaaaattctttcctttcatgtgaaagacaactcaggagggaaagaagataaattcttacccccaaacctcttcctgaaccaggaaccaagcaaactatttgtgactttggtattttaccaagagttcctgacaagcaccaccaaagccatgtgtctgccctgttacaggagtaacctggacaagctgtaccatggcctggaactcgccaagaagcagctgcgagccacccagcagaccattgccagctgcctttgcaccaacctcgtcatctcccaggggcctttcctgtactgctctctcatggaggtcaggcttcccacagagcacaggcgcctggtcacagcaccagtggcttcgtctgaccatctgtctcgcctccgcagggcactccagatgtcatgctgttctctaggccggcatccctaagcctgctcagcaaacacctgctcaagtcctttgtgtgttcggtgaggggccaggcgggtgctgtgggtacaggagggcaggtgcttggagagctccctggatggggagttagatgctggccttggggtgcctgtggctgttgaccagctgcaaggtctaggcacatccattactttttctgagctgtctttttctcagctgacccctaggaaccttccagttctctcaagctctgattcatcactggctgtctaagtcactcagacaagtagggaggggcccttgcagagtgaacagggctggggcttgtgtcctattgttgcaggtcagggaaagcgggatggttgtagcaccgactggcttcccagcaacagcttgtccactaagctgatttcctgtgcctggctttgtcttctgtgtggcctaaccccctctttgcgttggcgtggaacacactcctaacttggctggctttagggcaggggtcctcacctagccgacatggggctcctcccagatgtgacatgtcaataattgaagtcctcctctgcttcgaggatgagagtttatgccgggggctatttcaaacaaaatgtgctaacaggaagttgaacttttcttttgccgctgaactaaccagtaaaatgatgacagatgacatgtgttctatcaaccaggtaatgtcaaagataaactagggacagagcatgggccttgacgtcctctaggctgtgttcaaagatgagcctcctcatttgccagttgtgtgacgtgaggtagatgatctgacctgatcctcagtttcctcatccgtgaaatgggtgaacacatacccactttacaggatccattcatttaccagacatgtattgaacatccaccacctgcccggccctgttgtggagtgactgcccatcctggtgcacatcctgggacacccctcagtcctagacacaccaggaatactggtcacctgggctgtagggtgtgggtgcagcaggcacagcagagaaggaaaccctaaacctttatcctgaaggagcgtgccggcgggggggacgaggagtggcagctgcggttaagatgaggggatgtgctgccaggggatggagcaggatgaggcggggtgggctggggcctcctggagaaggtggcagctgctgcaggacctgaaggaggtgagggagaggatagcagggcaggctccttgcaacaaacagccaaggggcagtggggctaggctggtagacaaggaggctcggggacacagcatcacagccacagtaccatgctgtgggtacgggagggcaggtgtttggagagctccctggactgggagttagacactggccttgggcatctaacttggggtggctgggtggggaccaaggcgtctcctggtgacagcgtccctggaggctttggggagtggagtgactgggcgctgttgggctctgggctctgagtgttgagctggggcccaccataccctgacggagggtgctctccgactccatagacaaagaaccggcgctgcaaactgctgcccctggtgatggctgcccccctgagcatggagcatggcacagtgaccgtggtgggcatccccccagagaccgacagctcggacaggaagaagtgagcagcttccactcgtcctgggactggagggtcgggggtgttggggttatcagcttattagccctgctgagtagagtggtatttgcctctagtgtctgtcctggggcggggggtgggaagggtccattgcaggccgcctggcccccgacatgtcttgtgtgtcagcagcttttttgggagggcgtttgagaaggcagcggaaagcaccagctcccggatgctgcacaaccattttgacctctcaggtgagagtctcctgccactctgccacactttcccacctgaccctttgaggctattgcaggccctggaaccaagcaagttggcatggctggaggagcctggccagcagccctcttgaccttccagatctggccctgggacaggctactcctggtggctcagggagctctggtgaacctcaggcccctgagagggaaaaagtgttttccagggaatgactggcctggctgtggccttacagcggccttacagccagtgctaaggatcactttcccagcaagcctaggggactggccaccagggcccgtgtgccccgatctcacctgtcagggttgggttgtttctgtttcatggggtgagggaacagcagggcccgtgatgacccaggacaccaacccttgctgcgccagccacctctccacaggccggggtgtgtgtcgtgataggtgctacctgtgagatggctgggacaccggccccacctgtgtgtcagatgagcccagaatggataggcctgcctgcccactgcttccccagcaccagcacggaacatggttcacattcggctgtgttggcgttcttattattgttgacaggttttaaagtaaaacagacgtattgatatttcaccccgggttagtttgctaaagctgccataacaaagtgccacagacagggtggcttcaaccacgtgtctcctcccagtcctagaggcgagaaggcccaggtcaaggtggggcagggctggcttctcctcaggcctctctccttggctcacacagatgaccaccttctcactgtgtcctcacgtggtctttcctctgcatacctccttggtgtctgtgtccaaaccgtttcatcttccaaggacaccagacagattggattagagcccaccctaacaaccacatttgaacttaattaccatagtcacattctaaggtcctgggggtaagggcttcaacatagagatgtgggggagaccgttcagctcataacaccctcagtacttcctgcacctctgagaaaggatattttcttgcctcatcaccacggattcctcaacaatgatagacactgtcatgggagatccagcctttgttgaagtggcgtcagccatctcagagctgccttccttgagccagacccagccatggctgtggcactgtgtggcattggttcaccccgcacagcagcccctgctaactcttttgtgcctgtgatgtgggagaggtggatggacacccactggcctgcagaatatctggccttcagtatacagggaggactcgggctgggaactgcttggtttccctgagggtggagagccaggggtgagggtgcagagtgggccatgtctagtgcccacctgcgtgggctgggtctggggctctcggggctgtggctggcagcatagatggctcccagggccaggccagccccatcctggggcctggttttgctttgtggtgagggtctgggtgctcagctgagcctgagggccctgtgagatatgggcagtttgcaccatgtccccttgtgcggaagagaacactgaagccgaggaattggccagagtgcggccaaaagtgacctgccccacccaaggacttccacaacccactctggggacgggggttcatgccagctggggtgggcaggcccgtgtttgtccaggtctgtagggcccttccctgtgtcacctctattgtcttcccgggggggagttctccctgcaggccccaaccctgacctctctagcagtgcagacagcagttgtgaagatgaagtacagtgagacagacacaaccactgagtgcagaataccacaggccgggaggagccgcgcactttggaatgcagtggagggcaggcagcggaggggagttctgtgccctgtcttgtgttcccactcctcccttctcacggctgtttttctttcattacttcagtaattgagctgaaagctgaggatcggagcaagtttctggacgcacttatttccctcctgtcctagggtgagttacaggggttctgcaggggtggctgcagcagccccctcagagcccgaccctgatgccctgctctgtcctccctcaacggaggcttctacttgggtttcagaccgaagcagggttcttgagattggagccaacacatttttcccaagcacatctgtccttaggctgccagcagggccacaatggggcattttgaggcagctaatttcattaagcccctgcgatcccttcagaaagagctggtattcaccctctgctgaccacacttgggctgggcatcgcgtgtgacacatgtcacacacagactccctggtgctgccctcgaaggccacctggagcctcctgtcccacagccttcgtgtcaggcgctgggcaagagcccgcagagcagccatccgggcttttgtgtgcttggctcatgagaaagcaaagctgttggcagccgcttagctgggaattccaaagcgctggttctgctggggccttcaccagcacacagctgtcctgagggccccattgggattcactggcaggtcactgtcccgggacacctcccactgccccatgtgctacctctttcttaagggttcccaggaaataggcctgccttgtgtctttgtaaccatctctcagcccaggttccccacagggaatgccacatccagccctgcatctcccagagccctagcctggaggctgcggctgtggcagatgggccctgccaagactctgttgcaggaggtccctcaggccaggcctggggtcctccccactctcccatccgtccgtccatccatccatctgtccatccctccaggggcaagcacctgttctcctgttggggctggagtgggggtttctgctgacaacagcatagggggcctcagggaccccacagttcctctcagggtggcctgggctacatggggcccattttgggcgcggggctctgagtcagaccctcggggtttttggcaagttctgtagggtcatcagcagtgaccttgggccagccacctaatcaggcttagcctgtttcctcatccaaaaatggggcccactctctccttagacgatgagtgtgagcatcacaggactgcatagggtggggcggaggcagaggtggggctctctggcagtggagtgggtgctagaggcaaacccctcccctgcagcctgcttggtggtgatgttatgctgctgtgtgtccttccactgaggcaggggcacaggtggcctgggctaggagggctgagcagcagagtgccgagggatggagggagagcccccatgggagggtgccagggggctggctgagcagctgggcggggtccgtgaggtaagaaggtgcccgggccagggggcaggagctctgatgtaggacagctcagcccagtcaaggggtgctatgaggacagcaggggcctccgagtctggggtggcctcacccccacaagcagtcctggctactcagcagcactacccagaggggacgcctgggcagtttcttcaattcggtggcacatcaacatcgtttgaaacttgttttttcttgttttgttttctagaatttgattcttccagaatgaccttcttatttatgtaactggctttcatttagattgtaagttatggacatgatttgagatgtagaagccattttttattaaataaaatgcttattttaggctccgtcccca

SEQ ID NO: 415 - DNA, 53112 bp, Homo sapiens
ccagtttccagctcacccggctcccggttgatctcgatgtcgaagtggcactgcggccggtcctgcgcccccatcgcgaccgaggtggcggcaagagctgggagagagggggagaaaagcggtcagggcaggggcgagggcgggggcgagggcaggggcgagggcggggctgagacgaagtccgcgccacggtgcctcacgccggcccgtcgcgacagcgcaggaggccaagacgaggccccctcccgccccgggcctcgcggctcccacgcagcgcgcacgcatgcgggcgagctcttcacctggctggcctccagcctgagcgggtccccgtgagcagaagagaaagcactgccactgcagccaaaccccaacgccgctaacggaacgccgtctcctcccccaggccgggcctcccaatgccacgctaaaccccgcgagagtcgggacaaataccgcgagagtacagtctagatgggggtggtcaaccgaaggtggcggcagcgggggcgtacgcacgggggcgtacgcacgggggcgtgtctggggagctctcgaggagcctccagccagcgctcctatacctgcgcgttccctgtttgcccccccctttgaagtcagtcgcccaatctgaaagccgtggatgcgcctgcgccctccatctcgtcaggtgtggctgtgagcgccgcgcattttccgataccgcgagacttctctgtttccgagcgctgtgaaggaactgagtgaattgaggctttgagttttcgttagccaagacgttgtgttgctctgtgttctttttggccgggagtggttatgtccgtgtcctactgttaggtcttttaggctgaagaatgcgttccttcccgctttggcaccagcgtcactggcaccgtttttgtcctgtgcttactgaccattctgcatcttttgtgaagtttcagttccagtcttctgcccgtttttaaatctggtccttcgtgtttaacagttctggatacaaatgttttgttagatatatgtatgctctgaatgaaaatcttttgttacataaatgattgcgaagtctttttcccaatctgggcctgtcgtttcattgttttgacgtttttggcaaagaagtttttaattctgattaagtcaattggtcagttttatattttaatggtttgtgcttttcctgtgctaggaaatctctgcctacctcaagttcttgaagatattctgtgttctcatatatgttttacatagtctttaacgtgtaagtctatgatatgatctaatatcattaatttttgcttatgttgtcaagtaagtgtcaacattttcctattgggatatacagtcgttccattaccgtttgttgaaaagactcttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgaaaagactcttatacattgaattaccttcgccttgtgaccatatatgtgtgggtctgtttctggatttttgttccaatgatctgtgtctgagtaccacactattttataagttttttttttaaactataaaatacacattacatgggcgggcgtggtggctcatgcctgtaatcccagcactttgggaggccgaggcaggcggatcacgaggtcaggagatcgagaccatcctggctaacacggtgaaaccctttctctactaaaaatacaaaaaattagccgggcgtggtggcggtcgcccgtagtcccagctactcgggaggctgaggcagaagaatggcgtgaacctgggaggcagagcttgcagtgagccgagatcggtccactgcattccagcctgggtgacagagcgagactccgtctcaaacaaaaaaaatctatctatagatctatagatctacagatatctagatatctatagatctatagatatatatacacattatgtgaaagttgccattttaaccatttttaagtgtacagttcgctggcattaactgtatttcacacggttgtacaaccctcagtacctcccatccgtccacagaacattttccatcttgcaaaactgaaactctgtattattaaacagtaactccccatttccctcttttcccaagttcctggcagccacccttctactttctctctgtaaatttgtctactctagtatttgtctactcatatgtgagtaaaatcatgtaatatttgttcttgtaggctaggtgcggtggctcacacctgtaatccctgcactctgggaggctgaggcgggtggatcacatgaggtcaggagttcgagaccagcctggccaacatgatgaaacgccgtctctactaaaaatacaaaaaattagcagggcgtggtggcaggcacctgtaatcccagctactcaggaggctgacgcaggagaatcacttgaacccgggaggcagagattgcagtgagccgagattgcgccactgcactccagcctgggtgacagtgcgagactctgtctcaaaaaaaaaaaaaaaaaaatttgttcttttgtagctgggtgatttcactcagcatgtcttccatttcatccatgttgtagcatgtcagaatttccttttttgaggctgaataatattccattgtatgtgtatatcatattttgtctatccattcatatgtcagtggatatttagattgcttctaccttttggctgttgtaaatagtactgttatgaatgtgggtgtacaaatacctctttgaaacctgctttcaattattttggatatatgcccagaaatggaatcactggatcataagctaattccatttaagatttttccaggaattaccatactgttttccatagctgcactattttacatttccatcagcagtgcacaaagtttccaatttttccacatcatcaccaacacttgttattttttggttttctttattgccatcctaatggatgtgaagtggcacactgttttaattaatgtagttttatagtaaatttggaaattgggctcacttagattgggtgtccaatcttttggtttacctgggccacattggaagaataattgtcttcagccatacataaaatacactaacactaacaatagccaatgagcttaaaattgcaacaaaatctcatatttcttgaaagtttatgagtttgtgttgggctgcacccaaagttgtcctgggccacatgtggcccctgggtggcgggttggacaagcttgacttagatcatttctgacctgtttctgcacctatgtcacctttttttttttttttttgagacaaagtctcgctccgtcgcccaggttggagtgcagtggcacgatcttggctcactgcaacctctgcctcctgagatcaagcgattcccctgcctcagcctccagtgtagctgagactacaggcacacgccaccacacctggctaatttttttgtatttttagtagagacagggtttcaccatgttggtcaggctggtctcgatctcctgaccttgtgatctgcccgcgttggcctcccaaagtgctgggattacaggcatgagtcactgcacccagccgtccatgtcacctttttaaagtacagtcaaacctttggtacttccacaccatcacagaagtgctgtcctttgttagagcttgcccattctacctccctgagagtccagtgtgtctattagaggagcagtctgtaggctgaattgagaagctagcggtcttgggtctgattttgctgacaattacagacttgaacagtatgaaatgtacatgcctttctggagatgaaatagtttgataaagctaactttcatacatggattcatgaaaggaaaggatggagaccattacccagctttgtaattaccgtgtttaggacatcaggcttcaatgtaaataggttttagagctcaggaatgaaatatttaatttgggatatacttaaacaactttaaacctagaattcattcttatcttgacattccagcaattctcttctttctgccactggttatgtgacctgagacaaatcactttgatctctctgaagtttactttcttcatctgtaaaataaatgagataaaatatctcctttctaaggttctgcctctctcaaagattattttattctgtcttgtgatttgaaattatattttagatgattcgaagataaaagtatgcaatttggtctgtgattaaggtgaagaaactcctgggacaaggcaggcctagggctagtatcaaccaaaatgactgacacctcctccatctcttccaagagtggtagaaagttggtatccaaagagtttacaaactcaggcttaatttgtccatgatttatcatgaagaagaaccactggtagtacgaattttcaggtaatgattctggggttcagccttttagagtgtgattatgccagcaattagaacttcaggggataggactctggaaaaccatcaggaatgctagtggggaaacagacaaaataattttctagaaaacagaaatgatcggctgggcgcggtggcttacgcctgtaatcccagcactctaggaggctgaggcaggtggatcacctgaggtcgtgagtacgagaccagcctgaccaacatggagaaaccccgtctctactaaaaataccaaaattagccaggcatggtgccacatgcctgtaatcccagctacttgggaggctgaggcaggagaatcacttgaacccaggaggtagaggttgcagtgagccaaaattgcaccactgcactccgacagagcgagattccgtctcaaaaaaaaacaaaaacaaaaacaaaacaaaacaaaaccaaaaaaaagaagaaaaagaaaaaagaaagagccagagccctcagcacattagtgctaacatagattaacatgtgcccagttctcaaccacgttatctcagtctcacaacctcaggaggcagatgctattttcattatcctcactttagaggtgaggaaacagagctttcagaggttaagggatagagctgggattcaaaatgagttatctcttcactatttacatgtattttacagttgccctaggttgcaacccttgactccaaaaaaaggagcagggacctgggcttctaattttggatatacttacaagaatccctttgcctcatctttcagataaatctccaagagtgaaagttttttatagaatacagctaataaagtcagaaagaatgataaattagaaaatcctcattatgtaatccctaatgaattaccacatcaaagctgggtggatcataatttaagtgaaaggctggttgggaacttaaaagtcaggtcactccttatgtgatgcaaaagcaagtacttatcaccttctaatatattcctgctaaaaatattagaacatgagtctgcatgagcctctagatctactagtttacaggaaaagtggatgatagtggcacataattaacaacactacagagatacaactgtatgtagaacacgagagaattctagggtaaacacctagttatttcaacaaataaagaaaaaaaggaactattaagtattctttaagtgacttaaaggaacatcaacaaaatacaacatgtgaatcttatttggattctggttcagacaaatcaacaaaaagactatctgataactgaagaaaattaaacatcatctattatcagatgatattagataataattagaaatcactattcattttgttggcaatgataatagtattgtttttatatactttatggttaagtcctcacagttattcttgaaaaccaaatggaatacttattacatgaaaacttctatacctccacatcagtattttatagaaaaataagctttatttcaaagcaatctgaaaacagcagtcagggggaccacatttacaaactgataggaaggagcacacagttacatgtccatttagcaaggtatcaagtcaggaatctcaccaattcctgcccaacacctactgagtttcctcttcaggttgaaactaaaaagtagacttgaacatcccagtgatgtctttgttatccaaacatgctccaagttcaggaaagaggacacctgggctcaacttattgagggatttgcttaattatttaaaaaatatttacatgagaatacagctaagttagtagctttcttcacattttcacgtttcgaaagagccacagaggtttcattcatgttttaaccagttgagttggtaaagaccctgtctccattttgtaagagatggattacattcaattactcctcacgacagccaaatggaagattattctattgcttttgaaagattattccattgcttttgaagtgctggttggactggcatctgcaatggtagccaaataaatgagatttctatgtaacacatgctggtacctatgggcaaaaaaacaggcaaaaatcagaggcttgtttttaccgaccatgaacaaaaaactggaaaataatttacccactctagtggaatggctcatccactgactggatgattcagtgttatcaaccttcttgtttaacatatttaaggaaaatatagtcagattctcacccattcttactgattactttcatagctactatcatttcttgcttgaactattgcagtagacacctagtctcccagatctatctttgcgcacctactttattctccacataacagcctgagagattactgtacaatttaaatcaaaatcatgttatatgtctattcaaaaccttccaaaggctcccatctcattcaggtaaaggtgagctgttcttgtgtcctaataaggccctacatgatgggggcctccagtccccctctgatctcacctcttatggctatacctttgttcactgaatactggccacagtggcctccttctgtgacttgaagatatccggcacactcctactagggggcttttccacctgatgctttctctgtcttacttatctcactatgccttactactgcatagctggctcccttaccccaggtctctactcaaatatcaccttatcagacataccatgtataaaatagcactcctccccccacttactctgctttattcttattcaaagcacttattattatgtgcctaattatacatttccttatagattctagagtctagaatgtcagctctgtgagtgcagagctggtatctgttttactatggatttcccagagtctgaaacagtgcctggtaccaggagtacaattgtcccttggtatccacagaggattggttccaggacacctccctcctccccttagatatcaaaatctgaggatgctcgagctcaagtcccttataaaaaatggcatagtatttgtatataacctacacacagccttccatatcatatactttaatttatttatttattgagacggagtcttgctctgtcacccaggctagagtgcagtggcgtgatcttggctcactgcaacctccacctcctgggttcaagcaattctcctgcctcggcctcccaagtagctgggattacaggcacacaccacgcctggctaatttttgtatttttagtttttagtagagatggggttttgccatgttggccaggctggtattgaactcctgacctcagatgatctgcccgcctcagcctcccactgtaatgccacagtactgggattacagggatgagccaccacacctggctcacagtttaaataatctctagattacttataataactaatacaacttaaatgccatataaatagttgttatactgtattttttttattgttgtgttgctatttttcattgttttgtgctccccaatatttttgaaatgcaatgcagaacccatggatacagaggaccaactgtacttataaaatatctgttcaacaacttcaagaagggacaaaacattttcatgatcaacataagtttacggtggggggggtagagttcttcacccaaaaaaataaatcagacaagggctcagaaagcatggcctgtgcaattgaaaaaccccactaggagattttgataactttcttacccttgggttgagaattactgtaccaaatggaatgttttgcaaccatttttcatatagaaaaaggagaaggtatttaccataaacttttaaaaatcaaattaccaaatgccagagtcagatgtaaagatttacccaaaaactgatatctctactattctattaaggtattcagtgagggactgtaggtaatttttctagggggtagggattgtgaaacatttcttcagtaacaatgaaataatatatttttctataagaaatgggcataaggtcggccgtggtggctcatgcctgtaattccaacactttgggaggtcgaggtgggtggatcatctgaggtcaggagtttgagaccagtctggccaacatggtgaaaccctgtctctactacaaatataaaaattagcagggcgtggtggcacacgcctgtagtcccagctactcagaggctgaggcacgagaattgcttgaacctcagaggtggaggttgcagtgagccgagattgcaccactgcactccagcctgggtgacagagggagactgtctcaaaaagaaaaaaaaaaagaaaagaaaaaaatgggcgtaatacctggactagattcggaaaagagactcagactctattttctctcattttggtatctacttagggagtgcattaaattattatgcacaatttacctttgacttaacttgtaaatcctttgtttgtctttgtgtgtgtgtcactaacagactgacgggaagttagaaatgagaggaagcttagcagtcaaatggcctgaccccttcacttaacagagaaaggatgaggcagggatccaagatgagaaaggggccatggctctaatctcctgagcttagttttctgtgtgctctcacccccatccctgttgtcatcagccggcatagctttgagtgaaggaggctttgcagtgagaataattcacattttgaagaaagagccacgtctgactccaggctccgcagtgtactcgttgtatggtcttgggcaggttggcaaactctttgagcctctctttcctcagttcaaagaggggcttaactgcgatcaatcacccaagactcttagttcgagaaagcaccgcatcacacaggcttcccctctacccacaggtcaggggcgcgggggtgggggtacttactgcacgcactcgttcccgcggcccttgttctgatactccacaatacagcggatcagctggtcattctcctcaaggagctgaaagatcagagaaagaaagggtcagtgcaggccgggcgcagtggctcacgcctgtaaccccggccctttgggaggccgatctaggcggatcacgaggtcaggagttcgagactagcctggccaacatggggaaaccccatactaaaaatacaaaaattagccgggagtggcgtcgcgctcctgtaatcccagctactcaggaggctgaggcaggagactcgcttgaagccaggaagcggtggtttcagtgagccaagatgcaccactgcactccagcctgggcgacagagcgggactccgtctcaaaaaaaaaaaaaaaaggagagaaagggttagtgcagtgtgacgtctggacggcgggggaccgaaccccatgccggggtcctgccccggcgcctgtgctgatttcgtgcccatctcaccccgcaccccggctgctcagcacccttcacagtcagctgggaggccgctcactacaggatgcttctcgcaccccgcagcccctcgggatcccgacttctctccgcccgcccgcccgcccgcgtggatgctcacccgctggatagtctcttgattgacttccgccttgcccctcagccagtccggtacgaaggccaccgacatcccgaggaacctccggaaccacgaccgccaagcaactcgacccacgataggtggggcctacgctctcgaagttgattggatgctcccgcctacagggcggggtacagaagggacgtcatttgtgactggacgcgcaagagctatactcagcgctttcctcggtcccagcccccagaacgccgggggcgttttcgtatcctttgcgcttgcgcagtctggagagcgaaacttgtgggttggggctgggtctactgctgacctacctggcgtcagcacctccagtgttaggctgtgcatgctttttttttttttgagatggagtctcgctctgtcgcccaggctggagtgcagtggcgcatctcagctcactgcaagctccgcctcctgggactacaggcgcccgccaccacgcccgtctaattttttgtattagtagagacggggtttcaccatattagccaggatggtctcggtctcctgacctcgtgatccgcccgcctcggcctcccaaagtgctgggtgtgcatactcaatctatctgcaggagcggtttgctcggcttcacccagcgtgtctggcacccagatacatggcttcagatccattgtcctctctacatcactctgtgcctccaggtctgcatctggagcatgaacattggctatggcattgtctcctgccaggccaaatctgcaggccaggaaaactctggtattagctttactctttgctgaacgagaaattcgcgtttttccacatagcctggacttatttggggcaggaataatgcttattaggttggcaaccctaaaaagcactggtattttctccattttacagatgacgaaacaggttaagtaacttgcccaaggttccttagcaaagccagtctctgaatacgggcagcctggctttagaactctcacccttaacaacccgggactgcccaggcaccataccgcaaaggtgttgtgccgcaagatgcaaggaggaagctggacataccttcttgggccacatggttactcctggtgaccactgcaactgaattggttgtagtcttctagaccagtggtccccagcctttttggcaccaggaattggtttcgtggaagacaatttttcttgtcttccacggaggtgggggtggttttggtatgaaactcttttacctcacatcagcaggcattagattctcattaggagcgcgcaacctagatctcttgcaagtccagttcacaatagggttcacgctcctgtgagaatctaatgctcccgctgatcctaatgcccccgctgatctgagggggcagaatgctcggcggtaatgcttatccgccctctgctcacctcctgctatgcggtaccggtcccctgttctagccatccgtggtggatgtggtaacaagattcgttttccctggagtgagcagcggccacttcatttaggagggagatcttgggaacctacactcctaaaaaggggaggtccctagagctttattcccctgagtggtggccctgatcctgagcaagctcatctgctttactgggctttctctccacaatccctttattcaaacctgtgaaaaggcagctttcatcccatttcttttttcttttttttttgagacagagtctcgctctgtcacccaggctggagtgcagtggtgtgatctcggctcactgcaacctctgcctcccgggttcaagcgattctcctgcctcagcctgctgagtagctggaattacaggtgcctgccaccacacccggctaatttttttttttgtatctttagtagacatggggtttcaccatattggtcaggctagtcttgaactcctgacctcgtgatccgcccgcttcggcctccaaaagtgctgggattacaggtgtgagctactgtgcccggcctgctttcatcccatttcacagagaggtaaacccggtgagagaagtgaggtaacacctgagctggggcggactcagggcttcctggttaccaagcctgcactgttaactccacatcaggcttcctcctcaggaaaattccccaaagctttcagagacacagagtgggcagaaaaggaaacatcaggagcaggatacaggtcttccgtagttccactcagccctattcctgtttagacaagtgaggaatgacaataacatgagatggtccagacaacaatcctcccacctgtgaaagcttccctgggattatgggcatgaaccaccatgcccggcctatacttttgttcataaagtttaagtgacttgcttaccaatcttatgcaaaatttcatgtaatttatataatactatataacataatgctacatatggtatgtatatatacacacaaagatctgtcctgggtattaagtatcttacctgtaggctttatgtttatggctctgaaatggagggaactgggacatacatgttttgaggaataaagtgaaggggtttttttgttgttgttgttttttgatacaaagtcttattctgttgcccaagctggagtgcattggtgcaatctcagctcactgtaacctccacctcccaggttcaagcaattctcctgcctcagcctcccgagtagtctgggactacaggcataagccaccatgcccagctaatttttttgtatttttagtagagatggggtttctctatgttggccaggctggtcttgaactcctgacctcatgatctgtctgcctcggcctcccaaagtgctgggattacaggcgtgagccaccgtgcctggccccggtttttgttgttgttgttgttattgttgtttttgtttttgtttttttgagacagtttcactcttgttgcccaggctggagtgcaatggtgcaatctcggctcactgcaacctccacctccggggttccagcaattctcctgcctcagcctcccaagtggccaggattacaggcatgcaccaccacgcccagctaattttgtgtttttggtagagatgggggtttttaccatgttggtcaggctggtcttgaactcctgacctcaggtgaaccacccacctcagcctcccaaaatgctaagattacaggtgtgagccacagagcctggcctaaagcgaaggttttgagtgaggtttatataaggatttgattttttttttttttgagacggagtctcgctctgtcgcccaggctggagtgctgtggcacgatctcggctcactgcaagctccgcctcccaggttcatgccattctcctgcctcagcttccccagtagctgggactacaggcgctcgccatcacgcccggctaattttttgtattttttttttttcagtagagacggggttccactgtgttagccaggatggtctcgatttcctgacctcgtgatccgcctgcctcggcctcccaaagtgctgggattacaggcgtgagccaccgcacctggactgattggttttttaacatcattaaagtttctatcaggtaaaaaaaaatgagatggtgttagggtgaggcaggtgttataggggaccaacctgttccagcatacagggaaagacctccagaagaaaaggtttataaaggcagtataaaggcaaagtggaggttaagcaggacacaggtgtccagattctgtactctcctaggagtaatgggagccatggatggttttaggcagaagaatgatgaagcctgagatgcatttagagttttattggctgtaacatggtgaaagttagggaagacgcccagatgagaaacaaaaagaacagtgacaaggctgctacaagcatgcaggccagagatagtgggagcaatgagaaaagaagtgtgtgcatttgaaagacattagaagtagatttggcaggccttagtgatcaagtggggagggaaagaaaagggaaattagggatgccttctggggttctgggttaagcaactgagaaactggtgatgccccttatgtaggcagggaacagtgggggagatgctggaatggaaatgaaggtgatatattcagttgtggaaatgtacagtgtgaggtgatgtcaaacgatgttgaggcttgtggctatttggggctgaaactcagggacaaaggctaggttggagatacagctttgagaaacatcacttgtagaaactgactggaactatgtagtggataagactgcctaaggagaatgtgatagtttctcttatggcagaggaaaagaagctgcaatggagactgaggggagaaagagactagagatataggaagaggaaaaccaggagagtgggggttatggctttttttttttttttaaacagtgactgaaaaggacatacaggacagcaatgacaaatgctgttgaaaggtcaaggaaggggtgggtgcagtggctcacacctgtaatgccagcactttgggaggccgaggtaggcagatcacttgaggtcaggagtttgagaccagcctggctaacatgttgaaaccctgtctctactaaaaatacaaaaattagccaggcatggtggcacaggcctgtagtcccagctacttgggaggctgaggctggaggatcacttgaatccggcaggcagaggttgcagtaagcctcagtgccattgcactccagcctgggtgacagagcgagactctgtctcaacaacaacaacaaaagaacaaggaagaataaagactaggtctttgaggagggcattttcagtgatatggtgaaacaggtatcagaactgcaggggactgagaaataatgaaaggtgaaggtgaagcaatggagtgttcacatatagaccactttttccatgaggtttggttgtaaaggggagaggggaaagaaggtggtagctggaaggagaggagttgtctggagctaagggacatcactttgatggttgctctttcttcagtaacggaggttcctgggagagcaagcgggggagggggggttgaagagtgggagatctggggagcatgcaggatatttggaagttgattttgggggagagctggagagagagctgccttggcaaataggagcgctgaaaggtgttgaggacctagttgaagttgacaatgtatgtagcactgatctgtgtggttgtgagattttgtccagcagcacttagagccaagaagcagattcagagaagacagaaggttggattcttccaggattgtagtgctgccagatgggtgttactatccttctagttatgccagaaagataactgtgcaaggaatataagtatattgggaagaatgtgatggaggtgataaaccctgaactctcagctgatggggaaggaaatgaagactcgatggagcttataaataaaacaaagtagagggacaaatgaactggaagtttctgcaggctagagaaaccatgaaaggaattcagagaatagcagaaggacagatgaaagatcaggtgtctgcatttataacttcagaggtggagctcttctgtggtccagggtgttaccctaggagtggaggactgaagaggactggaagagaaagactctggagttgactgtgaacctggagccaaagtgaacaatgattggagatgagagctaggactttaggtactacatctcacccctgttgtccaatctaccatggtgcctgaaccacaccagttgcaccagtcagagagtgtaaggtcctgttctaaagcactcgcaccacaagttttgagagcccaattccccatatttgtttgtttgttttgttttgttttgtttgttttttgagatggagtttcgctcttgtaggtcaggctggagtgcaatggtgcgatctcggcttactgcagcctcctcctcccaggttcaagtgattctcctgcctcagcctcccaagtagctgggatcacagatgtccaccatcacgcccggctaatttttgtaatttttcaatagagacggggttttgccatgttggacaggctggtccctgacctcgtgatccacccaccttggcctcccaaagtgctgggattataggtgtgagccaccacacctggccccaattccccatatttgaagagcacttatgctacagggttttcaattgcctttaccaaccctgaatctcctggtttttctccttctttgtgcctgttatgacctaccctcattatcagagactcattgtgggaggggactacacaagggtataaatcccaggaggtggtgaaccctggaggctatcttagactgtatcacaattctcttcagttttcattttgtaatttttctctggctatgtaagccccacttcgatttccgcccatatgatgctgactttcaaaagtctatgtcccggctaggcgtggtggctcacgcctgtaatcccagcacttagggaggccaaggcgggcagatcacttgaggccaggatttcgagaccaaactggccaatatggtgaaacccccatctctactaaaaatacaaaaattagctgggcgtgttggcagatgcttgtaatcccagctacttgggaggctgaggcagaagaatcacttgagcctgggaggcgcaggttgcagtgggccgagattgtgccactaaactccaacctaggccacagagtgagactcagcctcaaaaaaagtctgtgttcagcccagacctctacattgacctgcaacctgtatatgcacctgctgtgttgacatctgtattagtcaaggttctccagagagagagaaccaatgtgatatctatatatctacaatatagatctatatctatagatatatgggaggggatttattaggggaactggctcacatagttatggaggctgagaagtcccacaatagaccatctacaagctggagaaccagggaggctggtagactgcttcagttcaagactaccctgtcttagacttggcctcagaaccagggaagctgaatggtgtatctcccagtccaaggcccaagccgggagaacctggggaaccactggtacaagtcttggagtccaaaggctcaatacttgctaaatgaataaatggacggactctactacctaatctcctagagttaggagattaggggaacggggaattctgatgccaagggcagaagaggggtgtcccaactccagagtagagaatttgcctttcctctgcctttttgttctattatgtggtgcctgcgcatattagatgaggacagatcttccttactcagtccattgacttaaatgccaatatcttctgggaacaccctcatagacatacccagaagtaatgttcccccagctacctgagtatcccttaacctagtcaggttgacatctaaaactaatcatcgcaaaatcctaaccaagtctcaaaggtgcctcaaattcaacttgtctaagatggagctcaagatcaatcttatctcctcttccagtgttctccatatctgtgaatccctgcaccatccatccatttatccaaggctgaacagtggcatcatccttgaagctgcttcatcgccccttcacatccaactcatcaccaagtcctattgattttgctcctacatttctctgcagccttcttagatctctttttcttcactctcaccctagtccacactccagctccattctctcttgcccagatgactgcactggctcccaggccagtcccaccatagctctgttgagacttctccattttgatctgcactttagcagccaaagtgagttttataaaatgcaattttgaccagtgttctatggtcctaaactttccactatggtccataaaatcctacatggtcctgccccttctattcgctctagtggatctcactccactcctttattctctaaactctgagtttcttttctttttgtggtaaaatgtacataaccatttttaagtgtgcagatctgtggcatttggtacattcacattgttgtgtgatcatcactactatccatttccagaactgtttcatcttctccagctgaaattctgtacctattaagcactaactttccatttccccctttctgggtttcttttcatccctcaaaggagctctgctgccttccacagagttcttatatacatgctaatctctccatctgaaacacacttcctctcccctttgcctagttagcctcctgtgattcccaacaccagcctagaagcttctgtaaattctcccaaaacccctgctcctccctgaagagcagtttgtatttatacaggtgtttgattgtttgaagggtgctctcaccctgcctcctctcttaacatagtttttcgtgtcaggaattcctcgctttgtccacaacccctggcacatagcaggtgctcaatacttgctaaatgaataaatggacggactctgctacctacctaatctccttccagccagtcatccatctgtgggtgcctcggtccccagcttggggtgtgtccccctgggtcggactttggcgccccatccaggctggcagtaggttgtgctctttggtttgcctatctcgggcctcccgcccagccgcgcggaccgcagaacatacgccccgggcgttatcactctgtcacgcggagcctccccgcctccagacgtcagtccggttgctaccccggcaggaatcgagcttagatcacgaaggctccttctcacctccggacgtgagaattacaggcttggatctcaaaccgccgcggtgagagccgggaggtgggaagaaagttgggaggcgcgcgcccccgtcacactccctctccgtttgggtcgcagccctttaagaaccactacgttcgcgccttcgccgggacgggggctgtggaggcgcgccgggattggtcggtttgggtgcgggtgtcgcttagcagcagcgaatgcggggtaggggggaggtggggtggctcaagactcgcgcacgcgcaccacggcctacctgcgcctgggctgccggtgacctgggccgagccctcccggtcggctaagattgctgaggaggcggcgggtagctggcaggcgccgacttccgaaggccgccgtccgggcgaggtgagggctggcgggcggaggcgggtgccgcggcccgttagccaagagcaggcgggttagggtgtggcgcagggcgggcccagaggtggaggcggcccagggcccacccggccctcagtcccggccttgaccatggggctccccacggggcttcactgggcttcttggagtcctctgtcccctttctcccgtcagcctgttcccggaccccggggccacccaaggcacgcgcctgcaggaaccctgggctgacagatgggcgccaagggcttctcccagttggaagagatggggagtgagaaaggggacgattgtttctttaaccattcacgaagctcacgtcagagcattgtttaatctgaatagcaaacttcccttagcatgcccgtgttattagactttaaatattggatacactgaaccaacttttcagagcactaggtgtaggacgttccattacaggttttgtgttcattacagatttacacatgtacctccagagccagaaggataaagcactcggggaaaaattaggtttgtagaaataaaagccacggaagactattgccagtgtgaaaagtaattggtgaaatttgtgacatggtcagaaaaaaatacagctcagaaccaacatatagggtaatatttaattacattttgcagagaagagttgatcccactaaagataattttagtaaaatgaaaaatggaagcaactggaaatggtttaacgttgccagatagaattaaataaacaaatagtgtttcctctggaaagtacattttggacaatgttaatagctctgatttaagtgtttgcatttgcaacagaagccatcttggagtcagtgttttttattcttagaataacttagaaatcaactaaattcaaaaagtaacatgatcatagagaggacaacctgacttcaaggtaatacagtggataaagagcagttgtaacaagtgtaatctcaggctccttcctctaccaacaggtctctgattagcttattagtgctctaaggagaagaaattattttagagaaagggagtagctgtaattcccaaagttggatttgtagaagaaggatgtggtggaaagatcctaggctttagaatatttgaagtaaggaagtctgggttgaatctagctttacctcttgagccttacagctgcagttttcccacctatccggtatagattatgtctaccttatagttacaagcatttaataacattatcagtgtaaaaggtcctatcaagtttagttccctacccctcttagttcctaacaaatgacgaaactgacctctaccctcctcttcactccatccccaagcaacttggagccttaatagaatctacagatttggtaaccagttctcaagtcctgtggctgaaggtgaattcagtaagggtggcacaactcagttttgtcttctgtattgtgtatttgagtcttctgtattctgtatatactttatggtgaacactttgtgtttgaatatttgtgtgccaaatgaagcctgttttgtctaaattcctattttgcaaggtgcagtcatctctctctttctctctgtttttctctttctttctgtctctctcagcctctctctctctcagtgcatgtggtaggggcttgaggaggggttaagggtaaaaggtggaagaaaaaacaggatcaagggtagcctgcagcataggcataaagtctttgttaatagaacagagataatctatgacatgagcagtttataaacagatgctgggaagaagatttaggaaataagggaggcaaattaaaatatgtttttataaaacctagtaacacggatgctgtgtatttgattactacttcactctacttttagacaaatttcatctgtataaacctttctctttttctctccaaatacagatttattgtggaaaagtgttcaaactgtagatcagaactatggcaagggatctgtaaacctgcatttcttgtttcagtgagcaaaaataaggcagcccttaggtcattcattcatttaacttagcagtgtttactgagtgcttcctaatatgtaccaggcaaggtggtaggttatgacatccactgccttgtggaaggatctggtaagatctggaagacattccagtgtctcttgtatgaacattctgaagctgcctttgtccttgtggaattgattttcttttcttttcttttttcttttcttttttttttttttgttttttgagacagggtctcactttgttgcccaggctggagtgcggtgatgcagtcgcagctcacgcagccttgacctcctgagctcaagtgatcctcccacttcagactcccaagtagctgggaccacaggtgtgtgccaccatgcctggctttttttttttttttttgtagagatggggtgtcattgtgttgcccaggctggtctcaaattcttggactcaagcagtcctcccgcctcagcctcccaaaatgctgggatgacaggtatgagccaccatgctcagcctgctttcctagttttttgttttgttttgttttgttttgttttgagatggagttttgctcttgttgcccaggctggagtgtgatggcacaatctcagctgactgcaacctctgcctcctgggttcaagtgactctcctgcctcagccttctgaatagctgggattacaggcatgtaccaccatacctagctaattttgtatttttagtagagacggggtttctccatgttggtcaggctgttctcgaactcccgacctcaggtgatccacctgcctctgcctcccaaagtgctgggattacaggcatgagccactgcacccagccgctttcctgttttaagttgaatactagttgtctttgagcagctttatttcaaagagtcctgagattatagtaccttccagtttagaaatgtgatgtagtaaaggagctattcactataaagtgtgcccttcagtgttcatgcataaaacatcaaaattacagttaattagcagataagatattggtggggatatttaaaaattatatttaaacaaaaaagtattagcataatttaagtaaccagtacatgaggatcttaagttaatacttttttccagcttttattttaagataattatagttgcaggaatttgcaaatatagtacagagaagtctcatgtacccttcacctagttttccccattgattacatattatataattctagtaaacagcaactccaggaaattgatgttggtataaagtgtgtgtgtgtgtgtgtgtgtgtgtgtgtgtagtactgtcactttatcgtgtgtagattcctgtaatcatcaccgcaatcaagatacagaattattccatcaccagatgcctttggctgttcattcatagtcacacccattcccttcctctctaccatccctaacctctgacaactgtttatcagccctccatttctataattttgtcatttcaagaatgttacgtaaaaggatgcatattgtatataaccttttgatacgggctttttataaccaagcataatgcacttgagatccattcaagttgttctgtgtaccaggaccatagtttattcttcttctttgctgagtagtattccatggaatgaatatactgcggtttgtttaaccattcactatttgtaggacattttggttgttttcaggtttggttgttataaataaagctgcaatgagcaattgtacagaggttttcgtgtagacacaaatttttatttctctgggataaatgtcaggagtgtgattggtagattgtacaataattgcatgtttagttttaaaagaaactgccaaactgtgttttgtttttgtttttttttttgagatgaaatttcattctgttgtccaggctggagtgcaatggtgcagtcttggcgcactgcaacctccgcctcccaggttcaagtgattctcctgcctcagcctcccaagtagctgggattataggtgcccaccaccatgcctagctaatttttgcatttttagtagagatggggtttcaccgtgttggccaggctggtctcgaacccttaacctcaggtgatccactcacctcagcctgccaaagtgctgggattacaggcatgagccactgcgcctggcccagacttttctagagtataccattttacagtccagtaatgcatgagagatccagtttgtctccatgcttgccagtgtttgatactgtcactatttatcattttagctgttctgatgggtaggtagtattatctcattggggtctcaagttgcattttcataatagctcaatatcttttcatgctctgatttgccatccatatatcctctttgtgaaatgtctgtatgtgtgtttttcccattttaaaattggattgtttgtgttttttcactgttgaatttcaagagttctttatacattctagatttgagttgcttatcagatatgtggtttacagatattttctcccaatttctagcttgtcttttcatcctcttcacatgggctttcctagagaagcaaaattgaaaagtgttcaattttgttgcagtccagttttccgaattatcttatggattatgcttttggtgtcatatctaagagctcctcaccaagtcataggtcctgaagatttcctcctatgttttcttccagttttatagttttatttttcatatttatatctatgataaatttttagttaatttttatgtaagatgtgaggtttaggtcaagattctttctttttactcccggcactatttatagaaaagactacccttcctcccttaaattacttttgcactttgtaaaaaatcagttagatatacttatgtaagtatatttttgggttctgtattctgtttcattgatctatgtctattcctccaacaataccacacaatcttgattactatagctatataataagtcttgaagtaggatagcatggtttttcctattttattcttttttcagaattgctttagctattttagtttctttgccttttcatacgcattttagaataatcttatctatagccacaaactcgcttgcttatttttttttttcagtagttgtattaaacctgtatatcagtttgggggagaattgacatctttgctttgttgactcttccaatccataaaacatgatatatctccccatttatttagcactttgatttcaggaatattttgtagttttcagcatacaagttctgtatatgttttgttagatttatatctaagtattttatttaaaaaattatagctttattgatattattttttagagtgattataaatggtatttaaattttggtttctatatgttcattgttcgtatatagaaatgtaattttttttagatgaagtatcactctgtccaaaggaccaactttttgtttcattgatttttctctgtttttaaaattttccatttcattgatttctatcctattatttccttccatgtttgtgatttaagtttattttgctcttcttctaatttcttgacttgtgagcttaaattactgttttgagacttttcttcttttggaatgtaagcatttagtgctatggatttccctctcggtactgttttagctgtgtgacacaaattttgatatattttcattttcatctagttcaatgtatttttttaatttcctttatatttcctttttaacttacggattgttttaaagtgtgtgtttaattttcaagtgtttggaggttttctttacctttctgttattaatttataatttgattacactgtggtcatataacacactttgtataaattattttaaatttattgagttttgtcttatagtccaggatatggtctatcttggtagacattctgtggtttcttgacttaaactcctgtcctcagcaatcctcccacctcggcctcccagagggctgagattacaggtatgagccattgtgtccagcctattctgtggggtcttcaaaggaattcttctgttgttggatgcaatattataaatcatgattatatcctttagttgatagtgttttctagttctttttgtaaatctttgctgatttctgtttacttgtcttatcaatttttgaggtgcagttgattgaagtctccagctataactatggatttgtctgttcctcctttcactttatgagtttttgcttcacttatttacatctttgaagtttggtgcaaacacattcaggattattatgccttcttagtggacttattcttttatcattatgtaatatccttctttgttcctggacattttcttcactctgaagtctatctgatgataatataactcttgcttcttttgattaatgtttgcatgctatattttttccatccatttactttcaacctacctatattgttatactggaagtgaatttcatgtagatagtatataattgggtcatgtcttttatctactgtcagtctctgttttggcaattgtcatatttagaccatttacatttaatgtaatcattgatatatattagggaataagtctgcccttttttgttttgtgtttgttctgtttgttgttgccattgttgttatttctctgttttcttttccttgacttcttgtgggtaatttgaacattttaaaataattacattttaggccaggcctagtggctcatgcctgtaatcccagtactttgggaagctgagatgggaggattgcttgagaccaggaattcaagaccagctgtggcaacatagcaagatcctgtctgtacaaaatatatcttttaaaaaattagctgggtataacggtacatgtctgtagtcccagctacttgggaggctgaggcagaaggatcacttgagtcttgaggctgaggcagaaggatgacttgaggttgaggcagcagtgagccatgattgtgtcactgcgttccagactgggtgacagagtgagaccctgtctcaaaaaataataatttcattttataatctatagtgttttttagtatatctctttgtatagtttttagtggggtgtatatgtgtttgtgtgtgagtatgtgtatgacttgttgtggtctcctgatgtgttttactatttcaaatgaaatgtagaaactttacctccttttatgtctttgaaccctcccatttataattgtcttaaatagttcctttacgtatgttgagaaccacatgagacataattattgcttcattcaccgaacataatttagaaaactcatgagagaataatctgtcatatttttaaaagtttttaccctttctgttgttctttctttcttcctgatattccaggatttcttcttttatcatttcctttctgtttagagaacttcttgacaaattcctttaatgttccttcatctaagtatgctttaatttttcttttattcctttttttttttttttttttgagacagggtcttgctatgttgcctaggctggacttgaactcctggggctcaagcagtatagctgggactacagacacatgccactgcacctggctgcttgaaggatatttttgctgaatacaggattctgggttggcagttcttttcttttagtatttgaaaaatgtgctacttccttttggcctccatgttttctatgagaaatttgctgtcatttgaattgttttccccttataggtaaggttattatttttctcttgctgctttcaagattttttctttgtctttagttttcataagttgggcttctgtctgtgtgctggcatgggtttctgggtttatcctttctgggatttgttcagtttctttgaatctctgggcttatgtcttttgcacagtttgggaaatattcagaaattatttctttgaatactttttcagccctgtcttctttcttttgtcctccaggactcaagtaacatgaatagttggtcattttttagagtctcacaggtctccaagtctctgtgaaatatttttcaatctagttcctctcatattgttcagattgagtaatttctatgttctgtcttaatgtttactcattcattcttctcctcccccccatatttctattgagtccatccattgcattttttactttagttaattaattactttatttattttcatacagatgggggtctcattatgttgcccaggctggtctcaaactcctggtctcaggtgatcctcttgccttggcctcccaaagcattaggattatagatgtaagccactgcacctggcctcagttttgttttttgtttttttgtttttgacggagtctcgctctgtagcccaggatggagtgcagtggtgtgatcttggctcactgccatctcagcctcccggattcaagcgattctcctgcctcagcctcccaagtatctgagactacaggtgtgtgccaccatgcccggctaatttttgtatttttaatagagacgaggttttactgtgttggccaggctgtctcgaactcctgacctcaagtgacccacctgccttggcctaccaaagtgccaggattacaggcatgagccatcgtgcctggcctcctcggtttatttttaattctagaatctccatttagtttttatatcttctgtttctttactgagagtttttatttttcattttttaaaagtggctgggtgtggtggctcacccctataatcccgccactttgagaggccgaggtgggaggatcacatgagcctgagagttcaagatgagcctgagcaacatagcgagaccctgtgtctacagaaaaaaaaagtagtggtgtgtgcctgtattcccagctattcagaatgctaaggtggaaggattgcttgagccctggagatcgaggctgcagtgagccatgattgcactgctgtattctagcctgggaaacagtttataattgaccattgaagcatttttatggtggctgttttaaactctttgttagataattctaatatctctgtcatcttgatgttgccatcaattaatgtctcttctcattgaagctgaggtttttctggttcttagtatagccagtgattttctattgaaacttacattttggatgttttgagatctgaatcttactaaaatcttctgttttagctggcccttctgaacaccactccagcaggggaagcaagggactgtcttattactgcccaatggaagtagaagtccaggttccctacgtggcctctgttaacaccctgggggaaaggggctgctcatcattgcctgggagagataggaattctgtctacccagtgacacagtgggagagaatggctcattactgccctctagccccctacttggccttctctgatgctaccccggcaggatgggaggtggagaatggggcacttcattactgtagggcagtggtggaagtctaggctcttcacttggccttcgttggcaggtgtgtggtagctacagtttttttgtgatgtttggctggagtagagcagttttttacctgcaagttttttgttttgctatgcattaccttttctagtttttttgactggagagaacaaagtttttttggctttttttttttttttggtctgtacccattggcatttcttgctagcttctccaccactcagtctgtgatatgtgagacaaacaaacaaacaaataagaaaaaacaaactcagcagactcacagctgtgtcattcctcagaccccaaggtccctagccagtcttcttccttctccacctttcagaatttttatttttatttttgagacagggtctcactctgtcacctaggttggagtgcagtgacacaatctcagctcactgtaacctctccctcccggattcaagcgattctcgtgcctcagcctcctgagtagctgggattacaggtgtgtgccaccacgcccggctaatttttgtatttttagtagagacggggtttcgccatgttggccaggctggtcagaatttttaaatgtttattttatatataatgtccagggtatttcaagggagaagtagggaaaagtacttctacttcatctttccagaagcagaagttcattctgttttgagcagtggtcagatctcttatttgagtacaggctgtctcataatagctcataacctgaattcacaaatatcaaatccctgtaaagataagccccttcctttttgtattattatttttccatcttttagaatacaaagtatatttttacaaaggaaaataatgtcaaggatgttgtcttcattcttatactcttccgtggcagcctataaaatcttttaacccttcaggcagctgccatcctgtacattcacatacactcacaaatacacacaaacaagttagtatcacagtgtcatcttcattaaaccatcacaaatatttaaaaaagacttttaaaaaatagatgtgagtttcactagtttgcagtactagtaacttgatagaactgaaaaacaagaggggtatttatttatcttgaatactaatatttgaggaaaagcaagtttgatcaccaaaggataggatggagaagtagagaacctggaggggtcatttgggtcctttagagagtggtaaaactagttcttctgattaccatcgcttggaaatgtcacccttttcttttttattggcttaagataatacctggcataaggtagatgctccataaagacagaactacagaggatgtttggaattgacagttggagtcagtgcacactgctttcctttagaggggcatacaatttactcagctcccaaaaaagtacctttcttattttgctttggggtgtttctgtcctgtctctaactgttttggtatctcattgactgtctctttttggcctcaatgtcttcatatcttggcttatggttctttttggagttattgttgagagcctaagccctggtctcaaattgatcttgtagcctttccctatgtctgtcagggctttgtgccctataactctttttaaaaaatgttttaaaattaaatatttcaaatacttacgaaagtatagaagatagaacaaaaggaatcccctgattccttttgtggtgccttgaggtctcatcattggctaggcgtctgctgtaaaacccacagtgtcttctggcagttgacctggtcctgccgttggtgctgcaaacttagtagcttttatgtgtgggtcctggggcttttcacatttttactccccaatggaaggtgtggagaaatgggtcaaatggactgtgtaggatctgttggctggtagcctaatttttctttttgcctcctttgtgtttttatatcactgcagtttctacatgtatattgtggtaataattattcattcattcatccattccagacatggtctttattcttagaacttatattttggtagtggaaatgcaaaatcagtaaaatagagaacaaagaggtaggtttcctaagaatttaaaagagggagaaagtacttctagctggacaagtctgagaaggtggatttgagacagtctttgatttgcatttggatatggagagatgaaaggagtggcattgcagacacaagtgaagaatgcatagaggtacagagatgaagagtagtgtgcatcttggggttctgagatgaagaactgagatgccaaataaggttgcatccctagagttctttggaagagaggtccactggtatcctgttatcatcctatcaagtaaagggcctgatagtagaggatcctgtcaagtagaggatttgtgaaatacgatgtgtggacacatcctattggaaagacttatctgagctgtaatagccacctcactaatccctaattgcagggctgccactcacagatgtacaggttatgccctgaacaagcaccctgcagtgttaacagatagggctaaaacacagccaggctctgctagcagaaatggtgcaggcctgtttccaccaagagaggcatcctttcctaatctgcccaaggcaccacgagggttcagatctgtttctttctgtttcttaatggtattcacatatcactgtaatatgatttgctaaatgattgcctttagccatatgtagggattcagtcatcactttgaagactgactctgtatcaaacatttgcagaaattcagaaggacatgatctagaggtttcatttttgccttctgctttccttgtcaccagcattaggttagatgctcagaatctctccaccttcttctatctccttgcaagtgaggatatggcagctaaactgcttagtgcctatctccatgggtgacctgaagttcacaggtcactgacatcaatcctcgctgcttcagtgtctggtgcttcctgtctctttagggctgtcttgctctgtgtcctgctacctgccattactactgttggtcctgagccctctggtcctgcgtccgttcttctctattcctttccccatcatcccagttggcttaattctggaaagggagagactcattagagaaaaagaaaaagagaattacaactgcagaaaaggcagggaggataatgaagggaggaaagttgggagtgatatagcagtagaggccagggaaataacaataaaagcaacatttgcaattatagtaagaatgagggtgaaaaaccctagagtgggcatttcacaggtgggggtatttctggcactgtcatttgagcctcagtaacaaggtgaccttgctttcctcaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacagtaagtgatcatattcactttttcagaatattagcaaaatttggattacttttaactacatgtagtgataatcttatgctgatcacattgtgtattaaaagtagatctagcatcagtggtctgagatcatgtgtgtctacaacagaatcataaaagaaatgggttttcttagagcctcaggaatggctgctccaacttttttttttttttttttcttttgaggcagagttttgctctgtcacccaggctggagtgcagtggcaccatcttggctcactgcaacctccgcctcctgggttcaagcagttctcgtgcctcagcctcctgagtagctgggatcataggcacatgccacgatgcccagctaatttttatatttttagtagagatggggtttcaccatgttgcccaggctggtctcgaattccagatctcaggtgatccacctgcctcgacctgtcagagtactgggattacaagtgtgagccactgcacccagccgtggctgctccacctcttaacttctgttagtggagtgcccatgagcattgggagacctgggttcatgtctttagttttgtagttttttcttcactcagatgcaggggaagagaaaaggtaaggagggaggagatactagattataatgtggggagggaaaataatgagagttagaaagccaagaaataagaaaaaaatttcatttttactttatttatacctttgctttttaattttttcacttttttatgttttaatttttcactttttaatttttatttatttatttttttgacacagttttgcccttgtggcccaggctggagtgcagtggcaaactctctgcacactgcaacctctgcctcctgggttcaagtgattcttctgcttcagcctcctgagcagctgggattataggcacctaccaccacgcccggctaatttttgaattttttagtagagacggggtttcaccatgttggccaggctgctcttgagctcctgacctcaggtgatctgcccaccttggcctcccaaagtgctgggattacaggcgtgagccactgcgcctggtcatttttaaatttttattatgtgacaggagcaggggagtgaaaaataagtgagagtaggtctcttttctcaaggaacttaaagtctaacaaggtaacaagagaaatatataactaactataatacagtggggaaaatgttccattggaagtaggaatcaagtgattacaataatcctggttacaataactgatattattgagtgttttctatatgccaggcactattctgtgttttatgtggctaatgatgtaggtaatagtgttacacctgttttgcagaggaggaaactgaggtaaaaaaaacttaactaagtttacactgttagtaatgggtcagcccaggatttgaatgcaggcagttaggcaccaaagtctgcttcttatgggttatacaatttcctgttctaggactcagagcaagaagccagtcattctatggaggcatcaggggcaaggcagattttagaatatcaaaatgacttgttagattttacgtctattttctcgttttagacctttacttagcaagtctcttttgctctccttatatttttattttttattttattttttagagacagggtcttagctgggtgcagtggctcacgcctgtaatcccagcactttgggaggctgaggcgggaagatcgcgaagttcaagaccagcctgggcaatatgataagaccccatctctacaaaaaaattaaaaattacccaagtgtggtagggtgcacctgtaccagctacttgggaggctgaggtgggaggattgctcaagcccaggaggtcgaggccacagtgagccatgttcacacctcagcctccaaagtagctggaactctgtctccagatagataggtagattggatagattgattgattgatagatagcctcccaagtagctgagtctacacaccactatacccagctaatttatttttattttttagagacaaggtcttgccatgttgcccaggctggtcttaaactcctaggctcaagtgatcctcccgccttggccttccaaagccctgggattataggtatgagccaccttgccttgcacccttttgttctccttgaatagtaaatttttttttttttttttgagacggagtctcgctctgtcgcccaggctggagtgcagtggcacgatctcggctcactgcaagctctgcctcttgggttcacaccattcttctgcctcagcctcccgagtagctgggactacaggtgcccaccaccacgcctggctaatttttttttgtatttttagtagagacggcgtttcaccgtgttagccaggatggtctcgagctcctaacctcgtgattctcctgcctcggcctcccaaagtgctgggattacaggcgtgagccaccgcacccggccttgaatagtaaatttttagttgacctgctaagctgaggtccttttaggggaattcagtctcagaattataaaaacaaaaggaaaagtccaggcctgaccccaggctaggtggtaatgtcaggctagaagggccatgtcctgaagggggtgacaaataataggcacatgcagctgtcacctggtgatgtgggctctggatgtttaggagcaaacactgagttgcacctgcccacatgtgcagcccctttctctggacatgctgaacatgctgtccttgatggtctctcctttactatgctgtgattaactgatttgtacttcaaataggaaagcttttctctgttaaaggctatttttcacagaaaaaagaagtctaagacttcagatttaaatcctggatacttcagtagtattttggaaaaaggaataaaaaatgttctactcatttgtaattttgaattaaatatttaccattattttcgcagaggaaatagactttcttttcttacaggtgagcagtaccatagcttttaatagtaaggagtgtgttagttccctaaggctgccataacaaatgaccacaaactggcttcaaacaacagaattcgttctctcacaggtatcgcagggccatgttccctctacaaactttaaggaagaatccttcctaaacctctgctactttctggcagtcattggcaatccttggttttccttggcttgtagatgcgttactgcaggctctgtctccatggttgcatggtcttcttccttctgtctctgtgtccaaatttcctttcatataaggatactgatcattagatgagggcccaccctaatccagtatgacttcattttatcttggttacatcttcaaagactctgtttctttgagttaggacatcagtaaatctttttggggggacaaactcaacccacaccaggggtcctctttcaaatagaaacacctccatcctagagtggcctagacccttctgaaggatttcttccataaggaggagagttgtccttttttttagattggaaaagtttttatatagggagttacagtttcaaaaagttggtagaacaacataacctaaaaaccgtcctgctgaaaacatccagaaatgagggtaaatatatatcgacaattactttaaatgtgtagttaatcttgaaagaaagaaatcctaagatgctagaaatgaaaggggggcagaatattaaggtagtaagtgtgtgagcggacagtgaggctcctggcattcagtcaccataaaattggagcttggtttgggcttacataggatggagtgtcagaacaagacccttgtggctgggtgcagtggttcacgcctgtaatcccagcactttgggaggttgaggcaggcagattgcttgagcccagtggttcgagaccagcctgggcaacatagagagacccccatctctacaaaaacacgaaaattagccaggtgtggtggcacacgcctgtagtcccagctactcgggaggctgaggtgggaggatggcttgagcctgggaggttgaggctgcagtgagctgagattgtgccattgcactctagcatggatgacagagtgagaccctgtgtcaaaacaaaacaaaacaaaacactcttgcataaaggaaagttcttgtcaggccacaacctaatggaatggtgataggtgagggaaataattttcccattgatacagggtaactcacctctacttggctttgtgtgggaaggaaaaataaatttcacctaagaaattgaaatgttgttcttgcgcctcgtaaaaggttgaagttggagtgtatactccccaaagtctaggaattcctaagccaaggttgaaacatcagtattggtcccagagtgatgacactgctatggtagccagccagagcaaatgcagaaccacactggaagaagtgtgccacaacttgggcttcaggggattcttacaaaaaaaagtcccatagggatgagttctcagcaaaaaggacaaaacacaagaggagacattccacagtgagtgggagtcagtagacacacagataggtgacctagaacccctgtaccctgaacttgaaatgattgcatgacagcccaaaagggagtagaaaaagaagaaaagccctgtatttattttatgagaccaaaataacctaaataccacaatcagatgaagacagtataagaaaggaaaattataggccagtcttatttgcatagacacaaaagtcccaattaaaatgttagcaaactaaatccagcagttgtatgtttatgaatatgtaggaacttagatccaacaagggcttattttaggatgccaggatcatttaacattaggaaatctgttgatgtagattaaagaagaaaaacgttttctcaatagatgtggagaagtctgaggctaattcccccaatagaatatgcatccctcatgcatgaataaataagagtgatcacaggctgtcattgattaagactactagacattttaaaggaagcggaagaaagacagtctcaggaataggtcgaactgaagagacaatatacctgcagcaaacagctacaggactgtttaaagccaagcaagtgcagaattcaggtaaggttgtgtctgggtgtgggatgggaatacatggggctgtttcctggtaatacagatattgcccttttgtttcagtttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttggtttgtaaccctctttcatatttatttttctcttccatggtgttatatgtgtagaatttacagtttaggtttggctttgaccatcaaggaaaaccactggagatgcaaaaacatgtcattgaagaacagacttgtaccatgagatttcatatcaattgaagtgtcccggaaagcgtcaaggtttaacactctggcttttcatctccacagagcctgggggcagggtggaggaagggtgaaacgtgtaggttataacccacagctctctgaagctggggtcagcaaatgatggcccataggccagccgcctgttttataaataaagcagaacgtggctatgcttattcttttacatgttgtctgtggctgcttttgccccacgacagcagagttgagttgtgacagagaccatgtagccaccaacctaaaatatttactaactggcattgtaagaaacttttgttgacccctgccccagagcattactgctcaaagggtgtttaccatcaggaggtaagcacagaaagtgagaactggtgtttagaaattcttacagtaatttgacattcctgtgattattttttattgctttttttaaagcaaaatatcagtctgcggtggtttggaagtaagaaaaaaacagttccttgacccagaagtttgctctggaaaaatgatacttcttttctaggctctgccagaaaggccttgttgaggcttagagactttggaacacagcataataatcagtgtgtgccctattttggtcaggtgtgggtcattttgagctcttgggagaagaggaatggagatggcagttgggggacagtctgtgctctccgtgtaaacagctgctgactctgtgatgttcttaaacaaaggtttggcagcatttgttataaatggtcagggggcagaaccagcacctggaagtgttgccacttaggctttctggctactcctgccatagccctcacattccttcatgtgttctactggctagcccatcaggaatggggctagcaccctcttttggtgtcaccctggtaggcaggctccagcctggtaaagttctgcccctgagtctccctgtgaggtcttagtcaagcttgtgctctgggccacacttctttctctgaagagggctgctagtctaaaacagaccacagctgcagcatccctgggctgtgagttgatttggagctcggtagacctgtgttcttctctccccttatctctgcatgtgccttccttctaaagccatgtgcttgatctgatgggagccccttttccagcatcatgtttgctcattgttgagtgggagtagaatgagtcaaagtacactgagagtagaattatacagattttgctttgccagtttgtatgaaacttcaagaactgttcagatgtgataatggatttatactaacataaatttaagaattaaaatgaatacttttcaaatatataatcctagtttccacaacgtattcatttgtatttttttttcaaacaagccctttttttttgagttaatcaggtcaggaataactgtctccatttttcaagcttagaaatattctgtaaattgcctagggttgtaccgtactatcagaagtggtaaggggctaagacgcatgcccctttcccccgactctctcatcactgaggttctgtgatgcattattgcctttttagtcaatcacattttaattatcctgctctgaagtgattgatcagacagtgttcatattagcaatcatttggcctttgtgtttaacttgacgcttttcagaatctggctgatttattagctcttagaaatgtgaacttcagctgggtgcaatggttcacgcctattatcccagcactctgggaggctgaggcaggagaatcccttgagctcaggagtttgagaccagcctgggcaatacagtgagaccttgtctctacagaaaaacaatttaaaaatgaaaaaaattagccaggtgtggtggcacacatctgtggtctcagctacttgggaggcttaggtgggagaatcacttgagcctgggaggtcaaggctgcagtgagttgtgatcgcaccactgcactgcactccagagtgggcgacagtgagaccctatcttcaaaaaaaagaaatgtgaacttcattttgtacgtattgtcttataatatccattctgatgaaaatgcttaacttgtgttgctctctttttgcagacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctggtaagtggcttgttgttccctgatgttgatgaagtgatattgtgtatttcaaatggacgttgattttttttttcactagaaagctattttttggggagagggagtagtataaaatatgctgagaaaaatatgggcccatcctgtttcttggtggctgttataaaaactttgactacaggccaggcgtggaggctcatgcctgtaatctcagcactttgggaggccaagtcaggcggatcacttgagtccaggagtttgaaaccagcctgggcaacatggcaaaaccccatctctatcaaaaatacaaaaaattagccagaggtggtggctcgtgcctgtagtctcagctactgcagagactgaagtaggggaatcacctgagcccgggaagtcgaggctgcagcgagccatgattgtgagccactgcactctagcctgggtgacagaatgagaccctgtctcaaaaaagaaaaaaattgactattatgacagtggattggtttgaggggaaactattgtgatgaaattcaggagccgaagagtgacttggcaggttacttttgtttttcttttccttcttcttcttctttttttttttttcaaatagagacaaggtttcaccatgttacagcccaggctggtctcgaactcctgggctcaagccatcatcctcctgcctcggcctttcagagtgctgggattacaggtgtgagctaccacgcttagctggcaggttattttcttaattagggtgaagtctacaagtttattatttttaaattttatgtttttatttatttatttatttaagtccaagttgttctgacagaactacaagtttaaatgttataaagaagattcattctctttttctataagttacttattgaactgtatagattggtattatatatattatatatataatatatatattatatataaaatatatataatatatataaaacaattattatttatatatatatatatatagagagagagagagagagagagagaatccttatcatcttatttactgaaatgttgtagatctgaaacccccactcttcttgttggagggaggacagtggggatgagagcgttggacagggggctggagccagggcttctaacgttctcactgtctggctgtctctgagacctgggatctccctctatccctgtggatttcagagacctcatgtgaaggaagaggtcttaatgaacgtgatcacagtgtgctgatattccatgcctttgtcattaatgttattagccactcaatgcttatcacataacaaagtatgattttttgcattcctgtttatagttacatacaattaaactaatatttaattcaattggatatttatattcgaagaattctataatggcataagagctgaatcctttgctaaaagaagtgtctacactataatagtcttaattactttgtttttaactgttttatgctaaactcatttcttgaattttaaaagtgatgtattatattcatggttttgacttaactttgtgttttagtttaatgtgtttcaaccaatacttggattggctctcattccagtcaataagtgtttctagtttatgttgagaataaacttaatttttgtaaaaggaagactgggtaattgagctccaagattttcccttaccatatatgaatgcaggcatatctttgtaatgtatgttttgttttttaaacacttagacaagaggagcaaatccagaaagtgtcaccttgcccgtctttctaggacattttactgtgatttgatttaccctattgtcctgaggctagaatctttacaggtagcatattctgttctaacagtaacttttaattgctcagtggaaactctaacacactaacaataggcataagttggattgtggcgaggtatttgtgtgtgtgtgaaatataagtgtaagaaaggagtatagcgagagaatgggagggacaccatttaattgtgtgaaccaaaatcaatttcagtggttatctttacagagaaaatgagcatttgttctaattatagttctagaaacagcttgtaacctgaataatcaatgtttccctctttccaattattttagaattttaaaaattgcatttgctgtgaattgctctagaagtgcacgtgacatcgcatattgttattgtcagagaaagaggacaagttgaatgttgaggcatataatagaaatgctttaaacatttgacaaccaattacaaataaagccttggtcctctctggtagtataagaaactgttttatttacttacttatttaatttttttttgagacaggttcttgctctgtcgcccaggctgaagtaccatggtgcaatcttggcttactgcaacctccacctccagggctcaagctatcctcccaccttagcttcctgagtagcggggactacaggcacataccaccacacctggctaatttttgtattttttttttaatagagatggggtttcaccatgttgcccaggctggtcttgaactcctgagttcaagtgatcctctcaccttagcctcccaaagtgctgggattacaggcatgagctactgtgcctgaactttttttttttttttttttgagacaaggtcgctatgttgcctaggcttgagtgcaggggcgcaatcatggctcactgcagcctcaacctcccaggctcaggtgatcctcccacctcagcctcccaggtagctgggactacaggtatgcgtcaccatgcctggataagtttttgtattttttttttttgtagagacagggtctcactatgttgcccaggctggttttgaactcctgggctgacgtgatctgctgcctgcctcagcctcccagagtgctggcattacaggtgtgtgccaaaaattgttttaggatttttcagcctgatccctattgacatttttgcatcagataattctttattttggaggctgtcctgtgcattcattgtaggatgtttagaagcattcctggcctctatccactagatgccagtagcagcctgtctctagttgtgacaaccagaaatgactccagacatggccaaatatccactggggggcagattgcccctggttgagaaccactgctttagatagaaaggaaattaagcacttgaaaaacctgtgcttgcctggaaaagagcctttttctggaagaaactttactcaaatacccacatccattctgtccatcatttcttggcttttttccctctaacttctgctgcttttacaattaatatgtttgtaattctatgtttaacatagtgaacctatcattagtgtaggtctagttaatgtcttcgtttatttttctttcatgtagaaattacttacactagacacttgttttttttccattgtgaagctcctaatttccgaatggaaccagtgacagccctgggtatcctctccctcattctcaacatcatgtgtgctgccctgaatctcattcgaggagttcaccttgcagaacattctttacaggtaaccttttttttttttttaaaacagtttaaattgaaggacatatgatagaagaaagtgatagggatacattttatctataaaactgaggttttataatttttcaaaactaatatgaattttattataaattttattctttgtagtaagtgaatgaatatgaaggttgctcttttatgtctattgtcctaagaagcaggaggggcctgccaagatattggtaagaaatggagaatttgctacaaggacattagaccaccctgtggctcttgggaccccaggagtcactccagggactggattatttacccaggacaaaaggttcattctctgattttaaggttcaggttctttttctcctgagaaaaggttgtcccataatctgatttgtataatgcagatgccaccttccttgtgtctttgtcgaagaattatatgtcactaggaagttccttcactggtctgctcatttcaaaggaacttactatttcagtgctttttaaaaacagttttaaaattttgaagtattttgagaagtatttcaagaaggtatcggccgggtgtggtgactcactcctgtaattccagcacttctgggaggttgaggtgggtggatcacatgaggtcaggagtttgagaccagcctgatcaacatggtgaaaacccatctctactaaaaatacaaaattagctgggcgtggtggcgcatgcctgtaatcccagctactcaggaggctgaggtgggagagtcgcttgaaactgggaggcaggggttgcagtgagccaaaattgcgccactgcactctagcctgggcgacaaaagcaaaactccgtctcaaaaaaagaaaacaaaaacaaaaaagaggaggtataaaaccattattagcatcaacaaatagatattacttttaaagatagtgccaccatactcacacccatgcatatagtgggtaaagtctgaagcatgactgttgttgaacctcaggagactgatgtagactgacctgtttggagaatggcagcaggcctgtgttatgagtggtaactgcctgttaccacatcctgtctttgatcaatgtgtgttgtggtttctactcttattgtttatgattgctcttagccagatacttaccaactgtctgtttgtttgtatacattagaattagtacctggccagcaagatggttaagacatagtccctgccttgggggctctcatggcccaaaacagtgtatggtggcaatcctaaagaggcggcagtgcctggagatgggaggaattagagaaagctaggtcttaacagatgcttaggtttctgagaggtggagggattggcggcccattccaggttgcagacttagcacagtcacatggggacaggaggcacatgctgtgaccaagctgttgaaaacgattgtatgctaaccctgatctggtgcataaacaggaacttgtgtctcacccagccagggattttgtactgtcaaccataccagacagaaggcagagtaaagtgctttatgtcacagtgtttcctttcatctaaatatccctttccttgtgttccttgtatttgttttaggttgcccatgaggaaattggaaacattctggcttttcttgttcctttcgtagcctgcattttccaggtgggtgaaacgatattttggtcagtggattaaatccatgaccttactttgttcttctgttcatctatcagcaagtttctagatgtgatttttgttccaccaaggtcatggttcacatcatggacaataccaagcccttagtggaggaccttaggcccatcctggccagtcctctcattttacagaggaagaactttgtgctcataaagggaaagccccttgttcaaggccaaggggctattgacagcagcagaacagaaaccagcagtttggatttgacttcccagaagggagggatgagattacatagggattggattaggcctgactagtgagtggcaagatattgccttgtgcttattattaggacagtccaagcacagaaatgtccttctataaaagtagcatctgtgtacatgtagtttttaaaatataggtctaggcaggcattgtggctcacacctgtaatcccagtacttttcaaggccaaggtgggaggatcactttaggcctggagtttgagaccaaccagggcaacatagcaagaccccatctctgaactttttttttcttttttttttttgagacggagtcttgcactgttgcccaggctggagtgcagtggcacaatcttggctcactgcaagctctgcctcccgggttcacgccattctcctgcctcagcctcctaagtagctgggactgtaggtgcccaccaccacacctggctaattttttttgtacttttagtagagacggggtttcaccatgttagccaggatggtctcgatctcctgaccttgtgatccacccgcctcggccgcccaaagtgctgggattacaggcatgagccaccacgcccgacctctgcaaaaaattttttaaaaaatatatacatatataagactaggtcaaagaactgctgatttttttgttgttgttgttgttgttgttttaaatagtaataccttctgactcagacctgttctttaggaactgaagcaaacattagaacattaactagagggttttgattagttattttcatataagctgtgtactaaggggtggcataaagaggcgattttgagtccctcataggcagagttaattctagtgaaagcgtggctctaattctccttccttgtcctccgtatggactaggattttagcactgtctctgaatacatattttttctccctttttttaaaattaaaatttctgttcttaggacgctttccttctcttccacatacatcctagaatggtttattcttaagaattacccaggccaggtgtggtgactcatgcctgtaatcctagcactttgggaggccaagatgtgtggatcacttgaggccaggagttcaagaccagcctagggaaccccatctctattataataaaaatacaaaaatcagctgattatggtggtgcatacctgtagtcccagctacttgggaggcttaggcatgagaattgcttgaaccctggaggtggaggttgcggtgagctgagatcacgccactgtgttccagcctgggcaacagagaaagacattgcctaaaaaaaatgaaaaagcattacctgattatgcaaaaagaaattttcaacccatgaaaatgcattcattttttagaaaacaagtctccaagaccttggacatagccagtggcagtttcctagagctatgttttaggactgcagggattgtacagttccacctcattccttcaactgtgttcctggttggatagctcactccctccctctgtagattgaacctttgtcagattgatccatgttcagtgatgtcctttttttaaaaaaaaaaaacaaagcattgaaccaaaatgccgtttccaccttttgcagaacaagaatggccccttttatgtgtgatagtcatacacaaaataccagtcactctccctgctgtgagacctttccctgactcagagatgctttggaagacatgataaggagggtgcccaagggaagagtggtgctcaatgtagtcgtggctcaggagaaaccaaaatagtaaaagcatggctttctctcaccagcttgcttgcctgtcctggctccctgaagaaaaacttcactggggggccagtcagtcacgttagggtcccctgtctgcagcctggctgtctgcagcttatgtgcagctcttctttctctactgccaacagcctggtcatttctgtctatttctttaacttctttcagatgtgccatgcactgattcttcctgtgacatctatttcactttcctttaatcttccaaatcctcactttcgtccaataattagcagcctaaccagtgggtccacgctttactgtaatgaattcagtttaatcagctaatgtgagagaaatgacactcttcatggaagctgtgggaggtgaattttgcatatgatctagtggccattttatctctgattggaattcctcttctggtctcatttcagtgttatttgtacctgttctacagtccagccaggactatgaaggtggtgcttatgctgctctttatttgcctgggcaacatgtacctgcacgggctgaggaacctctggcaaatccttttccacataggagtggcttttctgtcttcatatcagatactaacaaggcagcttcaggagaagcagtctgactgtggagtatgaggatgacactgtgatgaatggattctttgattttcttttgaggatcaatctatgtttctctttctgcttctctactttacactccagtttccatccttttcagccaactggactgaaaaaccaggaattggggatgttaaacagttgcagtggaagtcatgaggttgcttgatacccagccttggttctgtgccaagcattactgcaggatctccagccagttcagcacgtttacctaggacagctggatctgggggctcatccagaaagagctttattggaagagagaaaggaaatattttggtcttttaagttgaatgatacagtaaaccacttgattcaataacactggttttagtcattgagagttgtctccaaggaaccactttaaaatccaaatcagctttcagtctaaacataacttgattagttttttttttcagagggtcagtacaggatgaattaaaaacctaaaaatatggttcataaatgtaagctagataaattttgtttacattttttcaatatcttaggttcgatatacctttggaatatttaattatattttggatataaattggacttcatttagggtgagggcaaacttaagctgagaaaatggttaagaaatctgagtttatttaatttatatgtaaccttttatagtggtgggactgtttgggtacagagatgttttatatttatttgcagggtatatccgaatattttaaaaattaattgaataaccagtacttctagatgataagtttgtcagcatgagcagaaatgagaatttcaggattacttacaattgaccacaacctggagtaggtgaatgaacatggattcagtggcactttacagatccgcttgggaggggctgctgtcatcagccttttcagtagagctgagtgcctgttgttttaatgatgatgactactgtaccctgtgtacctgttcccagagcgcctccaaaattaattactcctctgcacctttcccagtcatcttaattagcttgagggcctcattttttatgaacaagagttaagtatctgttaactttttaaagcttgatagagatataattaacacatactctggaaagttactctctttcactgtcaaaaaattgattgatcacagttttccaaaatatggttctggataagatcccttaggtttcccgaaatttcagcctggcttgttttgtaccacgcaggaggtcattttgggagtttgctctttggattgttcttggtagaagtctggaatctgaatagttcaaccacagttgcatggaacactttgagtgttcaactgcattatgtggtcttgataaatttttaaaaatcctattttgatagtttttaaaagtggaaaaccattacaagagttgagtggatagggaatgtaagaatgtagttttagaaaaattcaattatatttggttatcactggtattgtattgttattgagctaccttgttatcattttaagaaaaataagtttatatactgggaactatgttgggaaaatgttgccatagtaactttattttttataatagaattttctatttttgaccaaacataaaatatttggatatgggccaggcatgatggctcatgcctgtattcccagcactttggaaggccaaagcaggagactcggttgaggccagtagtttgagaccagcctggacaacatagtaagattcatctctacaaaaaaaaaaattagccggatgtgatggcacatgcctgtaatcccagcactttgggagtctgaggcaggaggatcccttgagtccaggagtttgaggcttccatgagctataatcacaccactgcaccccagcctgcatgacagagtgaaaccctgtctctaaaaagtctgaatatgaaaattatattggcagcatactcagacataaactccaaagttgtctctacactgatttcacatctgcataattttctgcatacccagcaggtgaattttcagtttttctgggagacaattttgaagagatggtgaaatagaatgggaagttaaggaggggaggtaaaatgttttaaatgagaagaacaaaaaagctttaaaagtcaataacactttgggaagctgaggtgggcagatcacgaggtcaagagatcgagaccatcctggctaacatggtgaaaccccatctctactaaaaatacaaaaattagctgggcacggtggcttgtgcctgtagccccagctactcaggaggctgaggcaggagaatctcttgaacccgggaggtggaggttgcagtgagccgagatcgagccactgcactccagcctggtgacaaagcaagactccgtctcaaaaaaaaaaaaaaaaaaagtcggtaagaacggcttaaaaatggactgttttcttttcctatgtggcattgggttgccatgtagacctgtaccccaggtgctttgggcatctgagcctatgatccatattcagcaggcagtaaagaaacggtccttgaagatgagtccttcctggtaatgcttcctgaccaccgaggcactaccagagatgttatccacaccaggtcgaatgtgtggatatcagttaacatctacatggggtgagattgacttttgcaaacaaaagggaaaagatgcactagaaaaacagtacaagtaatgaccacaaaaacattgtttgactgaaatccagctagctaaaagaatcctcagctcactgaaggaagagactgaaaataggaaagaagttctggtgatttcatccgagggaaatccccaggcttaggtttgacttggttcagggttggaggtttatagcctcttgtgtgatccttgataccagcaaactggttccaaatcccaggagttatcctcactccaccatggactcactgttgttgtagcacttttgttttcccagtagttaaatgctacctgtgcagctgacatcactggactagatctgggaatagatgaaataatgttgaaaacaaaactttagaggtgccttctggtatcagatgctgcaaggccttgagcatcagagtgtgttaagtcccatctactgtatcaaggccagagtgtggctccatgctcttaggaagggtttcccaaccacggggccagagcccaaaaggtttccccttccctaatatgctaatgaacgaaacatgtaaatctgttttcccctgttaggctagtcttactgtgatgagaagtgtacctggctttccttttcctgggtggagacagctggggcatattcgggtggcattccctctcagtaccagaggccccactgcctgcagctggaggcatgtgaccataagctcctgcttttgctttttgggcttgcatccctcttttctgtgaactctggagaatgctggaattaaaacatttaagcattttgattaaatgagcttgagctcctctgttcttttctaggtgctcttgttctccaactctcctgcctctttctacctctgccctatacattccagctctggagacagagtctgaaactggagtctctggagggatgagaaaaccatctttaattgtaacaaatggggtgggtagacgagcttcagagtgggagcagattgcattgaggttcaactctcccacccatgcctgggagtcaagtcttggagaggagtaacacttggtggtcagcacagctcagagtcagagacaatagccagcaggccagcaaggctggctgtgtgaggcacaggaagcagggcataggtagggagcagagctgggggttctctctctgctggaagatagcagctgccccttggcatatgggggttgcacactgcaccttgtagccagggctgctatttgctgttctgtgaaggagttggccactcattgtgacatgcaggacagtggccttctgagaacctgctgcttgcttgcatagtgcagcacaagtgaggacaggcaggggtgggagcatttatggtgatcagatgtgcctggcaagcccctgttcagacattgctcacattccaaatgttttcgtgtagaatattgcacaggtctggggacgctctacctgtgccctgtgagtgttaataatggtggagaaagagtgtagctgtgcccttgagagagaaggtgagggaaagagtgcaccagtcagctgaccgtcagctggctaggctcttcactgagtcctatgtcgcagtgcacaaatcactgcccatcaggcctcagtttcctcatctggtaaatggtgataacatcaatctgcccccccgccagggtgctgttatgagggtcaaaagtggtagtggagggtaatactgggtgagtccattgtgtgtgggaggagaaaggctttacattcacctggtacatgaaggtttttctgcttcaggcagcacagcacagccatttcttctggcctttacaaaaaggcattttgttatactacagtgtaaacctcatttttttcactccaaaaggtagcagcccctcttcttcccaccctggacctgcctttcactccctgggcacagagcgcatggtaccattgatgtttggtttattccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaa

SEQ ID NO: 416 - DNA, 159343 bp, Homo sapiens
gcagtagctaaagtcaccagcgtgcgcgggaagctgggccgcgtctgcttatgattggttgccgcggcagactcccacccaccgaaacgcagccctggaagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggtgagggccgggacggcgcgtgctggggagggacccggggccttgtggcgcggctcctttcccgcctcagagagtgggcggtgagcagcctctccagtgcggaggcacgggggcggaacgttggtgcttgtgcggattccgccgtccccaggttctgcttggctccggagggacgcccccctcagccctgaaacccgtgcctctccagccgccccggatctgaacttgtgatcacggagtgtttacgtcgtgccaggcattttaatgcattgttctagttcattttccagcagtcgcattcctcgccttggccctacatgtagcgctcattacaaacacggccagaatctcttattaacaaacagcagccaggagtgagatttaaaatagactgggggtttaggagacccttttatgacacgtaattctgctcccacgacgctcccatttataccgccggtccagctaagggtctggtaatggagcgccgttgaagagcagtatgatgaagtggtcaggaccaacggactctggagctgggctgcttgggatcaagtcgctgcccctctgcttattaacgtgtgaccttgggccagtcatggacgctatctgcttcagctcagcattcagtgctctccgtcacccgaccccatctatccaggattatctctccctggaaagctacaaacgtctcaccctatgtgggccaaatgttctggataggcctagttaacctcttctctccctgttttctttgcgctttcttgcagctatgtagttatgctaatgaaaagagcatcctagggggagcagagttgtggattctagtcctgactagaggactagtgcaaatgcgatactcctgatgaaaaatgtttcattcgttagatataaatgtgttaggcagggttatggacactagatgaaaaaagaaatacctctactttcatagagatcactattggacagcaaggcagaaataattacaattcaagttggaggcttatggaggtgagcttgtaagaggttacaagaggcgccaaggcaggatcgccaaagacggaagactttggaagagtctcatacaacggaagaggcgttatatgagacaccaaagtccacgttgagtcttggtggactagaagtttgctagggagagggcttgaaacgaggtagattggcgttgctggtgtagaaaaggaaggagactggcccaggtgggtggggttagatgaccaaaggcttttagtgtggtgttgagctgttgaaattttatgctgtagccaatgaaaagtctgaaatgttttttttttttttttttctgagacggagtcttactgtgtcgcccaggttggagttcagtggtgtaatcctggctcactgcaacctccacctcctgggttcaagcgattctcctgcctcagccaccggagtagctgggattacaggcacgtgccaccacgcctagctaatttttgtatttttagtagagatggggtttcaccatgttggccaggctggtctcaaactcctgacctcaagtgatccacccaccttggcctcccgatgtgctgggattacaggtattagccactgcacctgacctacatagattttacataagactttaaaacagggcgggcgcagtgactcacgcttgtaatcccagcactttgggaggctgaggtgggcggatcacaaggtcaggagatcaagaccatcctggctaacatggtgaaaccctgtctacactaaaaatacaaaaatcccagcactttgggaggctgaggtgggcggatcacgaggtcaggagatccagaccatcctggttaacactgtgaaaccctgtctctactaaaaatacaaaaaattagctgggtgcggtggcaggtgtctgtagtcccagctacttgggaggctgaggcaggagaatggtgtgaacccggaaggcagagcttgcagtgagccgagattgtgccactgcactccagcctgggcaacagagcgagactccatctcaaaaaaaaaaaaaaaaaaaaaaaagactttaaaaaaaattataagaaaggacagaccaagtgcagtggttcgttccagcacttagggatgccaaggtgggaggattgcttgatgctaggagttgaagactagcctgtgtaacatagcgagacccatctctacaaaaaaattaaaaagttacctttagaacttacgatttttatgtgtagactccatataagcagagggtctatgcttattcactatttattaccttccatagtccctgcacatataataggtgcttcataaacaatttaatgaatgaataaattactgagaaaacactggaagtttttgggttagcattgtgttaggtgcttgatatggtctggctgtgttcccacccttatctcatcttgaattcccatgttttgtgggaggtacctggtgggacataattgaatcatgtgggcaggtttttcctgtgctgttctcctggtagtgaataagcctcacaagatctgatggttttaaaaatgggagtttccctgcacaggctctctctctttgcctgccgccatccatgtaagatgtaacttgctcctccttgccttcctcaatgattgtgaggcctcctcagccatgtggaactggctgcagagtcattaaacttcgttcttttgtaaattgcccagtctcaggtatgtctttttttatttttttttgagacagagtctggctctgtggctaggctggagtgcagtggtgcgatctcgactcactgcagcctccgcctcccgggttcaagcgattctcctgcctcagcctcccaagtagctgggactataggtgcacgccaccatgcccagctaatttttgtatttttaatagagacggagtttcactgtgttggccaggatggtcttgatctcttgacctcgtgatcttcccgcctccgccttccaaagagctgggattacctacccagctgggtatgtctttattagcagcgtgaaaacagactaaaacagtaaactgataccaatagagtgggatgcagctgaaaagatacccgaaaatatggaagcaactttggagctgggtaacaggcagaggtcagagcagtttagagggctcagaagaagaccagaaaatgtgggaaagtttggaacttcctagagacttgttcaatggctttgaccaaaatcctgataatgatatggacaatgaaatccaggctcatgtggtctcagatggagatgaggaacttgttgggaactggagcaaaggtgacacttgttatgttttagtaaagagactggtggcattttgccctgccctagagatttgtggagctttgaacttgagagaaatgattttgggtatctggtgggagaaatttctaagcagcaaagcattcaagaggtgacttgggtgctgttaaaggcattcagttttaaaagggaaacagcatgaaagtttggaaaatttgcagcctgacaatgtgatagaaaagaaaatcccgttttctgaggagaaattcaagctagctacagaaatttgcataagtaatgaggatcccaatgttaatccccaagacaatgggaaaaatgtttccagggcatgtcagaggccttcatggcagcccctctcatcacaagcctagaggcctaggagaaaaaagtgatttcatgggccagcccggggtccccatgctgtgtgcagcctagtgacttggtgccctgcatcccagctgccccagctgtggctgaaaggggccaacctagagctcaggccatggcttcagagggtgcaagcctgaaaccttgacagcttccaggtggtgttgagcctgcaggtgcacagaaatcaataattgaggtttgagaatctctgcctaggtttcaaagatgtatggaaacgcctgcatgtccaggcagaagtttgctgcaggggtggggtgctcattgagttcctctgctagggcaatgtagaagggaaatgtagggtcagagcccccccacagagtccctactggggcaccacctagtggagctgtgaaaagagggctaccattctccagacctcagaatggtagatccacagacagcttgcaccatgtgcctggaaaagctgtagacacttaacgccatctcatgaaagcaaccaggcagtgtgctgtaccctgcaaagccacaggggcagagctgtccaaggctgtggttgcccagctcttgcatccgcatgacctggacatgagacatagagtcaaaggagatcattttggagctttaagatttgactgccatgctggattttggacttgcatggggcctgtagcccctttgttttggccaatttctcccatttggaatggctgtatttacccaattcctataccccattgtatctgggaagtaactaacttgcttttgatttgacaggctcatatgcggaaaggacttaccttgtcttgaatgagactttggactggaattttgaattaatgctgaaatgagttaaggctttgggggactgttgggaatgcatgattggttttgaaatgtgaggacatgagatttgggaggggtcatggcagaatgatatggtttggctatgtccccacctaaatcccatcttgaattcccatgtattgtgggagggacctggtgggagatagttgaatcatggggatggatctttcccatgctgttgtgatagtgaataagcctcatgagatctgatggttttaaaaacggaagtctacctgcacaagctctttctttgcctgctgccatccatgtaagacatgacttgttcctccttgccttctgccatgattgtgagacctccccagccatgtggaactataagtccagtaagcctctttttcttcccagtctcgggtatgtctttatcagcagcatgaagtccagctaatacagtgcttgaacatgtaatatctcaaatctgtaatgtactttttttttttttaaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggtaattatcttcctttttaatttacttatttttttaagagtagaaaaataaaaatgtgaagaatttaattgtgttttagtattttaagtagattgtgatagtagaatggtttgagacactttaatagcaattagcatgtggtttttaaaaagttgcagtttggctggtcgcagtggctcatgcttgtaatcccagtattttgggaggctgaggcaggtaggttgcctgagcccaggagttcaagaccagcctgcccaacgtggtaaagccccatctctactgaagataaaaaaatttaaaaaaattagctggggctattggcacacacctgtggtcccagctaatcaagaggatgaggttagaggatcacttgagcccaggaggttgaggttacagtttaactttcagaggccaaggcaggaggattgcttgagtccaggagtttgagaccaccctggggaatgtagggagatcccatctctatagagggatagattagatagataatttctgaggggaggggagggggagggccagggaaggggagggaaaggggaggggagggcagggccagcagtaaggtcataatagagacatgtatctgtaagatccttataataggtgaggatggccacaaattagcgccacagatttgtatttttagtagagacaaggttttaccatgttggccaggctggtcttgaactcctgacctcaagtgatccgcctgccttggcctcccaaagtgctgagattacagatgtgagccaccatgcccaaccacaagcatttatttatttatttatttatttatttatttatttatttagagacagtcttgctctgtcgccaggctggagtgcagtggcgccatctgggctcactgcaaactctgactccctggttcaagcttttctcccgcctcagcctcccgagtagctgggattacaggtgcatgctgcaacacccggctaatttttgtatttttagtagagatggggtttcaccatgttggccaggacggtctcgatctcctgacctcgtgatccgcctgccttggcctcccaaagtgttgggattacaggcgtgagccacagcactcagccagttatttttttataagaaaacattttactggccaggcctggtggctcacacctgtaatcccagcactttgggaggccgaggcaggcggatcacgaggtcaggagttcgagaccagcctggccaacatggtgaaaccccatctctactaaaaatacaaaaattagccaggcgtggtggtgtgcgcctgtattcccagctactggggaggctgaagcaggagaatcgattgaacccttgaggcagaggttgcagtgagttgagatcgcaccattgcactctagcctgggtgacagagcaagacttcatctcaaaaaaaagagaaaacattttattaataaggttcatagagtttggatttttcctttttgcttataaaattttaaagtatgttcaagagtttgttaaatttttaaaattttatttttacttaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacaggtaagcaaattgagtctagtgatagaggagattccaggcctaggaaaggctctttaattgacatgatactgtttcatttaaggaaaaataataaaaaaactcttttttttgtatctaattaaaataatgttctgatgtttacagaaactttgtatatttaattggacattagaacaagctgtttgttgtgtaagatttattttacctcagatcttttctcccccctttcctttctgtcttgtgttccaaaagagtaattattacggtaaatattactgtaattatggatttatcaaataagatgcagttctttagcattttttgataaatcgagtggaactttagcctgttattttactatttgttttattttaactaaattctgattgtgtcattttttttttttttttttgggaccgagtctcgctctgtcgcccaggctggagtgcagtggtgcgatctcggctcactgcaacctctgcctcccaggttcaagcaattcttctgcctcagcctcctgagtagctgggattacaggtgtgtaccaccacacccagctaatttttgtatttttagtagaggtgaggtttcaccatcttggccaggctggtcttgaactcctcacctcgtgatccacccacctgggcctcccaaagtgctgggattacagccatgagccaccatgctcggctttgattgtgtcatttgtataggcatgtggtttattatttagttatttttttttttttctttgaggtggagtatcactcttggtgcccaggctggagtgtaatggcgtgatctcagctcactgcaacctctacctcctgggttcaagcaattctcctgccccagcaggagtagcttgggattacaggcatgccccaccacacctggccaattttgtgtttttagtagagacagggttccaccatgttggtcaggctggtcttgaactcctgacctcaggtgatctgcccacctcagcctcccagagtgctgggattataggcatgagccacggtgcccagcatatttagatttttttttttttgagactgagtctgactctgtcacccaggctagagtgcagtggcacgatccacgatcttggctcactgcagcctccaccttatgggttcaagcgattcttctgcctcagcctcccaagtagctgggactgcaggcacatgccaacacgcccggcttatttttgtatttttatagagacggggtttcatcatattggtcaggctggtctctaactcctgaccttgtgatccacccgccttggcctcccatagttctgggattacaggcatgagccacagcgccaggcctagatgtttcttaaggtatgtatctcccaaagattctttttgtggtcctcaagtaccataagcaccgctggagataacacatgtgatgggcatttttagcatagattgtatctaagcaactttccacaagtaatagttctgttaagggttgttattgtggccgggcgcggtggctcacacctgtaatcctggcactttgggaagctgaggcggccggatcacctgaggtcagggattcgagaccagcctgtccaatgtgctgaaaccctgtctctactaaaaatgcaaagaaaaaaaaaatctagccaagcatggtggcttgctcctgtaatcctagctacttgggaggctgaggcaggagaattgcttgaacctgggaggcagaggtagcagtgagccaagatcgtgtcaccgcattccatcctgggcgacagtgagactctgtctcaaaacaaaaaaagagttgttaccgttgggactattttttgaaagctttatgtgaacgtaattttatattttgatgaaaatttagtttattgatgtaaaaagtgtatcagtacatcatatcagtgtcttgcacattgtataaacatttaatgtaggtgaatctgttatcactatagttatcaatgttataattttcatttttgcttttcttattccttttctcatagtagtttaaactatttctttcaaaatagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggtacatggattataaatgtgaattacaatatatataatgtaaatatgtaatatataataaataatatgtaaactatagtgactttttagaaggatatttctgtcatatttatctcaaaacctaaactgtgtatcaatgatattaagcttttttttttttttgagacagagtttcacttttgttgcccaggctggagtacaatggcgcgatcttggctcaccacatcctctgcctcccaggttcaagtgatcctcctgccttggcctcctgagtagctgggattacaggcatgtgccaccacgcctggctcatcttttttgtatttttagtagagatggggtttctctatgttggtcaggctggtctcaaactcctgaacctcaggtgatccgcccgcctcgggcttccaaagcgctgagattgcaggcatgagccactgtgtctggcctatttttatagtttatgtacttggaattatataatatattctgcctagcttctttcattcaatatttgtaagatttatccatattattgagtgtagttgtggatttttgcatttatatttcatagcacgagcatgtcagaatttatccattttacttcccttctgcccgccactgctactctccccattttacctttttttttgtttttttgagatggagtctcagaatttcgctctgtcgcccaggctggagtgctgtggcacggtctcagctcactgcaacttctgcctctgggttcagctgcacgccaccatgcctggctaatttttgtattttcagtagaggggattttgctatgttggccaggctggtcttgaactcctgacctcaggtgatccacccaccttggcctgccagagtgctgtgattacaggcgtgaaccaccgtgcccgacccccattctaattttgatggacatttgggtaattttcatttttggctgttataaatactgctgcaattacagttaattttcacagtttttttttttttttttttttttttttttttttgaggtgagtttcgctcttgttgctcaggctggagtgcagtggtgcgatctcagcccactgcaaccttcaccttctggattcaagcaattctcctttctcatctcctaagtagctggggtttacaggcatgtgccaccatgcccagctaatttttgtattttaatttcacagttctggaggctgggaagttcagaattaaggcactggctgatctgttgtctggtgagggcccacttgttcatagataaccattttctcactctaacctcacaaggttgaaagggcctaatttttgtgtttttagtagagacggggtttcactatgttggctaggctggtctcaaactcctagcctcgagtcatccacccgcctcgtcctcccggagtgcttggattacagcatgagccactgcgcccggcccccattttagttttgatggacatttgggtaattttcttttttggctattctaaataatgctgcaattactgttaattttcaccttgtaaaaaccattttcaaatctcaagagattaacctttagttttcttggtttggattgggaaggaacaccaaggaaaatgagggacttcagaatttattttcattttgcatttgttttttaaaatctttagaactggatccagtggtatagaaatcttcgatttttaaattcttaattttaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcaggtaaaaaaaaaaaaaaaaaaaaaaaaaaagggttaaaaatgttgaatggttaaaaaatgttttcattgacatatactgaagaagcttataaaggagctaaaatattttgaaatattattatacttggattagataactagctttaaatggctgtatttttctctcccctcctccactccactttttaacttttttttttttaagtcagagtctcacttgttccctaggccagagtgcagtggcacaatctcagcccactctaacctccacctcccaagtagttgggattacagttgcctgccaccatgcctggttaatttttatatttttagtagggttgcggggacagggtttcaccatgttggccaggttggtctcaaacttctgaccttaggtgatcctcccacctcggcttcccaaagtgctgggattacaggcttgagccatcgtgcccagcctactttttacttttttagagactgggcttggtggagtgaagtggcaagatcatagctcactgcagtattgaactcctgggctcaagcgatcttcctgcttcaacctcatgagtagctgggtctacaggcacaagccaccatgcttgcctaattttaaaatttttgcagagttggagtttcacagtgttgcccaggatgttcgctcactcctgacttcaagtgattcttctgccttagcctctagagtggtagctgggattacaggcatgaaccaccatgctctgctattttttttcaaggtttttttttttttttttttttttgagagactggtatgactatgtatgctccctaggctggagtgcagtggctattcacaggaagtgccatcagagtgtactacagcttcaaactcctgggctcaagcacttctatcatagtctccaaagtagctgggactacgagtgtgtctcattgtgccttgctctcgaattgctttttttttttttttctggtttcaagctatctatgtggtattagtcctcactttatgaataattttgtatactactaatagcaattttttttttttttttttttttgagacggagtctcattcttgtcgcccaggctggagtgcagtggtgtgatcttagctcactgcaacctctgcctctccggtttgggcaattagctgggattagaggcgcctgccaccatgcccagctaatttttgtatttttagtagacatggggtttcatcttgttggctaggctggactctaactccaggtgatctgcctgcctcggcctcccaaattgatgggattacaggtgtaaaccactgggcctggcctagcaatttaaaatgacattctaagaagttttatgtctaaatctgcagtaagtggctgggtgacgtggctcatgcctgtaatcccaacgctttgggagtccagggtgggaggatgacttgaggccaggagttgagaccagcctgggcaacatagtgagactctgtctctacaaaagaaaaaattagcggggcttagtggcgtgcgcctgtagtctcagctactcgaaaggctgaagtgggaggattctttgagccccaagggttctggcttgccgtgagccaggatggcaccactgcactccagtctgggcaatagagtcagaccctgtctcaacaaataaaataaaactgtagtaattataaagtggttttggctgggggagaaatgtacagttgaacatacggattaagaggttgaaagttggtcttaggaagaggaactttttgtggaaatttcttaatatttgaagaatattatgttattgttcctctgtttttcatggcgtagtaaggttttcactaatgagcttgccattctttctattttattttttgtttactagggttctgttgaagataccactggctctcagtctctggctgccttgctgaataagtgtaaaacccctcaaggacaaagacttgttaaccagtggattaagcagcctctcatggataagaacagaatagaggagaggtatgttattagtttatactttcgttagttttatgtaacctgcagttacccacatgattataccacttattgtaatatgcagttttggaagtatatgttaccatttaactgtacagagtacatagtaatagagtggtaattatttagattgattaaagaactcatttttttaaataagttttttttttttcactataaaagtttattttatttgagatggtatggtatcgaacatgttcatattgtgtgtaatcgtgggtaaattactcaacctttatgtcatagtttcttcacctttaaaatgacattaataaaagagctacttaataggattataagcatgagatgatttaatatacataaaatacttacagtctgatatataggaagcacttaactctttatcctagaaaagatttaaggtgaccttaacatatatgtcagaaaatctttaaaattgtggaaataaaaggttgtataattctgctatcctaaaattactagtatttcaatatattttattttagtcttttcttttagatacaagttttaaaacttttaagtgaagtgtaatatacgtaagtactgcttgatgaatttaaggtgatttctaaagccaggtttgttggggaagaggagtgggatttagtgatttagaaccagaaattggggctgggtgcgatgtctcatgcctataattccagaacttcgggaggccatagtgggagaattgtttgtgccccggagttcaagaccagcctgggcaactcagtgagacgccatctctacaaaagaaaaaaaaaaaaaattagctcagtgtggtgacatgtacctgtagcccgagctactcgggaggctgaggtgggaatatcaccctggcccagaagtttgaggctgcagtgggctatgattgtgccactgaactccagcctgggcaatggagtgaaaccctgtctcaaaaaacaaacaaaaaaagaaactgaggctgggcacggtggctcacacatataatccagcacttggggaggttgaggcaggataattgcttgagcccaggagtttgagaccagtctgggcaacaaaatgacaccccatttctaccaaaaaaaaaattgtttaaaattagctgggcatggtggcatgtgcctgtggtcccagctacatgggaggctaaggctggaggattgtttagcccaggaggttgaggctgcagtgagccatattcatgtccctgcactccagcctgggtgacatagtgagacgctgtctcaaacaaaaatcaacaggccagatgcagtggctcacccctgtaatcccaacactttgggaggccgaggtgggtggattacttgaggtcaagagttcgagaccagcccggccaacatggcgaaaccccatctctactaaaaatacaaaattagatgggcatggtggtgtgtgcctgtaataccagctactcttgaggctgaggcatgagaatcgcttgagttgggaggcaaaggttgcagtgagccaagattgtgccactgcactctaccctgggtgagaaacgagattttgtatcaaacaaacaaacaaacaaaaaaagacgcccaaaatcaacaacaacaaaaacgatattggaatgattggatccccaaagataaatgtttgaggtgatggatatctcagttaccctgagttaagtattatacattgtatacgtgtattaaaatattacaaacccccaaatgtgtacaattatgaggtatcaataaaagagattggaaggactgggtaatttgcaagtaattaaggcaatttacaatttttaatttttatttgtgaataagtagttatacgtgtcaaaattcaaaaaggacaggtggatatacagtgataagtcatccccccttctctgtcagctccataaagagcccctgtcttgcatggctccagggtcacatttcctattgtattttgccaccacctgccctgggagcaacagtgttagtttcttgaacatccttccaagcagagtctgggcctacacaagcaaaacaagtatgtctattctctctcctctttaatttttttaaaggaagtgattgataatttaacactcaagctataggtcattggttatatttttaatttccaatttatgggaatagaggaagtgtcagtgatccccttctggtttaagaactggaggatgcatgtgtttagaccctttagaaacctgaaatgtcacctaatataattatcagagtaacactttttagtaagcaagctatctatcaaaagtaggtttttgaagaagagggtaaggaaaggttactttcatgggacatagcaataatttctaaaatctaatggttttacaagacttgttcattagaagtaacatctgtgaggatggctttatgagtcaaaatattatctgcttaataccccacctgtagggtaagaagaaatgtttttttcttggtgacaatttttagcagcaagcggggagggcctgtggcttccaaggccaaacgttgaaataccacagactaggaagaaaaagatccactccttatacaggatttgtttgtttcttcttttttcttcatttttgtagagatgaggtctcactatgttgcccaggctggtctctcttttttttttgagcccgagtttcactcttgacgcccaggctggagtgcagtggtgtgattttggctcaccgcaacctctgcctcccgggttcaagcgattctcctgcctcagccttcctgagtagctgggattacaggcatgcgccaccacgtccggctaattttgtatttttagtagagatgggtttctccatgtgggtcaggctgctctcgaactcccggcctcggatgatccacttgcctcggcctcccacagtgctgggattacaggcgtgagccactgagcccagccatgctggtctcaagcaatccacacccacctcagcttccaaaagtgctggcattacaggtgtgagcccccgtgcccagcctgtttcttataattattcctctttctcaactctgtctgctgtggtacctcatgcttcctagtttaagccttcttgggagttctcaggagaaatctgttatctcccttactaagcatttgggattgatgttccttccaggttactataaaaccaagttttttttggttcttttttttttttcttttaaaagaaatgagattttgtcatggttagcctggtttcaaactcccaagctcaagtaatccaccttcctttgcctcccaaagtgctaggattacaggcatgaaccactacacccgatctgtactgttcctctttccattcactaaaacctacttgcaactatgagcatatgttattgccatctagaaatgagtttctagggacttgttcctttttgtactttatttaaacagtcgaattagaaattattattatcattatttattttttgagatggagtcttgctctgttgcccaggttggagtgcagtggcgtgatctcggctcactgcaacctccacctcctgggtttaagcgattctcctgtctcagcctcccgagtagctgggactacaggcatgtaccaccacacctggctaatttttatattcttaatagaaacagggtttcactattttggccaggctggtctcgaactcctgacctcagatgatccactcaccttggcctcccaaagtactggaattataggcgtaagccaccgtgcccggccaaaattatttataataagcaaggcatggtggcttgtgcctgaagtcccagctacttgggaagctgaggcaggaggatcacaggttcaggtccaccctgggaaaatagtgagaaccttccctatccccagtcttcaaaaaagaaaaaaatttgctggagaaggtcacacaatgctgataggtcccattgtgctttcatgctttctagttttcaatgataactggttgttacttttattgtctgactcattatagtgaccaactcccgattttttactttgccttaagccttcagctatctcctacctctaagcggatgatttcttccttaacacttaaaacctcaaaatttatctgtacttccactcttttactctctggctctttctcagaagaagaaataacacttttatttcttttcaaagccaacctttccatactttacttggagacatatttctttttttttgttttgtttttgtgagtggagtctcactctgtcgcctggtctggagtgcaatggcgcaatctccactcagtgcaacctctgcctcccaggttcaagcgattctcctgcctcagcctgctgagtacctgggcttacaggttagcacaccacacccggccaagttttgggtttttagtagagacagggttttgccgtgttggccaggctggtctctaactcctgacctcccgatccgcccgcctcaggtgcaagccaccgcgcccagccctagtgtagcaatcttaatcagaaatatgtctctggctgggcgaggtggctcatgcctataatcccagcactttgggaggccaaggcaggcagatcacctgaggtcaggagttcaagaccagcctgaccaacatggagaaaccctgtctctattaaaaatacaaaattagctgggtgtggtggcatatgcctgtaatcccagctactcaggaggctgaggcaggagaatcgcttgaacctgggaggcggaggttgcggtgagccaagatctcaccattgcactccagcctaggcaacgagcaaaactccatctcaaaaaaaaaaaaaaaaaaaaaaagattgctatgttaatcttatttatttatttatttattttgagacagagtctcacactattgccagggctggagtgcaatggcataatcttagctcactgcaacctccgcctcccgggttcaggtgattctcctgcctcagcctcctgagtagctgggattacaggcgcccgccaccacgcctggcttattttttgtgttttttagtagagacggggtttcactacgttggccaggctggtcttgaactcctgaccttgtgatttgcccacctcagcctcccaaagtgctgggattacaggcgtgagccaccgtgcctggcttatgttaatcttattttatataaaaagaaataatattaaactagaaggcaataaaaatgccaaattcaatacacaaattattttgtcagcatttccacaagaataaactattttatatgctaacatatgttcaatgttccttacagaattctgacattaaaaatgaaaaattaccaaagcttcagatgaatctataaatggacaaaagaaaaagcttaaaaggataaagagcaacactccaagtgcatgtataaacataaggactcttgggacttaacctttttaaaaatctttaggcctagcacagtatttgctatttaatgtatcaaatgggtggttttgacttcattaatccatatataggacagatgaaaaaaagaattatagacttgtaattacagttctttaggaaccatatttgctctcagccttttaaatacgctgtcaggcaattccagtcagcacttttgaaaaaaacctacctacctacctacctacctatctatctatctatctatctagagactgagttataagactagctagtttttgtattttttgcagagacaggatttcatcatgttttctaggctgttcttgaactcccaggctcaagccatccacccgcctcagcctcccaaagcgctgggattacaggcgtgagtcaccatgcccaaccaattccagtcagctcttaaaatgaaagcctagaaatggtagggttaaagaggggacagaatgttgattttaaaatacctagaatttggccaggtgcagtggctgtaacccagcactttgggaggccaaggtggccggattgccttggcctgcctcagcctcccaaagtgctgggattacaggtgtgagctcaggagttcgagaccagcctgggcaacacggtgaaaccccttctctagtaaaatacaaaaaattagctgcatgtggcggcgtgcacctgtggtcccagttacttgggaggctgaggcaggagaattgcttgaacctgggaggcagaggttgcagtgagctgagattgcgccactgcactccagcctgggcaacagagtgagactctgtctccaaaaaaaaaaaaccccaagaatttgattaattctgttggaattttaagagttaactgatccccaaaatgactcagctgtatgcaatttaatgcaatattaattcgcatgttgactctcagaattgcatacagctgagtcattttattgagtaggattgataagtatactatgttatgccaacagtaactgtgatgcttctaaaattgtgatttttaaattggcattgtcacagaaacagcagagtagttgtttttttctttaagcttcttttagccagaaacataaactgaaactgtaattattactgcaatcgtatgttgaatagacttgtgaaactagcaatttattaggcttttaatgatatctggaccaaaggctgagggagctgtgctgtgtgtatgttgctttgtgctttgttttttagaagcttgtcgtttctttgccattttacttctttctttttttttgagacggagtcttgctctgtcccccaggctggagtgcagtggcgcagtttccgctcactgcaagctccgcctcctgggttcactccattctcctgcttcagcctcccaagtagctgggactacaggcgcccaccaccacgcccggctaattttctgtattttttagtagagatggggtttcaccatgttacccaggatggtcttgatcttctgaccttgtgatccgcccgcctcggcctcccaaagtgctgggattacaggcttgagccaccacgcctggcccattacccattacttgtttcttaatgttacattctctttccctctttttttttttttgttttttgagatggagtttcgctcttgttgcccaggctggagtgcaacggtgccattttggcccactgcaacctctgcctcccaggttcaaatgattctccagcctcagcctcccaagtagctaggattacaggcacctgccaccacgcccagctaatttttgtatttttagtagagatggggctttgccatgttggccaggctggtcttgaactgctgacctcaggtgatctgtctgcctcagcctcccaaagtgctgggattacaggtgtgagccactgcacccagtccttaatgctactttataggtgaaaattgtgaaataacttaaatttcattttaattaaagttaatttttgggaaattaacgaaaggttgacattttattcttttgaatattgcagttgttatttgggtttaaattggggggcttaggaaggaaagaagcctgatggttgtttctgaattttctgaaaattatgtttgatatgctgtatatgaaatccagcttggagagaatatgtccattgttaaggaaaaattaatgaagatttgatctagataaggcattccaatcatttggaagtggtttgagtatctttttttctttttttaatttgagacagagtcttgctctgtggagtgtagtggtgcaatcttggctcactgcatcctccacctcccgggttcaatcaagcaattctcctgcttcagcctcccgagtagctgggattacaggtatgggctaccatccccagctaatttttttttttggatggaatcttgctcccgtcgggcaggctggagtgcagtggtgtgatctcagctcactgcaacctccacctcccagtttcaagcgattaagtgattctccttcctcagcctcccgagtagctgggattacaggcgtgtgccaccacgtcgccaccacgtctggctaatttttgtatttttagtagagacagggtttcgccatgttggccaggctggtcatgaactcctgacctcaggtgatccacctgcttggcctcccaaagtgctaggattacaggtgtgagccactgtgcctggcttaagttttgtatttttagtagagacggtgttccatcatgttggtcaggctggtgtcaaactcctgaccatgcgatccgcctgcctcggcctcccaaagtgctgagattacaggcgagagccaccgtgcccggcctgtttgagtatcttttaaaaccagtaaggacaaactagaggtgtcagctctcttcatgggctttggagaaacaagacaaaaaggaaagagatgtttcgccgggcgcggtggctcactcctgtaatcccagcactttgggaggctgaggacagcggatcacccgaggtcaggagtcaagaccagagccattgcactccagcctgggcaacaagagcacaactttatctcaaaaaaaaaaaaaccaaaaaagaaacaggaaagagatgttttgattttttaagtctagagtgttctgttcttactctacagcacttagcagtagtccatctatcctccttgtttgttctttacaacaaaaccccattggttctctcttaccaagtttgctttattcttggtttatcctttgtaagatgtgaaagggatatgaagagcaaataggaagtgttactcttgctgcttgagagaaagctgttttacaatttgttggcaaacaatttgtaaaagtacaacaaaagtgtgcatttttggcttcttatttatgttttatcattgctatatctcataatttgtgatttttaaaataactttttatttgaaaagcactacagggtcacgtcatgtttttaaaaaataaattaagaaggtaaacacccgtacttctactttacctctagtcctagtctatggtggtaatcagtgttaacagtttagtttgtgttcttacccttccaggggttttttttctctatgtatacagatatatgcatttttaaaaacatagttaacacttaaaaacaatatgggatcgtattaggaatacaatctgtattccttcccaacagtatatacagtttttttccatttcactatgtatctatttataaattttttatttctaataatttctcttgaataggtgagacatcatatagtataaaattcagtagaaaatcagtttttcagaggtacaaaattggctgactttgcacagactcctttcatttcacaggtagggatgcacagccacctcttccaccgacgagaggaaaggatatgtgtgcctgtgggctcttcaactctgttgattagttatgatttattttctggtcagtttgagaggaaacagtgataaaatactgggaacagggaagaagcataagattattattgtttttttttttttttttgagacagagtcttgctcagttgcccaggctggagtgcagtggtgcgatctttgctcactgcaagctccgcctcccgggtccatgccattctcctgcctcagcctcccgagtagctgggactacaggcgcccgccaccacgccctgctaattttttttttgtatttttagtagagacagggtttcaccatgttagccaggatggtctcgatttcctgacctcgtgatccacccgcctcggcctcccaaagtgctgggattataggcgtgaaccaccgcgcccagctttaattttttttttttttttttttttgagacagagtcttgctctgtcgcccaggctgaagtgcagtggcgcgatctcggcttgctgcaagctccgcctcccaggttcacgccattctcctgcctcagcctcctgagtagctgggattacaggcacccgtcaccatgcccagctaattacgggacctcgctctgtcgcccgggctggagtgcagtggcacagtctcgctcactgcaatctggcaagtgattctcttgcctcagcctccagagtagctgggactacaggtgtgcgccgctacgcccagctaatttttgtatttttagtagagatagggtttcgccatgttggttggccaggatggtctcgatctcttgacctcgtgatccgcccttctcggcctcccaaagtgctgggattaccggtgtgagccatcgcacctggccttcctactttattaagatacctaagggatttctgtgattgttaggattcaaatttctgtgagcataagaatcaagctgtgtgcataataattgcatgggatttcacagctgggccccattcccagggattttgtattatctacctccaagtgattttgatgctggtgatccttggaccagacttggtgaagctcaatgcttagctaggaaagccccaaaaatttgctttattggattgtgtaatttgactacatccattgtttcttttttcaaatgtagagttatatgccacaaaaatattttccgtagcagtaggcatcctaattaatctcgatgtttgtttatagccccattgatggggctataaacttggcagcaaattgttttcccactaatttggcattttccataaatgtttgtttatagccccattgatggggctataaacttggcagcaaattgttttcccactaatttggcattttccataaaaaacacgtatctgttgttagctgcctagacgttagctggacatggtttaggttacttttctcttaaaaagtaaattttaattcaagttcctttaagccagcagtctcaacctggggcagtttttccctccaggggacattcagcagtgtctagagacatttttggttgtcatgctgaggaagagagtgtatagtgggtagaatccagggatgctgttaagcatggaacagccccttacaacaaaaaattatgtagcctaaaatggcagtgttgccaagattgagaaattatgctttaaatgtgtttttatatatggccattttgtgtttactctggagataacatgcttttcctcatataacatgcttgataaacattttggtaacacaggaattgtaaatgctggtgatgtcagtaaatagttaagaaatttagggctgtgcgcggtggctcacgcctgtaatcccagcactttgggaggccgaggcgggtggatcccgaggtcaggagatcgagaccatcctggctaacatggtgaaaccccgtctctactaaaaatacaaaaaaatgagccgggtgtggtggcaggcacctgtagtcccagctactcaatttagaaagcagatttgtttcctttctatacctgtgtaatttgaggtttagtttactgtcacatcgtttataaacataaggaagatcgttgctcatctgatagcattccgaaccttgagtcatctgtaatgcctatggcctccagaaaagcttctctaatactgtacttagagatgtgtaaaatatgtaggaacattttcccaccttcgattgttagtttacctttcagcttcagtaatttacctttcagctattactttagtaacatcttcaacattgtttttcaaactgcaaggtgtgacccagtagtgggtcgttaaattagtaggtgacagagcatttttgaagaattaaatacaatagaacatagcagagtgggctcacgcctgtaatcccagcactttgggaggcgaggctggcaggtcacaaggtcggcaggtcacaaggtcagaagatcgagaccttcctggctctaacatggtgaaaccccgtctctactaatagtacaaaaaattagcggggtgtggtggcatgcgtctctagtcccagctactcaggaggctgaggcacgagaatcacttgaatccgggagctggaggttgcagtgagccgagattgcaccactgcactccagcctcagcaacagagcaagactatttcaaaaaaaaaaaaaaaaaaaaagaaagaaagaaaaaaagaaaatagagtgtatcacataattagagtagcaagtattgatttgtgaaacctattttaatcatagatctatgtatgtatgtgctggattgtgatgtaaagacatttcttgctgtggttacactgaaaaaaatgaaaagtcactgatttccaataacttacagaagcagtatgaactacatattctgtcgttcttgaaacaagctgagattttattgactttgggaagcagtagaattattttagttttttaattaacagtttttggctttgtactgtcaagaggtaattttagaaagcattctaaaaatgtaagtactggatttggcaacattcttgaactgtaattctgtttcgttaaacatcactatttacatgtgcaacagcgtgtctgtaacaatgtcccagtaatgaaattctttcttctatttaaggcatgtctgtttgataaaagtcaaacaaaattgggtatatgtcagtgtcttatgatactgcttaattaaacattaatttgactcttagctaatcaggaaatgtttgcctcacagtcttacagagctttccaccttctaaaaaagctaacgtttcagaatagattcaggattcaaccttctttctgtctttttttttttttgtttgagacagagtcttgctctgttgcccaggctggagtacagtggcgctatctcggctcactgcaacctccgcctcctgggttcaagcaattctcctgcctcagcctcccgagtagccggggttacaggcgtgcgccaccatgcccagctaatttttttgtatttttagtagagacagggtttcaccatgctgggtggccaggcgggtctcaaacttctgaccttgagatctgcccaccgtggcttcccaaaatgctgggattataggcgtgagccaccgcacctagcctagattcaggctgcttctttttttttttttttttgagacagagtcttgctcttgttgcccaggctggagtgccatggcatgatctcagtgcaccacaatctctgcttcccaggtttaagcgattctcctgcctcagcctcccaagtagatgggatcacaggcatgagccaccatgcctggctaattttgtattttttgtacagacggggtttctccatgttggtcaggccagtctcgaactccctacctcaggtgatctgcctgcctcggcctctcaaagtgctgggattacaggtgtgagccactgcgcccagcagattcaagctttttaaatggaattttgagctgatttagttgagacttacgtgcttagttgataaattttaattttatactaaaatattttacattaattcaagttaatttatttcagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggtaacaagtgattttgtttttttgttttccttcaactcatacaatatatacttggcaatgtgctgtcctcataaagttggtggtggtgactcactcttaggacacattcagatttcttttttttttttttttgagaaggagtcttgctccgttgccaaggctagagtgcagtggcacaatctcagctcactgcaacctctgcctcctgggttcaagcgattctcctgcctcagcttcctgagtggctgggattacaggcatgtgccaccatgcccggctaatttttgtacttttagttttaccatgttggccaggttcgtctggaactcccaatctcaggtgacccacctgcctcggcctcccaaagtgctgggagtacaggcgtgagccacagagcctggccatgttcagacttctaataacaggtttgtattgactcttagcctcatggcagaagccaagagacatgagacagcttagaaatttttgctttttggaaatgaatgttagagttactggtttgtgattaaggcctattgcactgacagaggcagtgaaaaagggtttgattgccaaggaagattcacagggcctagaatggcagtggttatgcatctacagtttattacaggagaaggatacaatccagtagcaggattatggtaaggatatgcatcacagtcaaaggctgtcatagcaagtcatccagagagttcgggtgcaagttccagttttcctttgttgtgtaaagtctgtggtggggtgcattttctctctcagagcaggatgtgtgcacaggacaccttggaacctaggagcccaaaatagagtcttcactggactttttaatatttttcttgtcaagcggacatgttcctgttctctaactagcctcttcagtggaggtcagaggaagagcctcattgagaccaagtgcaactcatcaatcacatgaaacaatgctgataaataaaccacctaaatatcccctgacccacaaatacaaaacaacaccattcaatcagtatttttcatgccttgatcaggggtcattgccatgcaggaactttaacaaaacagtacaggctaataatagaattgttggaattaactcacacagcacacctatgagagagagttaagatagagggtcttggtggtctctaacagttgaattcaaagtgaagttaccagagtaaagtgagcaaagacacatattagtacaatattggtagataaaatcacgttgctctaataagcatagttttaaactttaaccatgtttctccagtaattttagtaattatattgttgttatgtctaatacataaagcattttttacttttttaaaaaatttttaggcaatgtggggtccaaagtaattaaaaaaaaatttttttaacataaagcatcttaaaattttacttaatcatgatcacttagaaccattaaaacatacgttttgatattatggggaagcttcgttgttcctttgtagacagacttaaagaaatacaactttatgatgacaagatataagataattatagatttaaattttatagaaaccttttcccttatctagtgcaagaggtagctaagtgcttattttctcaaagtactgtgttataaaaagtattcctagtgtagtcaaagcttctctttagactgataaaacttagagcacctgcatttacttccaacaaagcagaattaaagaaaatgagacttggccgggtacgtttgtaatcccagcactttgggaggccgaggcaggtggatcatgaggttaggagatcaagaccattctggctaacatggtgaaaccctgtctctaccaaaaatacaaaaaattagctgacatggtggtgcgcacctgtagtcccagcttctcaggtggctgaggcaggagaatcgcttgaacccaggaggtggaggttgcagtgagctgagatcacaccactgcgctccagcttgggcaacaaaaaaaaaaaaaaaaaaaagaaaaagaaaatgagtctttactggctgggcacagtggctcacacctgtaatcccagcactttgggagaccgagacgggcagatcacctgaggtcgggcattcgagaccagcctgaccaatatggagaaaccccatttgtactaaaaatacaaaattagcggggcgtggtggcgcatgcctgtaatcccagctattcgggaggctgaggcaggagaattgcctgaacccgggaggcggaggttgcggtgagcagagatcgtgccgttgcactccattctgggcaacaagagcgaaactctccatctcaaaaaaaagaaaatgagtctatactttgctgttttcatactctcttagtgtggtgtaggcagccatgtatcccccttgtgcctctatttctccattctgtgaatgagtgtcttccactgctgtgcttttctgattccgtaacctttgtttgtttgtttgtttgtttgtttgtttgttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaatgagcgtgctgccttcaagcatctgtttaacaaagcacatcttgcaccacccttaatccgttcaaccctgagtggacacagcacatgtttcagagagcacagggttgggggtaaggtcacagatcaacaggatcccaaggcagaataatttttcgtagtacagaacaaaatgaaaagtctcccacgtctacctctttctacacagacacggcaaccatccgatttctcaatcttttccccacctttcccccctttctattccacaaaaccgccattgtcatcatggcccgttctcaatgagctgttgagtacacctcccagacggggtggtggccgggcagaggggctcctcactacccagtaggggcggccgggcagaggcgcccctcacctcccggacggggcggctggccgggcggggggctgaccccccccccccgcctccctcccggacggggcggctggccaggcggggggctgacctccccgcctccctcccggatggggtggctggccgggttgggggctgaccccccgcacctccctcccggatggggcggctggctgggcagaggggctcctctcttcccagtaggggcagccgggcagaggcgcccctcacctcccggatggggcggctggccgggcggggggctgacccccccacctgcctccaggacggggcggctggccgggcagagcggctcctcacttcccagtaggggcggccaggcagaggcgcccctcacctcccggacggggcggctggccgggcagaggggctcctctcttcccagtaggggcggccgggcagaggcgcccctcacctcccggatggggcggctggccgggcggggggctgacccccccacatccttcccggacggggcggctggccgggcagagggtctcctcacttcccagtaggggcggccgggcagaggcgcccctcacctcccggacggggcagctggccgggcggggtgctgacccccccacctctctcctggctgggcggctggctgggcggggggatgacccccccatctccctcctggatggggcggctggccgggcggggggctaacccccccacctcccttccggacggggtggctgccgggcgcagacgctcctcacttcccagacggagtggctgccgggcggaggggctcctcacttctcagacggtgtggctgccgggcggaggggctcctcacttctcagacggggcggttgccaggcagagggtctcctcacttctcagacggggcggccgggcagagacgctcctcacatcccagacggggcggcagggcagaggcgctccccacatctcagacgatgggcggcctggtagagacgctcctcacttcctagatgggatggcggccgggcagagacgctcctcactttccagactgggcagccaggcagagaggctcctcacatcccggacgatgggcggccaggcagagatgctcctcacttcccagacggggtggcggccgggcagaggctgcaatctcggcactttgcggggccaaggcaggcagctgggaggtggaggttgtagcgaactgagatcacgccactgcaccccagcctgggcaccattgagcactgagtgaacgcgactccgtctgacatcccggcacctcgggaggccgaggctggcggatcactcgcggttaggagctggagaccagcccggccaacacagcgaaaccccgtctccaccaaaaaaataccaaaaccagtcaggcgtggcggcgcgcacctgcaatcgcaggcactcggcaggctgaggcaggagaatcaggcagggaggttgtagtgagccgagatggcagcagtacagtccagctttggctcggcatcagggggagaccatggaaagagagggagagggagaccgtggggagagggagaggagggagagggagagggaaccttttgttttattccagtaggaccagctagaaacagaaggtgattgaccagtattagggatggaatcagggtacaattatggagacaggctatctaaacaattcactctcaccatttaaatcagctgtttgatcattttttttccatatatctttaccatcgcatagtaaataatatcctttttattttcaagagggagtattggccttaagttaggaactctcttaatttttttcccccatcatcccacccgcacttcttactccttacttcctacttgcttttattctttactggctctttaccactgcgtatttttaggtgcatacatctattttttaaaaaagcacccttgttcctgggtcctcttccagtaccatctattaatatatctctctccctctttccactcccagctgggtttctgaaagcgtgcacttcccatcttccattcattcatctggtttccagccctgaccacagtactgaaatggcatttgctaggtgacctttatttttttttaaatccagtgaatgcggtatagtccccccgcttttttctttctttttttttttttgttttttgttttttgtttttttgagacagagttttgcccttgttgcccaggctggagtacaatggcgtgatatcggctcacggcaacctatgcctccccaggttcaagcgattctcctgcttcagcctcccaagtagctggattacaggcacctgccaccacagctggctaattttgtatttttagtagagatgggttttctcgatgttggtcaggctggtttcgaactcccgacctgaggtgatccacacacctctgcctcccaaagtgctgggattacaggtgtgagccactgcgcccagccttggtatagtctttaacgaaagttcactgatcttgaaaattttgatcttgaaactcttttttttttttttttttttttttttgagatggagtcttgctctgtcacccaggctggagtgcagtggcacaatctcagctcactgcaacctccacctcccaggttcaagcgattctcctgcctcagtctcccgagtagctaggattacaggtgcccaccaccatgcctggctaattttttgtatttttttagtagagatggggtttcactacattggccaggatggtcttgaactcctgacctcatgatccacccacctcggacctcccaaagtgctaggattacaggcgtgagccaccatgcccagccttgaaactctcctaaggttatgttaaacatttttgtattcttggttttctttttgttccatgggttatttctctttatccttctttttagctttcttaagtgttcctttaccttatcaaattctatttttggctcccatttcacttaataagaggaaaagctgggatttttttttttcttttgtggagacagagtctcactttgttgcccaggctggagtgcagtggtgcgatctcagctcactccaacctccgccttctgggttcaagcgattcttgtgcctcagcctcctgtgtagctgggattgcaggcatgtgccaccacgcctggctaatttttgtatttttagtagagatgggggtttcaccatgttggccaggctggtctcgaactcttgtcttccaagtgatctgcctgcctgggcctcccaaagtgctgggataaatttgagccattgtgctcgtctaagctgggattctttgaatgagttcttagaggcttcctgaaactttgtgcaacattttgtgtatgtgtatattttctggggaaaggatttgtaactttctattttttgagagggagtctctgtggctcagggtggagtgcagtggtgtgatctcggctcactgtaacttctgcctcctggttcaagtgattctcctgcctcaggctcccaagtacctggaattacaggcatgtgctaccacacctggctaattttgtatttttagtagagacagggtttcattatgttggccaggctgggaatttgtaactttcatcagatatcccaagggatatatgtctttcctggtagagagggaagaaacaaaaaacgtgtgtaaataccctcctctcccccagaaggtaagaagtactgctctgcacattccttgggtgatctttctcactccctgggataattaaggaagttagggattggggttgagggtaacttggcatccttccccaacctccctgtataggcacagtctaatatacttgatgacagtttgcaacaagtcaacaatttcctacttttctggtgttaggtttaagttatatagacctatggtgatcataacattatctaaatcagatgcttcacattataggtcttgcagctgatgtccagtttaggtgtttgaagtggcttagcctggaaaatgttacaggggaaaatctgctttccatgtgttatgctcagagctgtgttcttttcttttacacaatatgtttgacatttgttgaattttaggtgtaccctggtcattaggaactccctaaaggatctctgtgaggttttaaaaaaacaaaacaaaacaaaaaaacagtggcattttgcagaactcagtatagctctttaccatactgactgcaaggagaaagtaaaaagtgagactaattttgcaattagtctcccaagtttctttacaagaaaatagaccaaaggtactatgtttaaaagcaaaatcatggcttaaaagtttttctttttcttaatatattaatatattgctataaattgagtattgctctcttgctatcttgtgtttttttggtttttgattaactctaagcttaatgttattcctgacaaataaataaataaataaataaataaataaataaagtgaattcagagagacagtagagggcagcagccgtttagaaagtagattcacattgagtgattacggctcttttaaatctttctccactaagagatagctaatttccgaaaaggtatacttggcctcccatattccttatgtctcttaaaactaaaaaagctgggacaaaacttaaaataacagtattctacggttagggcaaatttctgatactgcttaaaacaatttaccgaggtatctttatttttttttgagacagggtttcactctgtcacccaggctggagtgctggagccttgacctcctgggctcagctcaagtgttcctctcacctcagtctgccaagtagctgggactacaggcatgcaccatcattcccaactaattttttaaaattttttgtagagatgggggtttcatcatgttgccaggctggtctcgaactcttgggctcaagcaatctgcccacctcgtcctcccgaagtacagggttataggcatgagccaccactcccagcctcagatttttttattgatgaattttattataacagctacaatactgagatgcataacccttccctttcctgatacccagttatcatctgtttctgtttaatacactccttaagtacctcacatttgctattcccctgccccccatggtctatgcatcttcttcattgaagtggtagtagtctttgttagctcatctggtcatgtcatcaattcagagcacattacctctttagttcagaacacattaattgcttcccataatcttcaggacacggccccatttcttcacgtggcttggccattgcttccctgttcagcttcccccacactccctcacctacaccttctgtctcagtatagtactgctagtctccagacatgccatgcctttttatgcttctatgcgtgttttcctgtctttaatgtccttgtccatgtgatgaacccctactcatttttccaagattgaactcaaatgtcaccttttctgtgagcttctctgctcttctcatgcagagtagaagtgtttatctccattgcccttgaccctaaataacagtacattagtataataatcacattttttacctgtttgtgtgctttccttctaaatggagaataagaatataaaagtgatttatttggcatttctgcaaagggagatgataaaaagaatctgcgttacttagcctttttaaaaaacccttagcctatgaaggctactatttaaggtttggttggattttgtatgttggaaatatgttctttaaatctcatcttcatcagtttataaaagcaatataagttctttgtagatcattatcatgccatccagatgtagtcattattgttttgatataggttgtttcagtctttaaaccaaattatacactgttccgctgtaactcttgttttgaaaacagatttgttccaatgtgggtggtatattagggaacaatttgagcataatgtaaattttgagtttgcttatgcacaaatccctaggcaacactaggtgaatgcagaaaaatgcatgcagctgaactcagcagtgtagatatatacaaaagatacacatacacacgctcttcaaatacctaccttattttcctgtatgtgttatgaaccatacccattcacatctggtattacaactttgccacccatttcagacagtattcctttgaccattctgcagtaactcagaagctgcagccctttagaagtctactccactgtggctcacgtctgtaatcccagcactttgggaggccgaggtgggtggatcatgaggtcaggagatcaagaccatcctggctaacacggtgaaaccccgtctctactaaaaaaaaatagaaaaacctagccgggcgtggtggtgggcatttgtggtcccagctactcgggaggccgaggcaggagaatggcgtgaaccggggaggcagagcttgcagtgagccaagattgcgccactgcactccagcctgggcgacagagcgagagtccgtctcaaaaaaaaaaaaaaagaaaaaaagaaggccactccacaagcaaaccgcagatgttttgcaaggtgacttatttattgtaatagttgtgtatttcttaaccatttcacatgtataaaactgtgctactacttttatgaggttcctgtctttattttttttaacatgtcgctggtgaaggttctgagagttgtggcttgaactccagttttctcataagcacggttttttgttgtttttttttgaaatggtctcgctgtgttccccaggctggagtgcagtggtgtggtctcggctttctgcagccttggcctcccagcttaagctatcctcccacctcaagctatcctcccacctcagcctcccaaatagctgggactgcaggcgtgagcctttgcccacctaatttttatacttttgtagagacagtttttccatgttgccaggctgctttggaactccttagctcaagcaatcagcccgccttcacctcccaaagtgctgggattacaggtgtgtcctaccacacccagacggctctggtatttactgcatagtgttctgatttttaggaatacatacgttgcattatatagcagaactggctgtattcaaaagtctaatagaaaatattgatagggtgataatgtatatagtactaattgtcagttgccataatttaactaatattgttttactttttactttttttttttttgagatggggccttgctatattacctaggctggtcttgaactcctgagctcaaggaatcctcttgcctcaacctcctgaggatgtttgacattttttgacttttttttttttttttttgagacggagtcttgctctgtctcccaggctggagtgcagtggcatgatctcggctcactgcagcctccacctcccgggttcaagggttcaagcacttctgcctcagcctcctgagtagctaggattacaggtgtgcaccaccaccacggctgatttttgtatttttaatagagatggggtttcaccatgttggtcaggctggtcttgaactcctgacctcgtgatcctcctgtgtcagcctcccaaagtgctgtgggtacaggcgtgagcctccatgccggccggctttttggcaatttaaatagttacagttacctattataattgatatttagctaacatctatttttattttaatattccaggaaattattatgcagaaactttaaaggtctgtgtacttctctggtgttttgattttttttttttctttttctgtgagtaattttctaaaactggtttctaggccaggctatttatgtcttgctttttattttttttggcgatggagtctcgctttgttgcccaggctggagtgcagtggcgctatctcatcttgctgcaacctctgcctcctgggttcaagcagttatcctgcctcagcctcccgagtagctgggactacaggcacatgccaccacgcctggctagttttttgtatttttagtagaggtggagtttcaccgtgttgcccaggctggtctggaacttctgagctcaggcagtctgcctgccttggcctcccaaagtgctaggattacaggtgtaagccactgctcccagccttattattttatttttatggattcggggtatatgtgcaggtttgtcccatggatatattgtgtaatggtgagttttggacttctgttgtgcccatgaacattgtacccaataggtggtaatttttcaattctcatccctctctctgcctctgcccttttggagttcccagtatctgttaattctctctgtatgtccatgtgtacccattgtttagctcctctattttttattttattttattttatttttgagacaagagtcttgctgtatcacccaggctggagtgcagtggtgcaatctcagttcactgcaaccttggtctctgggttcagatgattctcgtgccttagcctcccgagtagctggaattacaggtccgtgccacgatgcccggctaatttttgtattttcagtagaggtggagtttcgccatgttggccaggctggcctcaaactcttggcctgaagcaatccgcctgccttggcctcccaaagtgctgggattacggtgtgagccactgctcctgaccccatattttttcttttaattataaaggtaataatgtaaaaagaagtcaactcccagtttaactctagcagagtaaccagtgttaatttttttttttttttttttgagacggagtcttgctctatttcccaggctggagtgcagtgatgccatcttggctcactgcaacttctgcctcctgggttcaagccattctcgtgcctcagcttcctgagtagctgagattataggcgcccagtgccacgcctggctaatttgtgtatttttagtagagatggggtttcaccatgttggctaggctggtgttgaactcctgacctcgtgatccacccgcctcgatgctgggattacaggcgtgagccactgagcctggccaatccattcctttttatggctgagtagtattccattgtgtgtgtgtgtatatatacatatatatacacacatatacatatatatacacgtatatatgtatgtatgcgtatatatgtatgtgtgtgtgtatatatacacatatacatatatatacacctatatatgtggtatgtgtatatatatgtggtatgtatatatatgtggtatatatatgtggtatgtgtatatatatatgtggtatgtgtatatatatatgtatatatgtgtgtatatatgtggtatgtatatatatatgtatatatgtggtatgtatatatgtatatatgtgtgtctgcatatatgtatatgtgtgtatatatacacgtatatgtgtatatatatacgtatatatgtgtatatatacatatatacgtatatatatacacacacacatatatatacacatatgcaggcacacatatatatacatatatatatatacataccacagtttctttatccacttgttgattcatgggcatttgggttggttccacgtttttgcaattgtgaattgtgctgctataaacatccgtgtgcaagtatcttttttgtataatgatatcttttcccctgggtagatacccagtagtgggattgctggatcaactggtagttctacttttaaggaatctccacactgttttccttagtggttatactggtttacattcccaccagaagtgtagaagtgttccctgttcactgcatccacaccaacatctatttttgattttttgattatggccattcttgcaggagtaaggtggtatcgcattgtggttttgatttacatttccctgatcattagtgatgttgagcatttttttatgtttgtttgccatttgtatatcttcttgagaattgtctattcatgtccttagcccattttttgataggattgtttgttttttttcttgctagtttgtttgagcttgttgtagattctggttattagtcctttgtcagatttatagattgtgaagatttttttcccactctgtgggttgtctgtttttgtctgtttccttctgctgactgttccttttgccatgcaaaagctctttttttttgagacagaatctcgctctgtcggccaggctggtaacaaagacacaggtactggtaataactgccatggcttattgcctacattaatgatgaaagcaaatgctaaatttcagctagaggctagagaaaataagcctggaattttcttttatgtttatatactgctatgaataccaggagtccttgggttaagactgtagggctttctaaagcctgtgatcactagtggagaatgtagctttacaaagtctagttggaaattggcaactgggggttagtacaagttacaaggaagggatggaatttaagatgctagtgaaagcttggaggataagggagcaggtgaactcataaggaagtttatgaactgagaagggctgcagcaaagtgggctcatgtgcttgaggagccagaggacatgttgagggtgacataggttctgaagttcgtacagatacttatgcagtatggattcttggaaaaccttctttagtcatgtgatagaaaaataacagcttatggaaaaaacagggttgaggcagacctgaaaatacatgaaattttaaaaaccgcttctaacagaagcataacagactgtaataaaaactgtggccttcctggcatttgcacccaaacaacagcattagccaactctttgaagccttagatctgtggctcttgttttctcctttgaggtgtaggtccttgagggcatttgcttctaatagaggctagtttcatcagaattaaaaatctgaaccatggtatgaaattcaattcttttttttttttcttttttgaaaacactggcaaatgttttgtatccttgagctttcccacatatcttaacatagtgagtggaaagtacagtggctgttaagccaactactctgaggtcttcactgctaaggcttactcttaattgtgtgagagcttaaccttgatccctttaaaacattaatgggctagaaaaaaaaccattcataaaccagtgccacctctgaattttgctaccacaattcccttatttaccaatagtgcatgagctaatttggaataaagaactaggcattgtagcacaacagacattatgtgggcaaagtgttgtttatattctgtctaaatagtgcttcacatgtatgtactattttctaaatatgtatagatgcttttgtgattaataataaaacatgaattcttaaaacaattttgctgacttcatagtagcttttcaccgttttttcagtagctgctaaaatttctggagaagtttgggaactattgttttggagtgaaatgcagtgtgttagatatcacttgcagaattcttctaagggtatttattggcgattagaaaaaaaatccttgtgttataccagtagtaatacaaagtaattgttcagcttctgttaagtgtaaaggactatacaagtattgtgtatagttatctcatttattattttctgggtagctattgttattattacttcgtacaaaaagggaaaaggaggctcaaagtatcatgctccagataacagagccagtaggtagcagagctgggattgctacccaggtctctagtcctgctttttcacactatatactcattgcttcacttactccttcatacatgattccccagcatgtactcttttttttttttttttttttttgtttgagatagaatctcgctctctgttgcccaggctggcaggcagtagtgtgatcttgggctaactgcaacctccatctcctgcattcaagcagttctcctgcttcaacctcctgagtagctgagattataagcctatgctaccacgcctggctaatttttgtatttttagcagagatgaggtttcgccttgttggccaggctggtctcaaactcctgaactcaagtgatctgcccacctcagcctccgaaagtgctgggattataggcatgagccatcatgtccggcctccccatcatgtacccttaaataccatcaagcacagttccattgtgtaaaaacttggcttgatttaacctgttaattggaacactgtcattaatggaaattaggaatatgaggtaagctagaggttttattttaatgactttgggttattaaatctataagaaatgaaattcatttagtcataattaatgtcatgtttctgcatctatattacttgttgggtttacagacgaggtagtgtattattagtgggaagctttgagtgctacatcatctccctttctataaaataaattgagtacgaaacaatttgaattaaaacacctgagtaaatagtaactttggagacctgctgtactatttgtaccttttggatcaaatgatgcttgtttatctcagtcaaaattttatgatttgtattctgtaaaatgagatctttttatttgtttgttttactactttcttttaggaaaacaccagaaattattgttggcagtttttgtgactcctcttactgatcttcgttctgacttctccaagtttcaggaaatgatagaaacaactttagatatggatcaggtatgcaatatactttttaatttaagcagtagttatttttaaaaagcaaaggccactttaagaaagtttgtagatttttctttttagtatctaattgtagcacctttgtggacagtggatgtaatattaagtgacagatgggaaaaggatttttaaaaaaatagcaactgtttcagtggatgaaataaagattattagcagagaaaatgaatattgggcataactgtcctggtgaaagacaatctcataaatgaacaatttcataatttcgtaaatgcaactgcattttattttcaaagagaaggaaaattatagtcactggaaacggaaagagaagttagaggtaaacataggacacacaagaaaactttcattttgtttattttcttgtttttcttttgagacagggtttccctctgttacccaggcttaagtgcagtgacactatcatagttcactaacccctcaaattcctgggttcaagtaatcctcctgccttagccttagtaggtgtaaatacaggtgtgtaccaccatgcctggcgaattttaaaaaaacttttttatagagatgagctctcgccgtgttgcccaagctggtcctaaaacgctggcctcaagctatcctccggcctcagtcttagcctcccaaaatgctggggtttcagtagaagccaccatgccgggccacttctgtttcttttccatgtagagttctttgcaggaggaggttagaataggtgtgcatctcctaaatagttgtcgaatataactaaaaagttaaccaggactctaaatactatttacttctaaaatttgttaattgggaacatttagggtttaactgatctatatcttatgtctttaacaattttgaatgataattatatgtaaagtaagaacagtttgtgaaatagttgaaaatatccttacatgaaagtgaattttaaagcacagtttatgtaatgttaatgttttgttttgtatctgttaaaaatttgtttatatgaacaagtttacaggtttactgtggtgagcccgttgaatatagtgggttttttttgtttgttttgtttttgtttttgagatgaagtctcactcttgtcccgaggctgatgtgcaatggcgcgatcttggctcactgcaacctctgcctcctgggttcaagcgattctcctgccttagcctcccgagtagctgggattataggcacctgtcaccaaacccggctaagttttgtatttttggtagagatgggatctcagcatgttggccaggctggactcaggtgatccgtctgcctcggcctcccaagtgctgggattacaggtgtgagccaccatgccgagcctgaatatagtgtttttaagttgcaggactttaaaaataatattttgaaatttttctaagttaaattccctgttaaaatggtcatgcaggaatatacgcttgcattattcatattagggtaactgtttggtttgctagttgttagattctttgcattcctttttttttttttttttttttttttttttgagacggagtttcactctttttgacaaggctggagtgcaatggcgctatctcggctcacctcaacctccgcctcctgggttcaagcgattctcctgcctcagcctcccaagtagctggaattacaggaatacgccaccaagcccggctaattttgtatttttagtagagatggggtttctccatgttggtcaggctggtctcaaactcccagtctcaggtgatcagcccacctcggcctcccaaagtgctgggattacaggagtaatcccccacccttttaaaaaaatgagacagagttttattctgtcacccagggtggagtgcagtggtgcgatcatggttcaccgcagccttgaatctgggctcaagtgatcctcccacttcagcctcccaagtagttggaaccatagatgtgcatcaccacacctggctgatttttaaattatttgtagagatgaggtcttgcttgttgtctaggctggtcttaaacttctgggcttcagcagtcctcctgcctcagcctcccagagtgctgagatgatagacatgggccactgcccctggccgcatttttcttttcttttcctttctttttttttttttttttttgaaacggagttttgccattgtcgcccaggctggagtgcagtggcacgatctctgctcactgcaacctctgcctcccgagttcaagccattcttctgcctcagccttccagttatctgggattacagtcatgtgccaccacgcccagctaatttttgtatttttagtagaaacagggtttctctatgttggtcaggcttgtcccaaactcctgacctcagatgatccacctgcgtctgcctcccaaagtgctgggattataggcgtgagccaccatgcccggccctaactgcatttttcttagtatttgtggtttgagttaatacttgccctatgtgatgttgatttattattactggatcattaagtgaggtttaaagaagctaaatgccatttgctctatgccctctggattttaaaagtgcatgggtgtgcacgtgtgtaggtataaatgtttccatattctagtatattctgtgtcagtgatagagcagtcttagagctgtcttttccatttacttgtaggttaagaagccaaaaaaagttgtgtcatcatcccgtttaggaaaacttacattttggctattgtttcctctagtgctgctattagtggaatgattttaggtgttcaactttcagatcaatgggagacagaaatattgttctgagacatctggaagccgaatgtgttttattcctgcctgtctgaggatgtggtcttgcctttgatagggcaaagttatttgtaaacattgctttaaataaaaacatgtaaaggtgtttttgatggttaacaaaaactatgagtataatagagcctagtccctattacggactggtattgatctggtgtgggaagagtattgagcttttcagtgtcacctacctgtattcccttgaagggacccagagcccaggcaaagctctgctgaggtcgggcgtggtggttcacgcctgtaatcctagcattttaggagaccaaggcgggtggatcacctgaggtcaggagttcaagaccagcctagccaacatggtgaaaccctgtctctactaaaaatacaaaaattagctgggtgtggtggtgcatgcctgtaatcccagctatctgggaggctgaggcaagagaattgcttgaacccaggagacggaggttgcaatgagccgagatcatgccactgcactctaggtgggtccctgagtgagactccatctcaaaaaaaaaaacaaacaaaaaaaaaaaaaaaaaaaaacctctgctgaaatgctacagttaattttgccatttgtggtcagcattcttcttctaaattgctataatcttgccttcatattatgtgtctcaaatttaagcaggtatcagaatgtccacgggaacaaattgccatggctctaagcccagaatcagattcttcagatctggagtagggctggggaatttgcatttctaacacacaagtttgttgatgctgtttgtctggggtccacgcttgcctaacttctgatgtgatttatttctgccagtttctttttttgttgttgttttatttttttgagatggagtctcgctctgtcactcaggctagggtgcagtggcatgatcttggctcactgcaacccctgcctcctgggttcaagcgattctcctgcctcagcctcctgagtagctggggttataggcacactgcaccacacccagctaatttttgtatttttcgtagagacagggtttcaccatgttggccaggctggtcttgaactcctgacctcaggtgatccattggcctcggcctcccaaagtgctcggattacaggtgtgagccacccaccatgcctggcccttcctaccaatttctatcctccctgaaatgctgcacacttaggcagtcactggacaatatctgccccaaaattggtttgtataattgagaatatttaagaggttgttaaaatttgaaccactttctattcttctattaagtgtacacatctattaaagatccccttgtagctctttttatctgggccatcacatttctgcccagcagatgcagaggccctgtcctctcttccacctccccactacctctccttccctacttttggactgtaaaagctgtctttctgcagttaattgttttattctttgtaggttctactcgttgataatgttatctactgctataataattacagacggcaacaggatgatcaaatcttggatattttaaatttacattatgccttttttattttatttttttaaagtctctgcttgacagcaaataagcctaacgttccctaacaaatgatgatgtcccattaatgatttgatgacttcctgtttgtagtttttatttagagtgcttgtgggtagtttttcataacgacatttaaaaatcaggatataaataattttttaagttttttttttaggcggggcacagtggctcacacctgtaattccagcattttgggaggctgaggtgggcagatcttgtgaggtcaggagttcaacaccagcctggccaacagggcgacaccccatttctactaaaaatacaaaaattaggccgggtgcggtggctcacacctgtaatcccagcactttgggaggccgaggcaggcagatcacaaggtcaggagatcgagaccatcctggctaacacggtgaaaccccatctctactaaaaatgcaaaaaattagccgggcatggtggcaggcgcctatagtcccagctactcggaaggctgaggcaggagaatggcttgaacccaggaggtggagcttgcagtgagccgagatggcgctgctgcactccaacctgggcgagagtgcgagactctgtctcaaaaaaataaacaaataaaaaataaaaaaattaaccaggcatggtggcgcatacctgtagtcccagctacttgggaggctgggacagtagaatcgcttgaactcgggaggtggaggttgcagtgagctgagatcacccactgaactccagcctgggcaacagagcaagactctgtctccaaaaaaaaaaaatgtatttttctttgaagcttttctacttttaaatgtaatgtatagtattataacaagtgaacaaaatgatacaaagaagtatggcgggaaaggtgtggtagagatgggaaaacatatttcctccagcctcttaggttcattggaggagcttgggaattcaactgacacacgacagatttacaggagaaaagttttatttcaagtacacatgagagcttcatagaaaagaagtgaagacctaaagaaacagactggagagttcatatgccattttaataaaggataatgtattagtctgttctcatgctgctaataaatacatacccaagactgggtaatttataaagaaaaagaggtttaatcgactcacaattgcacatggctggggaggccttacaatcatggcagaaggtaaaggaggagcaaaggcacatattacatggtgtcaggcaagagagtgtgtgcaggggaactgccctttataaaaccatcagatctcgagagacttattcaccatcacaagaacggcatgggaaaaacctgcccccgtgattcaattacctcccaccgggtccctcccatgacacatggggattatgggagctacaactcaagatgagatttgggtggggacacagccaagacatatcagataataaattgtggagaggcagtaagattgaagaaaagaggtttgagcttcgaggggtggtaaattgtgggaaggtaattatttggggcaaactaatggcacataaggattgttttagtaaggcttgttatgcatacccaaaacaagtgccatctccagtaatttaagagtctatggtgatcaagagtagttctcttcctgctagaagaggggtgggagagaacaccttcacaaagggaaatttatattctgccttcatgcagaaagggggcgagcagagagttcctacgtatactgtttcttcattatcttcctctcaaaagaatacttaggctaaagtggcatgatttggggtgacattctgatcctcttcagtgacaatccttgatatttttccttctttctctccaggtaaacagtgttaacatcctggtatgcttcccccaattccattatactaactctgtattgtgggttaaagattttttactttgatcagcagtatttgaaacatacctgttatactagatgtactctgactgtaaaatagtggtcagtgttacttctttaatgatgctgtgggattaaaggattttattataaatgctgggaagagcctggatttgaggaaggtaagcagtgcagttaggtggatgtagactagaagaggtcatttgttctcatttcattgttgcccctatgacatgcccgtttctttcttttttttctttttttttttgagacggcgtcttgctctgtcgcccaggctggagtgcagtggcgcaatctcacctcactgcaagctctgccccccgggttcatgccattcttctgcgtcagcctcccgagtagctggaactacaggcgcctgccaccatgcccagctaattttttgtattttcagtagacacggggtttcaccatgttggccagggtggtctcaatctcctcacctcatgatctgcccgcctcggcctcccaaagtgctgggattacaggcgtaagccactgcacccagcctacgtgcccatttcttaaagtagaaaatttagtagttgatgatgtcagggaagaaaagctttttctctgccttacgttaagtagttgggggcaaattaaattaataaaagacagattagtgagagaaaaggctgtaagaatttggactttatataccatcataatagaggaagtaaagggagatgaagggcacttaagggaaaacagatgacttgtaggaaagataaatgaacccttaagagaatagatgagaaatatgaaggttttgtgacaatgtctgtttaggtggttacttctcttcttgttatgagagtcagtcttctggttgctggaaactgctaggagatttataacaattgggctctttcgagaggctcttcttttaagcagataagggagttcacaaaaaagcctgttctcaaatgatttcagcacacacacacacacacttacgacacagttaagtactgtgccagtaagatgtgagttgtgcatttcttttttttctctgagtagactgtttgaggttatttatatcaggacttgttatgcaggtaactgaaaactcaacataatctaggttatgtagttaaaagtatggagagaaggtaggctttatttagagttgcttgatcctgtagatctcttctaccttttgtaattttaatttcaaccaaggatggttccctttttggccctaggaccagttagcagttggggcaccattccaagcaagagtcctgcagtttgtagtgatgggaccatttaaacagtgattgtgaccagggacatagaatgggatgattggcccgaggtaaccatggttgggtatggagtcagcttccctgtaggaagagatagacaaagtctgagcactcctgggaagggggaggaagggaataactgttgtgtaaatcatcagcagtgtctactaagataccatctgtaaccataggcttctatgttttataatataaggctgtcttttaaataaatcagattccctgttaaagatctgttctagattccctagggggttgacctcatatagtatcttctttttctttggttacaaacttttaaacttgtctgaggttataaggtgaattcaactgtccactgtcaatgtagatatttttaatggatttagggatttaaattacatgattcagaaccactttgaggaagtctagggaatatcagttgtttctgtataatttctgaaagcttcactgttttctaggtgtgcacttaattcatgtgatgaagggaacagtatttacatgagtggtttggttaatttttcccctcctaagcttagctttgtgtatcgtgcgtgcttccagtgtttttgtggctgctttacataagtcttttagaagtattttctatttttgaagtaaatgtggatcaaaaccaccccaagacaggattgaaaaaaagacagtttttcgcaagaaagtaaataattttatttagcttgggactttaaatgatatgtcttaaatgtaaacatttctatactgcattttggccatcttttgatactagttttcagatgcatattgttatttcatttattattggaaaagtagtaactttaaacaaatttttattgaaaatgctgacagaggccgagtgtagtagctcacacctgtaatgtcagcactttgggaggccgaggcgggcggatcacgagctcaggagatcaagaccatcctggctaacacggtgaaaccccgtctgtactaaaaatacaaaaaaattagccgggcatggtggcaggtccctgtagtcccagctactcaggaggctgaggcaggagcatggcatgaatctgggaggcggagcttgcagtgagccaagatcgcgctactgcactccagcctgggcaacagagcaagactccatctcaaaaaaaaaaaaaaaaagaaagaaaatgctgaccaaaaaaaatgaaatagttttaaagaagccacagttgtgtgatcctgatacaactatatcattattgtatgagtatatatgagttataaaaatagtatatgtaaatgcttcataatttttattattagaaatgaaaaagtataacaaggggggtattcatattctctccacttagaattaaccctcaacatgttgacatctttgtttatagtaatccttttttgttttttttgttttttattatactttaagttctagggtacatgtgtacaatgtgcaggtttgttacatatgtatacatgtgacatgttggtgtgttgcacccattaactcgtcatttacattaggtatatctcctgatgctatccctcccccctccctccacccctcaacaggtgtgtgatgttccccttcctgtgtccaagtgtcctcattgttcaattcccacctatgactgagaacatgcggtgtttggttttttgtccttgcgatagtttgctgagaatgatagtttccagcttcatccatttccctacaaaggacatgaactcatcattttttatggctgcatagtattccatggtgtatatgtgccacattttcttaatctagtctgtcattgttggacatttgggttgattccaagtctttgatgttgtgaatagtgccgcaataaacacacgtgtgcgtgagcctttatagcagcatgatttataatcctttgggtatatacccagtaatgggatggctgggtccaatggtatttctacttctagatccctgaggaatcgccacagtcttccacaatggttgaactagtttacagtcccaccaacagtgtaaaagtgttcctatttctccacatcgtctccagcacctgtcgtttcctgactttttaatgatcgccattctaactggtgtgagatggtatctcattgtggttttgatttgcatttctctgatggccagtgatgatgagctatagaaatcctttttagaaacaacagagccttgttgtaaaacaggtaaatgtacgtgaggacttcaaaaagtttgtggaaaaatggaattaaaagataaaatttaaaaacacattttaaatttatttcccaacataagctcctcaagttcaagacacttttataaatgatgatctcagctgtttagttcatccgtaaagaactgagggtactagaaattttaccatgtcaatgcagtctctttacattactaactaaagaaaaataggtgctctttaaagatcttttaagattaggaacaaaaagaagtcagaagaagccaaatcaaggtggatgcttaacgactttccatagaaacttacaaaattggccttgtttgatgagaagagcgtgcaggaacgttgtcatggtggaaaaggactttgatgatgctttccctggcatttttctgcaaaaacttgggataactttctcaaaacactctaataataagcagagcttatgttctttatccccccagaacatcagcaagcaaaatgcctgaacatcccaaaaaactgttgccatgacctttgcccttgactggtccacttttgcttcgactggaccacttccatttttggtagccattgctttgattgtgctttgtcttcaggatggcattggtaaagccatgttttggctcctgttacagttctttgaagaaatgcttcaggatcttgatcccttgtttaaatttctatggaaagctctgctcctgtctgcagttaatctgggtgcaacagttttgtcacccatcaagtgaaaagtttgttcagctttaatttttcagtcagaattgtgtaaactggaccaattgttgagatgcctgtagtgttggctattgtttctgctgttagtcattagttctcttcaattagggaatgaacaaaattaatttttcctgaaaaattgatgtggatggtctgccgctgtgggcttcatcttcgacatggtctcatcccttgttagaacaagttatccgtttgtaaactgctgatttcctaggagcattgaccccataaaattttcataaagcatcagttatttcattattcttctatgcagacttcactataaatttgctgtttggtcttacttcaattttagcagaactcatactgctctgacatctaaactgatgtcttagccttcatagtgtctctgactagatcctattcagacgtgttatagcaaattagtaaagtttattttggtgccaaaaacttttgaatccacgcatagttttttcacaacacattttccatgaactttttgaagacccttcatatattataagaagaaagttaaaaatatcccctgcatctactactcagaaataaccactgttaacattaagtctgttctcaactctaggcattattgagggttttgaggacaggtcttgaaaatttctatggctaccttttactgggtggagactagcatgtatagttgaccgcataggttaatccctccactcaaaaagccacaattttaaagtgtagtattcactagcatttagtatattcacagtgttgtgaaatgaccaccaccatctagtttgaaaatatttcatcacaaccaaaagaaaacctcatatctattagcggtctctcctgtttccccagacaccggcaaccactaatgtactttttgtctctgtggacttgtcagttctggacattttatataaatggaatcatgtgaccttttatgattgacctctttcacttagtataatgttttagaggctcatccacattgtagcatgtgtcagtacttcatttccttgtgtattggtccattcttgtactgctataaagaaatagctgagactgagtaatttataaagaaaagaggtttaattggctcatggttctgcaggccgtacaggaagcatgatgatggcacctgctcagcttctggggaggcctcaggaaatttaaaatcatggcagaaggggaagtgcggcgtcttacatggtggagcaggagcaagagagagaagggggaggtgctccacacttttaaacaactagatctcaggacaagtcagtcactataatgagaacagcacccaggggaaaccgccctcacgatccagtcacctctcaccaggctccacctccagcactggggattccagttccaattcaacatgatacttgggtgggggcacatatccagaccatatctcctcgtatagctgaatagtattcccttatatggacataccacatttattattaatttattgattgattgacaggatcctgctctgttgtccaggctggagtgcagtggtttgagcatagctcactgcaggccttgaattcctgggctccagtgatcctcccacctcagcctcctgcgtacctgagattataggtgtgtgccaccacacctggctaattttttttattttttagcagagacagggtttttgctatgtttcccaggctggctttgaactcctgggctcaagcaatcctcctgccttggcttcccaaagttgtaggattacaagtgtgagtttagagaggtataatttcttactcaacttcaagtattttatttctcttatcatttgttgtttggtttgttaattatttggaagtatatttttaaatttccaagcttagtgtgtgtcagtttcataaaagttccccatgtatttaaaaattggatgtgtactctaattttgggattgctttttcattgtctatatatgcttgctaatttttgatctgctgggttactgagaaggatgtgggtttctccatctagttctatttttggttaatatgttaggcacagagctgttgtttttttgtggtgaattgaatcttcatcattctttagggactctgtccttaataatgctttttttgccttacattttgtttcattgtaagagagctatgtcagagtactttttaaaacactttttaatatggtatatatttttttcttttttaatgaggttttttaaccgtaagtttaagcaaaataaagcttaataactggattttatttagttttaaatttaatttgatttttttttttttgagactaagtctcactctgtcgcccaggctggggtgcagtggtgcgatctcagctcactgcagcctccgcctcccgggtttaagtgattctcctgccttagcctccctaggagctgggattacaggcgtgcgccaccacgcctggctaatttttgtatttttagtagaggcgggctttcaccatgttggccagtctggtctcgaactcctgacctcaggtgatccacctgcctcagcctcccaaagtgctgggattacaggcatgagccaacactcctggctaatttaattcgatttttttagtagcagttttagtctattatgtttgttgtagttactagtatctttggatttatttctacctaattatttggtgattcctcttcttcctggttccacttacacattaaaaaaaaaaacaaaaaaaacttagaatagagatggtgtctcactatgttgttcaggctgctctcaaactccagggctcaagttatcctcctgccttggcctcccaaagtgctgggattacaggtatgagccaccatacctggtcccccttgcccattctgttttacttttgtattgcttgggtttctaaaattccattttgtcctctccctttgctcttccccaatcctatctcatcacacacactggtttggaagatagccacttttttttttccaatgtgtttacttatcttatcagagtcaaaagcctatcagtatcttctcagatatcccaaaaaatactaggaccttaagacacctaaaatcaggttacatttcttcataattgtctagtattctagttctatcagttttacctctcagatctccattctgtaagtcaatgttaagtttagatttgtccatatgcatacgagtttctttggtattcaatacttcctgtatatttttaagaagttcctttgttggaggtctgttaggttttatttgtttgaaaatgtctgtatttcacccttgttcttgaaggatggtttttctaggtatacagttcttttttttttttctttgatacagttttgctcttgttgcccaggctggagtgcaatggtgcgatcttgactcactgcagcctccacctcccaggttcaagtgattctcctgcttcagcctctcgagtagctgggattacaggtgcccaccatcacacctggctaatttttggtatttttagtagacggggtttcaccatgctggccaggctggtcttgaactcctgacctcaggtgatctacctaccttggcctcccaaagtgctagggttacaggcgtgagccaccgtgcctgacaaaggcctaactttccttcctcattcttttcatcttgtttcttggtttcatcatcccattttttagtttcttttcagtctccttttgtgtagcctgaagcaataactgtgtttctgatgcctaggtaagtatactgtaggtaggctgatactgttcagctagtacatagtagaagtcagatgtcacatttttagaatactccagttctagataagaataccttgttgggtgatatattttattatcctggattgtttggcggatgtaatggattgctgaagacgcccagtttcctgtgtggcccttgagtatttattttagtaagttagaggctagttgttcacttttcccttgtttaactggggactcctcagcagccctttcaaaacagtataacctcatctgagaaaggaaaatgtaaggatattcattaagttttcttctctccagatttgggattatttttaggaattctcaagagttttgttgacttaccaactaggtttcttgaagatggtgagtgaggataggaacttggcctggtttggctcacctctcagattcattggaagaggcaagttcattagcacagtttcagtccaccattacagcatttttttcctgaattattataagtcttagtcaatatttccagataatcatcattatctgtttaaattactgcacagtattctattttactgatgtaccattgtgcaaatactatgatgttttattatttttaagttttgctataacagataagtctgcagagattttattcagctctgtattgttttgcttctgttgcattgtttcctcagattgaatttctaggagtagaattgctatgtcaaagagaataacaagtatctctgagccttgccgcatactgcttttttcatttttaaaggttataccaagttagagtctcactagaactgaatgagtgtactaattttactgtagctagtttctttttttttaaaaaaaaaaaaagctgtagaataatctcaaggttgcttaaatatttctgtcttttattcttacagcatttcctgtggattagttcactacttattttcttatctgtgagttgtaagtgcttacacatgcccacttgatgaccttgatgttttcttacacatggaagcaagtgctttttgtaaaagaatatattaacctttatctttttacattttgtgaagctttttttttaatgtttcatcttttaaaaattaggtttattcagaattttaaattttaatattatattgaatttcttttggttggtttaaattgagaaagttattttatgtatattctctttttttgctagctttctgtaatttgattttaattccttattccttgcatagtttgcttctggtatgttaaagtgtgctctctctaagtgggtagtaattaggaacaatttatctcaacctcatttattgaatgttttaaatcaagagaacggactctgttatattaagcttctatatataattgtctgtttcactgtaatgcctagtaaggatacacttcattctttttttagatgttctttcacaatttcatgtaaattttagttgttttgtttcaaaaaacaattcctattgaacaatctctaggaatagatagcttaataataatattagatctagttttctcttttcatagtttacctcttctttcttttctttcttttttttttttttttgagacggagtctcgctgtgtcgcccaggctggagtgcagtggtgcgatctctgctcacagcaagctccgcctcccaggttcgcgccattctcctgcctcagcctcccaactagctgggactacaggtgccccccaccactcctggctaatttttttttttttttttttttttttttttttgtatttttagtagagacagggtttcattgtgttagccaggatggtctcaatctcctgacctcgtgatccgcccacctcggcctcccaaagtggattacaggcgtgagccaccgcgcccagcctctgtctctcttttctttttctttttcttttcttttcttttcttttcttttcttttcttttcttttcttttcttttctttcctttcctttcctttcctttcctttcctttcctttccttttcttttctttcttttcttttcttctctcttctcttctcttctcttctcttctctgtctttttttgacgagtctcagtatgtcacctaggctggagtacagttgcacaatgttggctcattgcaacctctgcctcccttgttcaagtgattgtcctgcctcagcctgccaaatagctgggactacaggtgcgcactgctacgcccggctaattttgtatttttagtagagatggggtttcaccatgttggccaagccggtctcaaactcctgacctcaagagatccacctgcctcggcctcccaaagtgctgggattacaagtatgagccacgatgccagtccaattcttgtgtagttttttaatcagctgaatttaacattcaaattcttcttttaaatcttccaataggcagttatctttataaagatcctatataatcaagactttgtttctgaatattttatgtatgtttttgctactgtaaatgagatctatttctcattgtggtttcttgctgttattactggtaagaatttagtgaaacaaagtacttaagagtatgtctttaaattgtgagattttgatgaacttttaagaaataaaattctttagtttcttagagctttttgagatttctaaggtagatccttggtttgggcaacatataactattacaagttttgcacattgaacgttatttggtaatttttagagaggacattttaaatgtttaggaaaaatataaataaaatgtagaatactattgggggcatatacatcatcagcactgtaactgtttcatatgaatcatttttgtacatatagaactctaaagtcctaatgaacagaattttacatttctataaatagaaagtccttaatagttgtgactgaataacttatggatagcaaattatttaactgaaaacagtaaaatttaagtgggaggaaatatttgctttataatttctgtctttacccattatttataggattttgtcactttgttctgtttgcaggtggaaaaccatgaattccttgtaaaaccttcatttgatcctaatctcagtgaattaagagaaataatgaatgacttggaaaagaagatgcagtcaacattaataagtgcagccagagatcttggtaagaatgggtcattggaggttggaataattcttttgtctatacactgtatagacaaaatattgatgccagaattattttataagttccctgtccccaagatgatgacttcacatctctgtcaaacagaaatcgcccaacaggcccttgtatgatgtcatttaaacaagccctattttaaatgtcacctccactggtaacaggatactcctaggaggatcaccaagcccaattcttctaggagtagtgcattgattaggctttggggtttccaagcagttcattaatgtcacttttggaaaaagtctgtctttcataccagcttattaattccctatgggttcacacggttttttttcctggattttcatcaaacatgtgtaaggtactcagtacaaagaagtttagaaatccagaacaaagcagtgtatttaagtagtagtaaacttccagataatctgatgcccatatctacatatataaaaaatttgcaaatagttctgtagagagtccaaacatggagtagatccctaattaagagcctttgcattaaagtccaccttcctcatttcatagctaaggatattgaggctcagagagtttatgtgtctggagttaaagttattttgtgtttccttaatttttgacttactagaaagttaaagtacctacagatttctgtgtttcactatatgttaacttgcttggctggaagtttttctgctgataattggttttatgaaggaagaatcctgttaagaatgcatcattggactgggtgtggtggctcacgcctgtagtgatcctagcagtttgagagaccgaggtgggcagattgcttgagtccaggagtttgacactaacctgggcaacatgatgaaaccctgtctctacaacaaatacaaaaattggccatacatggtggcacgcacctgtggtcccagctactcaggaggctgaggtgagaggatcacttgagccagggaggttgaggctataatgagccataattgcactactgcactccagcctgggtgacagggtgagatcctgtctcaaaataagaaaagagaatgcatcattggccaggcacagtgactcatgcctataatcccaatactttaggaggatcacttcagcccaggagttcaagactagcctgtgccacatagaccacatttctaccaaaaatcaaaaggaaaaaacttgctgggtgtggtgatgcacacctgtggtcccagctactcgggaggctgaggtgagaggattgctttagcttaggtggttgaggctgcagtgagccatgatagcaccactgcattccatccagcctgagggacggagtgagagcgacaccttgtctttaaaaaaaaaaacagaggaatgcatcatagtatatattaaattattgcctatttttttatctattttattgagtgctaataagaaaattaatggcaaaaacttgttttttacagtataaattaagtttaatttcattttaaaattaagtaaatttgttttattaaaaagtatgttgaaagcaacataaatagcactcaaattgagacagaaactgtaactgtagtataagaagcattaggctgggaattgggaaacacgagttctagttgcagcttggaaactttttctgaagctctttacaaattacttaatttctctggttttcaccacattgttctatagcattaacatgttggattcattgctttaattcttagacctacgtgtcatcagaaatgccattacactttgaggatttgagccttattttaaataaagttgtgatcctcatggcagcctaggtttacatgtgttaaataaacagtattctgtaaataccattgtctttcatgtttagtgatgttgctgttgttaacactgcagtgaaatgcatatataagcaaactacattacatactcatgaacatggtcctttgttttgaaactttgatcactgattgttcgcagtctttcattgtggaactactctttcactttgaatgttttgagaggttcctttgttcagatcagtccgatttcgtttctgggtgggtctctactttcccttttctcactggtcaagcgaggtctgtctaattgtttgctactactaacatttgatggccacgcttcagcaagtacatttgtagattctctctctctgtctctcttaatttgtggtctagagatcatattggttaatgaaattatgaagagggaatgtatttataaaaactcaaattcttgatgcagaaggtctagctgattgtgaacccaaaatatccgagacaggtcacaaccaatttagaaactttattttgccaaggttaaggatgcatccatgacatagtctcacaaggttctaatgacacatgcgcaaggtggttagggtacagcttggttttatacattttagggagacatgagacatcagtcaacatgtgtaagatgtacattgattctatccagaaaggcaggacaacttgaagcaaggggctttcaggtaataagtagataagagacaaaaggttgcatacttttgagtccttgatcagcctttcactgaataaacaagcttagtcttgttagtgaatctgcgtttttacataaacagtaggtcagaggaagcaatcagaaatgcatttgtgtcaggtgagccgagggatgactttctgtccctcacctgtgaagataagctatcagtttccattgctagggtgaaattcaacagaattgtttgagagtgaacatctggaggcccacaaggactttccttgtggaggggaagtatgtagtgagggaagtatgtagtttttaaatctttgtcgctatcttatttagaaataagatggaaggcaggtttgtctgacatagttcccagcttgacttttccctcggcttagtgattttgcggttccgagatttattttcctttcacatatcagtcagatcatttggtttgtgaagtttcctatgcttaacagaaaatatgtgcactagttttcctagagtttcattgtcagagtctcaagtttttgtttggaaattgtatttggtcacattaattatactctatgttagttccaaagaaatacctttggttaagaaaagaattctcatgcataactcctcgagggtggggttacaccttaatccatcctcaggtgctcatggtaattggggcaaatatgttgcccagtgctggtgctctgcagccttggatgggtttacccagaaagcagctttcaagtcagaaactaacattcataagggagttaaggattttataaatagatatccataattcatgtagttttcaagtaagtagtatttgaatcttttctggttagataataattgtgagtatgttgtcatataataacagtatgtttttcactatttaaataattttagaattacattgaaaaatggtagtaggtatttatggaatactttttcttttcttcttgattatcaaggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacaggtttgcaagtcgttattatatttttaaccctttattaattccctaaatgctctaacatgatgtgaatgttctatgataagttttactaatgtagtcatcaggtaagagtcaagctttcttccatagagcagtcagctgtcgcaacaccatttgttaaatagtccgtctgttctccattgactgaagtggtactttgggtctattttaaagactctacttttacctcgtctcaccattcttttgtctacacaaaatatattttatcgcttattctgtgttaccatatctattagagctagttccccctcatatctctgctttagttattttcacatgtttcttttatcttttttttttttggagatggagtctcgctctgttgcccaggctggagtgcagtggcatgatctcggctcactgcaagctccgccttccgggttcacgccattctcctgcctcagcctcccgagtagctgggactacaggcgcccgccactgcgcccagctaattttttgtatttttagtagagacggggtttcaccgtggtctcgatctcctgacctcgtgatccgcctgcctctgcctcccaaagtactgggattacaggtgtgagccaccgcgcccagccttatcttttttttttttccccctgagacagagtcttgctgtgtcgcccaggctggagtgcagtgacgcgcagtcttgactcactgcagcctccacctcccggattcaagcgattctcatgcttcagcttcctgagtagctaggattataggcatgcaccaccacgcctagttcatttttgtatttttagtagagatgggttttcaccatgttggacaggctggtctcggactcctggcctcaagtgatccacctgcctcagcttcccaaagtgctgagattacaggtgtgagccaccgtgcctgacccacatgtttattttttctaagaaaactttactatcatttatcaagttaagaaaattattctgatatttcaattgggtgtttaaattagttgagggaaatatgaggccattcactagatgataggttttttttgttttaatcatgtttcatgttgaaacaaaaaagttttttcctgccagttttctggctaatctcaggaagtccctgaaacaaattattgataagtaaaaaaaattatttaaaaaattttaaattatatttaaaatcttctgtgacttatggtggggggaggctaaagcctttctccttctgtactgttctggaaactatggcctgttctactccctcccctcctgaattttcccagaactttacaggtagcttttatatatatgatcccctgtcgtctgtttaacaagtactttgagtgtctattatatgcagacattctaggtgttcagacaccctagtaattagtttgttcctcataattctcagtaaagaagacatgtatatttctcattttataggtgaagaagctaagactttacttttcctcagttagacagctagtgctggtgggtgcctaaacttagatcttccattgccaaatctaggtgtgttgtttttccagcacactagaatcctcctggttcaagaaatgtatatattttagcttggataagatacaacttttggagtgttctaatcatcttcaagtttttcgtggattagttataacatatgaaaaaagatagggctgaatgggccacatgatgccaaaagtgaaaaagtcactcactagattatgacctgcagaatctggtccttgcctgcctctgcttttatattttgcagcttgtcccttcacacagtggtctcacttttataatgtctttccctcatgcatttctttaattctttttatttgcctgttccatagtagtctgtttgtgctgctacttgcccctgtactgttcttgagctatacatatacatgtctgctgtgccattgagtgattccatcaaggccacaattatcatcttgatgaactgattttctcccactgctgataattacttctctctcctttctttctcctttacatcacctctttttgttcttaatttcattccctccttgatgccagtgagtatttttttcttattttattctcatcttccttgagtattgtttatttcaacctctttttttttttttttttttggagaagggtttggctttgtcgctcaggctggagtgcagtggcacaattttggcccactgcaacctccacctcctgggctcaagccatcccacctcagccacccaagtagctgggactacaggtgttgcccactgctttgtatttttaatagacacaggatttccccatgttgctcaggctggtctcgaactcctgggctcaagcagtccacctgccttgccctcccaaagttctgggattacaggattacagatgctgtgcccggcccaacctctaattttaattttctcttcaaattgttcaataagatttagtttcaagacattttcctggccgggcatggtggcttacgcctataatttcaacactttgggaggccgaggcaggtggatcacttgaggtcaagagttcaagaccagcctggccagcgtggtgaaaccccatctctactaaaaaatacaaaaattagccgggtgtggtggtacatgcctgtaatcgtagctattgtggaggccgaggcatgagaatcgcttgagcccgggaagcagaggttgcagtgagttgagatgacaccactgaaatccagcccgggcaacagagtcagactacgtctcaaaaaaaacaaaacaagctgggcgccgtggctcacgcctgtaatcccagcactttgggaggccgaggccggtggatcacgaggtcaggagatcgagaccatcctggctaacacggtggtgaaaccctacctctagtaaaaatataaaacattagccgggcgtagtggttggtgcctgtagtcccagctactcaggaggctgaggcaggagaatggtgtgaagccgggaggcagaggttgcagtgagcctagatcgcgccactgcactttagcctgggtgacagaacaagactccgtctcaaaaaaaaaaccatttttcttattttgaaaacttttggtattgaaagatatttatactacagtaatgagaaatactgtgtgtgtgtatatatgtttgtgtttttttttttgtttttttctttctctctctctcttttttttttttttgacagagttttgctcctgttgtccaggctggagtgcagtggtgctatctcgactcaccacaacctctgcctcccgggttcaagtgattctcctccctcagcctcccgaatagctgggattacaggaatgtgccaccacacctaactttgtatttttagtagagacgggttttccccatgttggtcaggctggtcttgaactcctgacctcaggtgatccacctgcctcggcctcccaaagtgctgggattacaggcaccctgcctgtgtttgtgttttaaaaggggtaatagcttcagtcttttttttctttctctgagacggagttttagttttgttgcccaggctggaatgcaatggtgtgttcttggctcaccacaacctccatttcctgggttcaagcgattctcctgcctcagcctcctgagaagctgggattacaagcacgcgccaccatgctgggctaatttttgtatttttagtagagacggggtttctccatgttggtcaggctggtctcgaactcctgacctcaggcaatccaccgacctcaggtgatccacccgcctcagcctcccaaagttctggggttacaggcgtgagccaccacgcccggctgtcttcaatcttaaataaggattccatttaaatattttgtaaaaggacacagatcacagttttactcaggggaatataattgttatagcaggaattgtgccattgcgctattccaaacagtgtaaaagaacattaataaattgaattctaactacatttgtccctaaggagttgttcgttttccacttgtatttccattttaattatcattatttggatgtttcataggatactttggatatgtttcacgtagtacacattgcttctagtacacattttaatatttttaataaaactgttatttcgatttgcagcaaattgacttctttaaatgaagagtataccaaaaataaaacagaatatgaagaagcccaggatgccattgttaaagaaattgtcaatatttcttcaggtaaacttaatagaactaataatgttctgaatgtcacctggcttttggtaacagaagaaaaatcatgatatttgaagtgtgttttgttattttcgcaagccattacattctgactatttaatatgttaggtttcctatataaaataaggcatggtatgttacagtaggacacataactggaagttactcttgcacatagaaacaaaaaatggcagaaaagcacaaaacttactatagttgtaacagggaaaggaaacactagggcctacaacgtactaatgtcttgggtcatctatgggctcatgaggctctaggttatggaagtaaataccactgaaaagcaaatattaattacacatgaggcaagcctttttgagttctgtatgtcattttgtagattttgagttcattctagtggcaccatttgagatcattttcatgtaattaaaggaacacagcaacctggcactgtgttattgcccttagaatggaatgaatatatgtttagcacaaggtaggaagtgatgcgttaagttggaaggctttgccgatcatggtgtgtatgttgactaacctttattgtgcctttaaaaaatatactcaagaactaccttaaccaagtaattaaagtcaagattaccagttgtgggacaaatgacatgtacttcctggtgtgatatagaaggaaggacacagtatcacctatatagtattcttgaccagaatatttaacctgattttaaacaagaagtaaaaattcaaataaatttagattgtggtgcattcaaggcctgaactttaataaatgtccatgtcacggcagcaaaaaagaaatcaacaggtcttaaagagacagggcaaccaaacgcagtaggcagtagttgattagatcccaatttagaggttggagttggggaatagctatagaggacactattggggcgaattgagaaagtttaatatgagacaatatggtgttagtgtcagatttcttgtgtgaaatggtagtgttatgattaggagaatgtccttgttctcaggatatgcatgctaaattatttaaggacaaatatttttttaaaaggttatgtgcatgagtaattctataaattgtgttgctattatgaattgtcatggtaaatcaaaaggaaacataaaactcaaaaggttttattttaatacactttatgtattgaaatgaatggaattgatttgtaaagattacatttttgcttgttggtgtcagataactgtgacgtaataatcttttgctgaattatgtttcttaggctagatttcattttaaagaaccctgtaaataccatttatttgaactgtggatcttccttaaaaaataatatttattaagcacctagcagggtaaagtttttagattttaacatttaaattgaaggttttatattagaagtcaacctgaatttaaatgaaacttcttcttggtctgatattacatattatgagctatttttatttaaaaatgtaatggcggccagacatggtgattcacacctgtaatcccagcactttgggaggctgagctgggaggattgcttaagcccagaagtttgagaccagcctagccaacatagggggaccccaactctacaaaaaaatccaaaaaatattagccggctgtggtggtacatgcctgtagtcccagctactcaggaggctgaggcaggagaatcacttgaacccaggaggtcgagggtgtggtgagccataattatgctactgtacttcagcctgggcgacagagcaagactcccatctcaaaaagtgtaatggatcactttaataattttctatcatacaattaagtcataaaaggtcatgctattaagagccagttatgtgacatgccaagtatagactcttaattaagatgctttggtttgctttttatttatttatttatttttcagatggggtcttaccatgttgcccaggctttagtgcagtgatgcgatcatgactcactgcagcctcaacctcctaggttcaagggattctccccacttagcctcccaagtagcttgggactactacatgtagtagtgccaccacacctggttaatttttttttaattatcttttgtggagatgaagtctcactctgttgcccaggccagactcaagcagtcttcctgccttggcctccgaaagtgttgggattacaggcgtgagccaccctgcccagcctagttttcttttttttactataaacttattcttgtcagtatgctagcaattttacaagttttaaagtagttatagcaagtacttcactcatgtttaattcttaaaggcttctattgctatataatagggtagtctgaattcttcaaaagtgtactgaggccaggtgcagtagctcacacctataatcccagcattttgggaggccgaggcgggtggatcacctgaggtcaggagttcgaaactggcctaaccaacatgttgaaaccctgtctttactaaaagtacaaaaattagctgggtatggtggcaggtgcctgtaatcccagctactcaggaggctgaggcaggagaatcgcttgaacccaggaggcggaggttgcagtgagccaagatcacaccattgcactccagcctgggcgacagagcaagactctgtctccaaaaaaaaaaaaaaaaaaaaaaaaaaaaagtatactgaaacagaggaagataattaggtctgcttggccattgttaagttgatttttattttcaaaacatttgatcactgttgtggggaacaagggaataaaaaataagttaaatttccagcccctagattaaactaataatttttggttttcctagaattaaatgcttttatcttgaatgttctgtgaagcttttgacatgattgatagctgtatgatagtctgaatgacatgtgggtcatgcaccagcccctccaacctgttaacatttagaatctattcagaaaaatttaagcattgttaatttcctttgttttttgtctagcatgtgtcagatttttttaaatgtatttattaatagcttttaatgttaatactctagaacagtagaatcttgaaaatgttttaagtgacaattagagatttaaatttatgctgacatcctctgcatgtgatactgatgaggaaagaaagccaaactgtcttacggtcagttcgtacaatataccaggccttgatggtcacatttcaacttgctacctttttgcttacatttttcttatggtgattttgaggtgtcattctggtttctcagatacttaaaatataggaaaaggtgtgtcttaaaattgagagaatgtcttggataagcagctgtgtagttttatattttgctgataagggaaggtactctatttttgttttttgtgtgtttttgtttgtttgtttttgagacagaattgcccaggctggagtgctgtggcgcaatctcagcttactgcaacttccaccttctgggttcatgcaattctggtgcctcagcctcccaagtatctgggtttacagacatgcaccaccatacctggctaatttttgtatttttggtagagatggggtttcgccgtgttaccaggctggtcttgaattcctggccccatgtgatcccccggcctcatgcgatctgcccgcctcagcctccctaagtgctgggattataggcgtgagccacccaacccagccagtactctgtttttgatagctattcacaatgggaaaggatgtagcaacacattttaaccctatgttgagttttaggtgggttcctttgaaattttgttaaggctaacttttgttaatttttttaaaaaagtgtaaattaggaaatgggttttgaattcccaaatggggggattaaatgtatttttacggcttatatctgtttattattcagtattcctgtgtacattttctgtttttatttttatacaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggtaaaaaacctggtttttgggctttgtgggggtaacgttttgtttttttttttttttttttaatcttggagtagaaatatatttaaaattgatggagaaaattcccagttcttaacattagaaagggaatatattattcttaccagttagtaatctattcacatttggtttagagggaagatttagaaggtgagataaaagcttgtgagagaatagtgtattcatgtgaaacttcttccatgggttcagagcatttagaaacaaacatcccttcacactcaaagcttacctttgagccagtcctccaatagtgaggtctttgaaggtcaggccaaattggctgtgggaggacctcaggttaggataggaattattttaagacatggcactatattcatgtgaaactcgcaaaaactagccttgcatataggctcatgtatcatgtctcagctgagatgtttgagagatcttaactagattctagaaaacaaaaaaggaagtagttttggggcaaatatatttgggaaacagtttattgtatttcctttccccaaatggattttcaagttcttcatataatctaaccccaacaaataaattgcctgtttttcaaaagaaagatcatgtcttcaggtttttgtgtggggtttaaatgattcgaaagatttgaccatactgatacattcactagtaaccttagttactaatgagtaatggttttgagttaatcagttaggcctgaactacttttctggaagttagtaaattatctcacaggcagccctgtgagccatgggaaaatgtgtatatggtctttctaggccacagtcaaattacaggtatatttgtcatggcttctcttgatgaaaggcccagtatcggtttgtctgaagatatataatagcattgcttttgggggtaatatgggcagtaactctgtccacatctttgggcaggctgtggttctgcctttatatgctatgtcagtgtaaacctacgcgattaatcatcagtgtacagtttaggactaacaatccatttattagtagcagaaagaagtttaaaatcttgctttctgatataatttgttttgtaggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtaagtgcatctcctagtcccttgaagatagaaatgtatgtctctgtcctgtgagaaggaaaagtatatttgcagattctcatgtaaaaacatctgagaatgtttgtcttagtttaatagttgttttcctgtggactttatatactttgtattgtcttaaaagagtgattgatggtagctacggaaaactttgatttttaaaattgtctctttaagtagacaatttataagctactggtacgagttcaccttataaatctccactaccatgtttttgcttggactgttcacacttcctggaatggtccttcttgccgtttatccaacttctttctaatttttaagtccctaatgatgggaattctatttctgtagtgatttttctggtcatacgaccgtaaggtcatgggtgtttttctctgaattcctcttgagatgcctgtaacttgaaccacgtttttattctagacattactgaaatgttttgtctttatttcactttttaggagcttccttgaaggtagggactataccttctatttcttggtatctttttctttctttttttaaaagttttttagagagacagggtctcactcttttgcccagactggtctcgaactcctgggctcaggtgatcttcctgccttggcttcccagagtgctgggattacaggcatgaaccaccgtgatcctccttatttcttagtatcttctaaagaacattaaatatagtaggtgcctagtaaattatgtattgatttaacttctttgaggttctgttgtttgtgaagaattataaaagcaatacaaatgtttgtatagtaattaagcaacaggttaatattcatgacttaaaagattaaagaaataagcaaaacatgttagctggcaactcacagaaaaagaattaaattgccaatgagcacacgagcacatgaaaaattagcaaaagtttcacccctttacatatatttggttaaaattgagaaaagaatagtaatagatggtattggtaggactgtggcaggcacacaatttacatgaccaccaaaagtgtatgcaggtatccatgtcaccacaccctggtctcatcttcattcagttttatttattttttttaatctcggcctatttgattggcacgaaatgaatgatagctgccttatttggaattcctttgattactactagtgtgcttgataatgtaaaacaatattcaaaatctgtttttcctttcatccgttgtttgttcatgttcatgacctttttttttttttcctattctcctccctccctccctccctccctcccttccttccttccctccttccctccttccctccctccctcccacacaaaggtgtgtgctaccatacctggctagtttttaatttttttttttttttttttttttagaggcaaggtctcactatgttgctcaggctggtctgggctcaagtgatcctcccacctccgccttccaaagtgctgggattacagacgtgagccatcatgcctggcccttgcccatttttctattgaagttttagtgctttttattgactttgtttatatattaagataatccattatgtttgtggcatatccttcccaatgtattgtcttaattttgtttttgtatgtgtatgttaccacattttatgtgatgggaaatttcatgtaattatgtgcttcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtatgtactattggagtactctaaattcagaacttggtaatgggaaacttactacccttgaaatcatcagtaattgccttattctaagttagtataaattattgatgttgttatagaacccatttaccccttaattcacagtctgggggtaggaacatgtacatcatatttctgtatctcatagtaggaccactcattctaaagcattcacagaaagaattatctgtactctttttgggacagaatctcgttctgttgcccaggctggagtgcgatctcggctcactgcaacctccgcctcccgggttcaagcgattctcctgcctcagcttcccgagtagctgggattacaggcgcctgccaccacacctggctaatttttatatttttagtagagacggggtttcaccatgctggccaggctggtctcgaattcctgacctcaggcaatccacccgtctcggcctcccaaagtgctgggattacaggtgtgagccaccacgcccggccagaattatctgtactcttgaacatcaccatggaggcattttctgctacctcccatggcagtatgttttcttgttgaattaggataacaaacaatatgctttcaagttccaaagttctagctgttattgtttaacaaaatcttcattataattagcttattttgtgtttaagagtgtgttatagaaacaggttcatttaaagctgggggttccagaaatcttgaaatagtagttatcacatgcagagtgacttatctgttgttgtttcatcctttcaggaaagtttgtcattcgtgggcttgggatctagtcagatccctgtattgatgagattcacatgttataaggctttcaaaggttttaaaaatcatactataaggattgatttcactagtcaccagaataactttttcagatagcgctctgattttccacgaacacgtttttctgcatcagttggttgcacatgagtgagataatcttggttctttatcctttgttatttgtacttcattgggaatccttttgagttagtatatttgagtcattattattattgctgtagaattcaggaacttttagtagatctggcagcataaaattttgcttttaaatcattgtttgtgttttgtatgctatagaaatgggttcagaatattttttaaaaggccagatgaagtgtgaagatagaaaaacttcatccttcactgtgaatgtttaacaaacatttgcttctactttatttttgtttgcttcctttagttgtgcaaagtattcagttctagaatgcatgagatatatgacaaagccaaaaaattctttatagttgataaataattgtggcaaaaacagctgtatagtaactttgcaagcatcatttgattaaatgcttaaaaagtcttgactcagttttaactatttcctgcaaataatcaatatttaattaaagctactccaaattagtgacactttacgtgtctgtctttctccctccccttctcccttctcccttcccccttctcccattctcccattctcccttctctcttcttcctttcctcttcccttcccttcccctttcccttcccccttccctcttctcttcccctcccccttcccatcccccatcccttcccttcccccatccctttcctttccccttcccttccctcctcttcctccttcccttcccccttcctccttcccttcccccttcctccttccctttcctcttccctttccccttcccttcccccttcccttccctcttcccttccccttcccctttcccctccccctctcctcccctcccttaccttcccatgaaatgagaaagcctcagagatagtggcttgattaatttttctttagattaagatatttgtctaagcctttaaggtttatctattgagcttttttgtctcctatttttatttttcctactatgtttgtcgaggataaaatacagcactgtgtgccaagtcataatcacttttcatttgagacttaattaaaatgcctttattttaatgatatatttggctaatgtatttgaagtaatccgaaattaagttttctaatgacaaggtgagaaggataaattccatttacataaattgctgtctcttctcatgctgtcccctcacgcttccccaaatttcttataggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagaggtttgtcagtttgttttcatagtttaacttagcttctctattattacataaacaggacactaagatgaaggttttttgttgttgtttgttttcctctgtgtttctagtgcttattttttaatcagtttttttgatggcaaagaatctatctctgtgttattttgatttctgcagtatatacatctgcatgatcaatattcgatttcaagtaccaaagtaggagtaaaggaatattaacctaggtttaaaattagtcatttcactaaaattagttattatggacgatagatgtctaggtatatctttgttcataaacgaatatatcaagttcagttattaaattacacattaggtaagaaaaggacaaagaaataaaaaagcatgattcataattcctgccctctatttgtctagaatttagttgggaagataagaataacgaacgtgacacagagaataaagtggcatatgacaaatatttattcaagaaagctatatgtggacgggatgtttcagttctcatgggagaagtggattttatggtgcctttgagtaatgggtcatatttgggcgttcacacagaaagacccaagcatatgcctaattttttattattattattttttatttatttatttattttttagacggagtctcgctctgtcgcccaggctggagagcaggggcgcgcgatctcggctcactgcaaactctgcctcctgggttcacaccattctcctgcctcaggctcccgagcagctgggactacaggcgcctgccaccacgcccggctaaattttttgtattttttagtagagatggggtttcaccgtgttagccaggatggtctcgatctcctgacctcatgatctgcctgccttggcctcccaaagtgccgggattacaggagtgggccactgtgcccggcccttttttttttttttttttttaaattagaggattactagttctcttcaattataaaaataaaagaatcttatttcactgcctggtcctggaaacatgtactgcaatatacattgtgacaactttttacctgtcatgtttttagcttttacctgtgaatgtcttatcattgttcttatctgaaggatagatagttgctacaataataatagatggtgtgtatggtttttgagcctaaaaagtgtagttttatctgttgtacctatacaagcaggagaaatataacttgttaataattttaggtatggcaggctgccatcctaaatatgaagtggtctttgtatttgcactttaatgtgttgaaatcatagctttcagtgatccaggattaggcagactcttttatgcaatctcttgtttccagttagaatagaagtcgtgtacttttgataacattaattataatatattttgagccctgtgaggttggtaacattattcccattttatgaatgaggaatgtgtgttaaggagtttgcccaagagtcacatagcaagtcatagtcatgctctctgaagcagcaataacttggcaataaaataaaaatgaagcatcttctgtatgtgttaacttttcagtgactgtttatgccttccagtattctttgtaaaccttgaattctttttttcacagatgattaaagtttatcaattgtaaaggtggaggaatttgggaactagacagtgcacacataaataataaatatgttcttcaaatattgggtgggctaatgtgggaggagtttgagaccagcctgggcaacatagtgagaccctcgtctctaaaaatatgaaaaataaaaaaaaaattttttaaatgtgtgatatgtttagatggaaatgaaacaatttgtcactgtctaacatgacttttagaaaagatattttaattactaatgggacattcacatgtgtttcagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaatttgagatgcattgtagttcttcgcagtgtgacttcaaatattttggaagaaacaaatagctcagagacctcgtaaaatatcttaaactggagggctccatggagatcattgcgagtgactcccccagaatgtccatctgttgacaggagccaggctggctgcatacgaattagctaaggagcttattatatatccagagtcctaccgtgagcctccatcccgtctgccattctcccatccctggtctatgataagacttagaaatctggattttaacaaaacgtttcagattgagaaccttgatttagtctacttctcctattttacaataaagagatgaagcggttaagaattagctaatcctacgcaaagtgagggaaaaaggacagtctttttaataaatgcggcgggctggtggggtatccatataggaagaaatgacattggacccctactccatgtcatatataaaaacctccactttgggaggcgaagcaggcaatcacttgaactcaggagatcaagaccagcctggacaacatgacgaaaccccatctctacaaaaataaatgcaaaaattagccgggcatagtggtgcttgcctgtagtcccagctactcaggaggctgaggtgggaggatcacgtgatctgggagaggttgaggttacagtgagctgcactccatcctgggtaatacagtgataactgtgtctcaaacaaaacaaaacaaatcaccttcagtgatttttagaccaaatgtacaaggtaatactctcaaggttttaatgttttatagttctgcagaagataacataggaaaatatttttatgtccttggctttgggaagaatttaagtcacagaaaaacaccatccataaagtttgacttatttagctatttgaaattaacaacttctattaaaaggcaccacaagtgaaaagacatgaatcgtaatggaagaacatactggtacgttataaaatatcaaagagttgggcatggtgtcccatgcttgtagtcccagctactcaggaggctgaggcaggaggatcacttgagcccagcagttcaagtctcagcagttcaagtccagcctgggcaatatagcaagactgcatttcttttcttcttcttttttaatacctggaataaagaactcctataaaatcactaagaaaaggggtcacttaagaatctcattaacaaaaagaatttgaatatttttccaaggaagatatgcaaatggactgtaagcacatgaaaagatgcagatcagggaaatgcaagtcaaaaccacaatgagctacaacttcacactgattacgatagttaaaatcaaaaagtcagatggtaagtactggcaaggaagtggagaaattgaaactgtcatgcgctcttggtgcgaatgtaaaatggtgcagctgctttggaaaacagtctggcagttcctcagacaattccactccaacgtatatccaagtggaatcacaacatatgtccccacaaacttgtacataaatgtttatagcaggattattcataatagccaaaaggtggaaacaacccgaatgtccatcagcagatgaatgcataaatgaaacgtggtctatccatacaatggagtatattattgagccattaaaggaatgaagtactggtacatggtgcagcttagatgaaccttggaaacattgtgctaaatgaaagaagctggttacaagagtcaacacgtatgatttcattcatgtgaaagttcagaatagagacagcagtagagacaaagtagcagttcagggttggtgccagggaatagggggtaggtggggtgaaagctaaaggatacggtgtttctttgtgagatggaaattctaaaataggtgatgtttatacatgtctgtgaatatactaaaaaccattgaattgtacacattaaatggatgaattgtataggaattatattttaataaagctatttaaaaaaatccagacacttcacccaagaggaaatctaagtggtccataaacatgaaaaggtctttaatcaccagtcagaaaaatgaaaatgaaaaccatgccaggccacctcccaccaccatagtgacaagcatttcaagtgtggcagttccagctgttgttgaggatgtggaataacactggtaggggtgttaagattatctggtgaaattgaaaagacgcatacgacccagcaattctgctcttaagtgcatactctggagatgcttttgcccattgtgctgcgagatgtatacaagaatgttcctaatacctccacactggaaacaactcatcagtgaaaatgaactacagctacacaaaatgacatagatggaatcttaaaacgtttagtaaaagaaatgatacaaaaggatacagtttttttttcatttatgtgaagtttaagaataggtggtattgtttagggatgcagtctttgggatggcaactgtaaagaaaaagtgattgtgttaatcagagtgattgtctttagggaaatggagtgctgatggggagggggcacattagggcttctggagggccacagttctggtttttaacctgagtggtggttttgcacgtgcttgctttatagttagctgcaatttttttttttaatgcagttaaagtttggtatgagaacaaatgtatgaccgatgagtcctttcagtttaccaagttctttttcgtcatcgttaatttagagtgggttacatcagtttttcttttctggctgccaaaggcttaggaaaaaggcaaactgacagaggaagattttaaatgtagaaatatttattggtttacaaatccttttaatcacttatacatgaaaagctttcatataattcaaaaagcaaattttaaattccaatgaaatagttcatcccgtggttgtgaaagagtgtttttagattgctgcacagaagcatgtttaacgtggaaatcagctcatggttttagttgttagggctacaagaaattgggggagacttcattccaagaaaacatgtagtctgtcaggctgttttcattcctctaaaagagacagttttctaagatgtttttgaaaatgagaaaatacgtaatagatctgcttaagaagtttcaaacttaatctgtgcttattacatgaatatgctaatgtaaaaccaggccttcagttagtgtttccttccttttagaatggtgtatgtaaagcaaaatataaactaatttctgacctgtcaaaggttttttcttaaaatttaaatttataatgtggtttggtttttctttcccactcaaacatgaatttgggtaataccagaataaagctggatatataaattttatccaaaatttagaactctgttgttaagaaatctgttgaccacataaccatgtttctgagaaaatacatgattttttgcatctttaaaaaaaattagcactaagaagctaagatgaagttgtttttgtaatttgatttttttttccttaaaatactgttttggagttaaaagttgtagcaaaactggtataagaaagatgttttaagatatatttaagtcttgtctcatactctattgactaagctagcccggtgactagggtagatgtatttaaagaataacttttcccccttaaaatctcaatattccacatcctgttagacttcttgagtattaaatacatcttctatccttggtctttctgcatttagcttttttgggaagtatgtttttacccaagcatatggtatgagctgctgattcagtattgagtggctctttaagcttgttagttacattctgctgattaaaatggtgtacagaatagtcaggaaaaaccagtccctggtctgaaataaacaatgttaattagcttatggggaagaacaaatgagtaaggagaattttcatatacaaaggaaatctctgattgtctttctggactcagtgtgtttgggttaaggagatagggtgcggctggagaaaatgatgaaaatgttcagaatgttacatgtatttttacactgaaactggaagtggaagcccagtgtgatagttttctgcccgatgttggcctgtcttcacacccacaccacttatcttgattgatagagctactacttcctcttatactgcttcagaagttaacctctgtggtgcagtgctaggatatcacagaggaaataatcccttgtagacagtgtcttgttgctgggagttatcagtgcctcctgttctctctaaggagggcaatgggaagccctttccttgcatttgctacagccgtttccttgacctccctggaagaacagtatttcatggtgtcagacaacattcagaacatgctcaaattaaatgtatgtcagtatgcatttgctttggtgtgtggtttgtccaaaccaaagtgcccatacatgtctctggtccagccatgtgggaaattcagcagtggggtgaaccatatggaaatggcaggtgttgggcagccttgactggactgccctggtcttacttctggatttggtgagtagaagatcacactgttgcttgctgccctgggttcacctcaaagagggaaagaagaattagcaacttaaatggttaaatttagaaacaagaaaaagttctgtcagtgggcagtttcttacgtctaacaaaaaaaacaacagcagtgaattcttttgtgttcagaattaaccagtaaacacaaccttagcaattaacctatcactatcacgattgtttatttcctggaattttgttgacagaattagtccaataaatgttatgaataataattttatgaatagagataggttaatgccaaattaagtataattgaatctgagacattaatgcaactgttttaaattcaaccactgacctgcaatttttatatgccttgtccatccagcaagatacattttgtccatttttttcatgtttaaaatttaatatttattgtcaattccagtgtgtttcattgctaaacatcaggctcagccaaagcaatcacgaaaatgactccacgttgaatctttaacatcacaatgtggattaacaatttggcaacatttggctgggcgcggtagctcacctataatcccagcactttgggaggccgaggcaggtggatcacgaggtcaggagatcgagaccatcctggctaacacggtgaaaacccgtctctactaaaaatacaaaaagccatgcatggtggcgggtgcctgtagtcccagctacttgggtggctgaggcaggagaatggcatgaacctgggaggtggagcttgcagtgagctgagatcgcgccactccagcctgggcaacaacaacaacaacaaaattggcaacattaaatactttgtcagtatctgaaaagtgcaaagtactgtgcttggctccccaaaggctcctcttaatcctgaaaggcaggtgcttttattatcttttatcttattatctacattttccagatgaggaaacgtaggtacagaggtttagtaacttgcccaggtcacatagccagtaagtggcagagctgggatttgaaccccagtaccctatctccagcgaatctgagatgtacatgtgataaatttaatctttctcaataaattattaagtgtcaaagcaagtggtatgggcaatgcaccaggattaagaaaaacagtgtgtggtaaagatgtaaaatatttctaattctgttgtgggctgtggcactcccgtggaaggcttgccacagacacagccagaggcatccacgtgggcccctgctgcacacctggtttgctgctaccaaggctgctctcccgaggcttgttcacacaaaggaaagtgagcagctaggaagctgcatatttgaaagttgactagtcaccaaatgctggcatccaaccaagtgattgcattgtaccctgtttggatgaaagattgtgtttaaatgaaaagagagatgatgagccagaagtgtggcaaatgagttaaaataaattgtcagcagtgtttgaagcaggttgctgagggctggtgtcctgaaatccggtcacttggaggatgtatatgttccatcaggggccggaaatgttttatccaagctttagggaataaccctggagattctcttcgttactctactgttaagtacgtgcttacggagtaaacttcgcatgactaaggtttacaggcctgaatgtgcaactgagttcaagtaagcagcaatgtggtgtattaggaagactgcttgacttgggttctaatccttgcttcaccacctagctgtgtgactttaaacatcactgtttttcctcctgccttccttctgtaacttaagggggttggattattagagttctcaaatgccataccttcaaggccaggtgcaggatgcagagaatagtgggttaaagtgaacacctcaatgtaaaatcattcaaaaatttaaaaacatcacggaccaaacaaatatgtctttaaatctgaatttggttaaaggtcacaagtttatgccctttggagtactctctgacattttcatgatgatatgaaaggatttttccatacatactcaaaaggcgctcacgcctctgttgcagtcagtctggccacttccaaatagccaccccatgttggtctccacttcttccctccctctttaagtgctatgttaataatctagcttataattctctaatcagcagtagagcactttgctactttattttttattgttaggggtgatcttagcagcccaagtatgctaagtcttagaaatattcatcagtgatgtttttccctgaagctcgtttggtgactgctaaactagaaccagaattggagaaaaacgaccctgtgaattccaagccaacaaagccggggaagaggcattgagcaacctgtggttgcctgagaaacaaaaggcaaggtggttggatgaaagcaacacttccaagccttttccagcttaacgaacataagtctaggttttggggagagcctatcttagtgagagtgaacaaataaagtaggctgtatctttcagaattgggtatgactcaaataactttttttttttttttttttttttttttttttgagacagtctcactctgttgcctaggctggagtgcagtggcatgatctcagctcactgcaacctccacctcctgggttcaagtgattctccggcctcagcctcccgactaactgggattataggcgcccaccagcacgcccagctaatttttgtagttttagtagagacagagctttaccatgttggccaggctggtctggaactcctgacctcaggtgatccacccccctgggcctcccaaagtgctgggattacaggcgtgagtcactgtgcctggcctcaaataactttcaagattgaataatagtagcttgaagcaagtctagagacgagccagctggaggacagggccagcaggaaggaggtatgcaaggaaaaacctgcaatgaatggacctactgtgtttgagggtactgagaggagtttggggttgaattaatacctacaaagcatccacaaagcaattgggaagaaagggtagggggactattaggcctagtcatatcaaacttttttttttttaaaaaagagtaaatgtcatgatagtatactgcccacctcaattgtaaaattttattttatttcgtttttagatggagtcttgcactgtcgcccgggctggagtgcaatggtgcgatctcggctcactgcaacctccgcctcctgggttcaagcaattctgctgcctcagcctcccaagtagctggcattgcaggcacccgccaccacgcctagctagtttttttgtgttttttgttttttttttttttttttttttttgagacggagtctcgctctgtcgcccaggctggagtgcagtggcgggatctcggctcactgcaagctccgcctcccgggttcacgccattctcctgcctcagcctcccaagtagctggcactacaggcgcccgccactacgcccggctaattttttgtatttttagtagagacggggtttcaccgttttagccgggatggtctcgatctcctgacctcgtgatctgcccgcctcggcctcccaaagtgctgggattacaggcgtgagctactacacccagccaattgtaaattttattcatttaaacaccaacaagtgatttaagaacaataataaaataactgtagctggtatgatggctcatgcctgtaattccagctactcaggaggctgaggtgagaattgatgaggccaggagttcaagaccagcctaggcaacatagtgagacccccccccacccccgtctctaaaaaaataattaaaaaaaaaataactgggcatggtggtagtcccagctacttgggaggctgaggtggggaggtttgcttgagcccaagagttaaggctacagtgagctgtgatcactgcactccagcctgggtgacagagcaagaccctgtttctaaaaaataaaaattatattgggatgatggaaaggtataaatctgctctttctgtaagatgatgtctaaaattggaaaataaatagtggtataagcatgttatttaaaaatttagaggtaagtgatagaggattgtgaaagtggctacctctgggacagtgaacagggcagcattgagaagggagctgccatttttcatcataagcctcatgatgatcctatttgattttttttaaagatttgtgttcataaaaatgaatattgaaagtgaatgcaggaaaaaaactgtctaaaagtatatttaaacagtgacattcactttgcacattgacaccttaagataaatccaatgcaatgtcatactcttaccccaaataagttgcattgtaatgtaaggtcattctcttggggagaatctaaactgacagaaaaatctgtcttaaggagtacctatgatcacaaagtacttcaagcaccctttaaattgtgattaaagataatttgttgtttagaaatatatatacctaggtctggggaggaatagaagggaaatggagagtgactgttaaggtttctttgagggatgatgaaaacgttctaaaattaagttgtgataattgcaaaactataaatatattagaaaccactgaattgcacatttaagtgggcaaactattacggcatatcaattatatcccagtaaagctgtttaaaaaatagtagcataaataagatgtaataatagccaacatttgttgggagccaatagcctgagtgaccagctcagcattcttgataaccacccccttctccctatctcctttactcaataaatatgaagggctctagaagctcagggcccttgttccctagaagcaaggagcccccgaccccttcttccaaacacactcttttgtctttgtctttattcccatgttcatcctcctttgttcagtccagcatggtctgtggcaaacattcaacaatctctaaggtagataatattatcccattttataaatgaaacgggcctagaggagctaaatgactttcttaagaccatcagacatgaatagattagaaattatttttctttcatgtaaaagaagtctggaggtaggctgtctagggctagtaaggtggctccacgattatgcagcagagaccctggaacctttgagttggtttctccactgtacatggcttctctcaaggtcacctcatggcccaagatgactgccagggcttcaaccaatgcatccacattttaggcagcaagaacgatgagagtgcaaagatgcttatcccacctttaaagaaacaaaagtacacagcttccacttgcatcttccatgggagaactgagtcacacatctatgctgttggagcctaggaaatggagtcttcactcccaaaactcattttgaaaagcattcgcgttttgtgaatggcaaggagtttccggtttggtgcttggtaaatgctttgagatgatgatgtctcttctgcccaccatcttcacagcctcacctagtctttcatatttatttccgctcaaagcttcatttggcctctggtcttccttctctttctctcacagcttttttggactctatcctgtaatcgcttttccactgaatccaactaaacactcagtaccttgtctgtctcgttcatcgtgctaggcacagtgctaggctctcaggaaacatgcatggagtgtaggttccttgggggatgtgaattatcaacacccttgagcatggctggaacgaatcgcccctcccgaggacagacaggtagagccagagtgcagggcagtctcccagctcgctggaggcagagctggcctggagcctggcctcctgaccctcaggtgcctcctctcaccctgagcttcccaaacaccgatttccaggcaaagcctcatcacacaacgatattaagtaaagtaaaataggaacggataataaatttttatgtatgcagaaattgtttctctcctcccctcctcttggggttgattaacttagctggaagtaatgaacctgaactgattttttgagcaccagatctaagtggtaattactgagttggtaccttgtttatagactttcagaagaccgtaatacttactaagagaatccttttctcctctactcccaccagtttctcccttggcatgagaaccgacaaaccagaacataaatgagctggaggagagagccctttcttttttttctaggagttgtgtcatatttctaaagggcagcactgtaagtactctgctcccttcagggaagaaattgtgcttccaggacccctcactgagagcaacgccagggaaagaatggccggctcaggacttccatcgcggtcattggccaaactccttccttctgagaatcttactgacagaggccccagggtcatctcatggggctttctgaggccagtactgctttcttctgactttcctcagtagacatctatggctcttttaatgacattctctctccaacctgcttggactccatccacatctttctttgggttcctccttctatgaaggagactcctgtttgtcctcaactggcctctcctggggttcaaaggcagcccttccttcgagtctctcgtgggttcgtgagcactctacctgcttgtttttgggtacttggtaagcccggcatcacaatctcccctggagctagtcccatggtgacacctgcccagattctgtggtcaccagaggtttcaggtgatggttcagagagggcaccgtttcccgggaggcttggggacttggcaattcatgggctttatattctcttgtatatcccacctgggccctggaagcccagtagctaagtgaggagaggcacaacctcctggcctgaagctgagttgcttctattccacctacaggttttcctctccctgttccctctcctggagcttccagatctctgccaccctgtccccctattcaccccagtgatacaggcagcccgagggctgagttctgtgacagcaccctcaccacttcaaatatgctgacatcggttcttcaggcctgggccactcactgagcaatttgatcttccatttatgcctctgcccagctgcgtcctgatcggtggctctggcctgctctcttcttgtcctggcttcagcccttgcgcctgcctctggccagccgagcttcaacagccagagcaccagctcctgcacaggtcgaggctcaagccgtggcagggccccttccccaagcagtcttcatctcatgtagctgtgacagtccttggatgatccgagctgggaggggcttcaaacaactgtatcaagttcaaacccttgatttaaatgtgaggaaaccaccgacccaaggccacacaggtagtgtgaggtggccattgccaggaaaggagggatgggcagttgtgtgccccatcctgagtgtctctggcagctggactggatgaccaccactaagccttccacaaactcaaatctgctttgacagtgaggagatacctgatgtcttgtttgttccccagtccctccctgtctttgctggttgctgctgctaccaatcacatggcccgttgtcctgcccacagaagtggaccaatgacccaagccatgtcatcagctttagattctgggaacgagaagctctccttcctccatgattattgagcttgtatgctgctatagccgtctgtgggcataccccacctctacctcttctcatctttgtgtaccctacccagccatcccggggagcctatcagcagtgggaaagaatgagatcaacatagacgaactattccatgttgatggggaaaggggcatggtggagcaaaagtgagctgagcacattattggagtccttgggctacgtcagggagtctctaggtcaccaagccaaccagttcctttttggcttaagctgctctcttattctcctacaccaactgggtatccaacaatgcaacccaatcctgacaataactatccggacggcataggttaagggcttggtcccacaagactgtccccacttcagacatcagctgcaaagaaggtgcccaggctacccacatttctgcccaactgactataaatttgggggttcccaccagccctcttcatgtttgataatttgctagaacaactcaccaaactcaggaaagcactttacttactattattggtttattataaaggctaaaactcaggaacagccaaatggaagagttgcatagggcaaggtatggggatgggagtaggggtggctcagaactaccatgtcttcttgggatgcattaccctcccagcaccttgacatgctcagcaacctgtaagctccctgaaactttgcttgggaattttttttttttttttttagattccattaagtaggcatgattgatgaaatcactggccattagtgattgaactcacactccagactaggtgtggtggctcccatgtgtaatcccagaactttgggaggctaaggcaggaggattgcttgaggtcaggagtttgagaccaggctagccaacatagcaagacccgatcttgacaaaaaagaaaaaaaattaaccagtcatggtgatgcaaacctgtggtctcagctacctgggaggcggaggtgggaggagccaaggaggttgttctctcttgagattggagggtggggctgaaaattccaaccctctacacacagggttagttctggctaccaaaccctgtcttgaagctatctagggtcacctcattagcataaactcaagtatagttgaaaggggctcattataagtaagaaaatacacttccatcattcaggaaattctcagggttttaggagctctgtgctaggaaatggagacaaacaccaaacaaattttatataccagaaatgctataagtgcagtttctgttgcctgtgaccaaagggtccctggatggttcaggcactgatggagccagaatgaaaacccatgacaaccaactcctaatgggcctcatgttctgtgaactactcagattccaaatgcatcaaagacaccactattgaaggcaagtctgattgttttgtgggctcttgcagaccataaatgtagccttgcacgcgtgggtttgatcgaagtgaggttctatcagtaacatgtgactatgcctctttcataggttgttgcttcaaagagaaaaataaccacttctgtgctgttctatgtgtacggcatccagcatgggtgctcaagtagaatgaaataaattcacccaagggtccctactctgcctctgcacctcagacctttaacctcatttgtagaaggagggtgacaatcgaatcgatgtaatttacctatctactaataatcagaactcttttgctttcaggtgagagaaatgcaacccataccaccttctaccctaagaaccatctgaggttaggggtgctgatcccaggcccagctgggttctaaaactggaggggggcatgcggcctcatcctccctcgcttcctctctcatcctgagtgtcatctttgtctttcggttccttcatgtggcaggggacgtggccactgaaagcaatagggtcagatccttacagtatcttctttttcttttcttttttttttttgagatggagtctcacactgtcacctgggctggagtgcagtggcacgatctcggctcactgcaacctccgcctcctgagttcacgtgattctcctgcctcagcctcccgagtagctgggattacaggcacacaccaccatgcccggctaattttttttttttttggggggacagagtcttgctctgtagcctcggctagagtgcagtggtgcgatcttggctcactgcaacttctgcctcccgggttcaaataattctcctgcctcagcctcctgagtagctgggattacaggcgcctgccaccatgcctggctaatttttgtacttttagtagagacggggtttcgccatgttggccaggatggtctcaaactcctgacctcaggtgatctgcccgccttggcctttcaaagtgctgggattacaggcatgagccactgcgcctggcccttacagtattttctcagagggaaagaaggcctctgtcttcaggggccaccttagatcccagaaggattctgacacctggaccagaggcagagaccgccagggcaactctacccgaaccaagaggaagtggggacagatactctcctttgaccaaaactttaatgaggctcgtctgagaccttcctgaccaggcccagcctatgtccttgcagaattcagtttgagcaagaatcctgccgagtcagggcagggaaacgcccccagccttggtatctgaccactgtctacatcttatcagcctgatctgccttcagcaagagtcctattgggttggtctaacaggattcccctctccccgatgttttctctcagttattttccattcactgacctccaccctgcttcatggctgcaagtccccacttgcccatgctgtagtcagaatcgagtgcaatctctccccacaactgcaagaccacactgcagtgcagcttgttcctctgaccatggctccccttgtgtagtctgccttactatccataacaagtgtcatgaataattttttctttaacaatacccccctccaggctgggcacggtggctcacacctgtaatcccagaactttgggagactgaggcaggaagatcacttgagcccaggagctcaagaacagcccaggcaacatagtgaaaccctctacaaaaaatgcaaaaattaatggggtgtggtggtgtgtacctgtagtcccagctactcgggaggctgaggtaggaggatcacctgagcccagaaatttgaggctgcagtgagctgtgatcatgccactgaactccagcctgggtgacaagagtgagaccctgtcccaaaacaaacaaaaacaataaaataaaatatccccctccaaaaaagtgaagggttgacagtctgaggaaaacagcttgtgtctgcacatatatatttttttttaggtagagtctcactctgttgcccaggctggagggcaatggcatgatcttggctcactgcaacctttgcctcctggttcaagtgattctcctgcctcagcttcccaagtagctggaactacggggtacatgccaccacacctggctaatttttgtatttttagtagagatgggatttcaccatgttggctaggctggtcttgaactcctgatctcaagtgatccacccatctcagcctcccaaagtgctggggttacaggtatgagccaccacactcagccatctgcacatttctttataggagacttgtgaggattctaggagagaaggcatgaggaaagctgagtacagtgtccagctcccagcaaatcctcaaccaatgtcagttgctgccacaatgatgacggcagtggtgatgaggaggggaggtgggatggggagttgggagttaatgtgccctgtgctttgatgagggcggccagcgtgtagcccagtggaactgcactccagcctgcaagctgctacatgccagggtgtgtgtggtttgtctgctcagaggggtgccttgttctacttcatgctaaggcactgcaggagctctcaatggtcctgggaaaaagaggatctccttgtactaaggtatgaagagctaagttcctttgctcatcaaaggccagaagtggggaaatgattttaatgtcttgtaagagattgccgaattggagcacaatttgcaactgatggtgtagtgaaatgagaaaggttttggaaaatcatttccaaggccccagaagctgctgagcctggatggctttctaagtgggaactgaaactggcccagttgtcctatagaactgatgtttactgtttttttgtttttatttttgtttttttttttttgatagactgtagaaatggagcctcctgctctgaaaggttgaaacttacatttgtcttatctgagttccttcctcaggaaactgaccctcaggcctggcagatgttattaggaactgaaacttaccagatcaccacatcagggcaatgagacaccagacccctcacgcatcatgattgcctaagcaaccatctgttgtttgaccaactcgttttccttacctctccctaattcctgttttcccacatgtagttacaattcttccctgccacatgaactcctaaattcagctggtccagctgatcaatttgagactgatctcccatctccttggctgcagcacccaaataaagccttcttccctagcaatgttccttgtctcagagatcagctttctgtgcggtgagcagcaggacctagactgaagccctggtgtttcggcaacagaatcagccgcaggcatcagaggcagtgggcacctaacaatattctgttgttttgagcttggggatccaggcagatcctttgcctcctgaactcggctgagggaggctctgctgagtgaggacggcaaacatctctcagaagggaactaaaatctattgcacacttggtttgtggtctacactctgcatggatgatctaatttcatctgtacacaaccggtaatgctcacagacaagaacaaggaggctcagaaaaggaaagttattcactcaaggacactgagtcgatggaaggaaggaggactggcttccactgtgcctcctcacctcctgggagtggctcacagaacagtcacgatcactgtcactctggcactcagacaagctggttgtgtaggcaaggtgtgtgaagtcctcacagccaagtaagataatacacagagatgtatatatgtatgtatttatttatttattttgagacagtctcctctgtcatccaggctggagtgcagtggtgcagtcatggctcactgcagcctcgacctcccaggcccgagcaatcctcccgcgtcagccggccaagtagctcggactacaggcacacgccaccacatccagctaattttttatttttcatttttaacttttttttcagagatggagtcttgctctgtcaccaggctagagtgcagtggtgtgatctcagctcactgcaacctccacctcccgggttcaagcagttctcctgcctcagcctcccaagtagctgggactacaggcgtgcacctccttgcctggctaatttttgtatttttagtagagatggggtttcaccgtgttagccaggctggtctcaaactcctgacctcaggcaatccacctgcctcaacctcccaaagtgctggaattacaggcataagccactgcgcccggcctatttttctatttttatttcttttgagatggagtcttgctctgttgcccaggctggagtgcagtggcacgatctcgactcactgccacctctgcctcctgtgttcgtgtgattctcctgcctcagcctcctgaatagctgggcctacaggcatgtgccaccatgcctgtctaatttttgtatttttcgtagagacggggttttgccatgttggccaggctggtctcaaactcctggactcaagtgatcctcctaccttgacctcccaaagtgcagggagtacaggtgtgagccactgtgccctgcctacacagagatttagaaagctaaaaggactcacccaaactcacacacttgagaagtggcagagttgggtcttctgtctctaaatctaccacaccaaacaactcaactggcagcattttctcagcaacatctttgcaggaaccttgtggtcaattcctcctgcaggggtgagtggcagcctgcagagagttctgtgagtcaagtgtttcaacatatggatggattgttgttttttactgtggcaacaaaaggtgtgagatttttgtctttcatcagctacaaactacactgttggtcaggcacttttactgggagatgtttttcccccgattcttcctggggtgacttgaaatgtgggcaggatccaggaggtggagagagaggggtctttgaaggggtggaggtgggctgctgacactgaagagctctcagctgattgactcacctgcacatgactgtgtagggaatgtctggcccaaggaggcttcctgtaatgtatctatcatctcttcatttagctcattttttgggtttcagaatccctcgtggaaggtccatttaaaatcttggaagaaacctgggctctgcagattgtcctcagtggagcaactaagagctgaatacagtaaaatgaaaggcaagacaaagtcatttcctgggttaggataattagaatttgagtcaccttcctgtgtaaaaggaaacaaacattctgatggtcttcatcagggaaagagaaatgttttatcaaataaagtgtaatcctggcagttggcttcaactgaggcttgaagagaggcccggggtgtttaatctcctgacattttccctgtacctcttttatgacacttttcactttttgccaagttatttataccatagcctttatagttaatttttgcttctagattatatatttccacttctgtggacaacttgcagcagtttgtgcatagtatgtattcaaaaaatgaaaaaatataaatacatggatgaattactgaatggatggataggtgagtgaatggatggatgagtggatggatgggtggatgagtggatggatggataaatggatggatgggtggatggatgtatggatggatggatggatggatggatggatggatggatggatggataaatggatggatggatggatggatgagtggatggatggatggatgagtggatggatggatggatggatggatggatggatggatggataaatggatggatggatggatggatgagtggatgggtggatggatggacggatgagtggatggatggacggatggatggatgggccctggtcatgttcacataagaaaggttgaacttgtgggagaggaggcaaaaagaggaagtgatagtcactgaatgtgtgtgctagacagtatgtctggcactttataatcattttagttaatcctcacaacaatgcaataaggtagattgcttgtttccccatttcaagatgttgaaactgattctcagagaggttaaagaatttgcttaatgggaccctcatctagatcagtctgaatagaaagaactaccagactcttaaagtcagcctagcaccaagtagacactaaaacattgatttttgtgatgttgtttcccagaaacattgagtcagaaagcatgtggatgcagattaaagtggaacaggctcggccatgactgagcatctgcaggaggagctgaggaaagagctggcctcctcaaggcctgggtgactcaactgtcagcctccaaagcccattcccctccttcattggagaggagtttgaggacagttgtggttgaacccccagcaaaactattccaaaacgccgtgtgctggggcaggtggggcctaggccaaggccatttggccctgcctgctgtggcccttctcccctcccatgtcttccagccttgcctcccccacaggctgcagatgacacccttcgcagtgcttattctggagtgtaagagctgagagcaggagctacctgggggttgaggggtgggcaggctttagagaaggggagagaagaggcctcactgtgggagctgggggctcccaggagccacatttgccaggcttggcttcaagctgacatcactatcagagaagacaggtctggggaatgagagggcccaggagttcaggagcccaaactgtcattcagttttggaagccgaatccccagcacaattgtccaccttgctggcagcatcctggttcccaaagcctgtcagcccggggctgcgggcctctctctcacaaagccttgtctaggtgacttgggaggtgaggcccctgttggtcagccccgttcctgatggaacaagccaccctaaccgctctgtcctctcaggtcaggcttctgacaagccacaatgtgggtgagcctttgtgcactgcctgcccacctctcaccaggagccctctctccccatggcctcaaggtaccagtgaggcttttttctgtctcagcctggccataagcagccctctgcaagagttccgttaccagtcatttgcattgtagtataagtggaaaccacagaatcgccttcctccccagttatttatacttcaagtcatattgtagagagaaaatttctgtcagcaaaaatctcaggaatcctcctcatttctatttgtatggctttcaatcgttgacatgattttttcacatatgtcatcttctggggatggattcgtataaccctgcttcacttgcttccctgtgggaggctcacttgcttctcgacaggctctggaagaactaggcagtctggtacatggttgtgcaagaacccttgagggggccttggagtgtgtgcttgggccctggaactcatgcctaggatggagggctgagattgccccttcccatccaccagggagttgacaagggggagaagaaacttcttgtgagcttgcgatgacttgtggcacttgcatcagaccttggagttccctggggagaggcactcttgggtatgacactgtatagtgccacctgattgccatttgacccagtttggccctggatccttgagcaagagggctggaaagaaagacaggcccactttttgggacactattagggtctgtagcattggtggggagagaattcccccaacccccaaaagagctgaaaatgagacacgcgtggaggggtgaaagtggagtgtggtcaacagtgtggttacagagatgtgtgtcggggccactcccactcaccagggagactcatgaagcagaagggatggggcacaatgtggcttccataggcacaccaagccacctggagagcgcatcagccctttgggtacccccaagcggaaggaggttgggtctttgggtctgggaactttggtgcttgttctggtgggaagggcagggagtcaagaccagctgtgtcttccactgctcttcttgtccactttggttactggcctctgttggcatgaactggggaggcagaggctacctacagacgaggaactgtgtggagtgcgagtgtatgcagtaaagggttagcttagctgacttgaggtactcacacccatattccgaagaaaagactggccctcagcctgagcctccgaaataatctctaagcccttagaataccctgctttgtattcaaagagtatctttgaatgctgaacttagaaccactctagaaaatgtatgctaacaatgcgatttatgatgaacacttgtctttgttcccctggggccctgggccacattgtatcagtttgagccctagagggacagagaatgagaaactaagatcagtcatgcaggtgctccaggcctatgtgaccaaccaccaataaaaaccctgaacatcaaggctcaagtgagcaatacagctggtcccaacttacagtggttcaacttgtgagttttgcactctacaatgggtttattgggacataacccagtggaggaggatctgtacttcattcacatgtgttgtcacatcattactgggagaattaagcactgtccacgtgaatccactgggagaggataactggaagcttgcacctggcttctcctggattctgctctgtacgcctttttcccttgttaattttaatctgtattctttcactgtagtaatctacaactataagcagaatagcttttctgagttctgtgagtctttctagtgaatcattgaatccaaggtggtcttggggacctctaacaaaagatgtctggacctgaacttcctgttgtttcaaagatcctatagcaggctgtcttaccaactttcagcatcaagaagctggtggagagtgggttagtttaaaaatgaaactggggagagagatgaagccgggggaagatgccgtgaaatctcaccttataggcagcctctgattcacctgagggtttttccttgaatactttctgggtacaagtatttgagacaggtgatgtgctggtcactttattctcagctgcttgtggcctagccctaacatgggcactggaaacaatgggggtaggggttgatgatggagaaatggggagtaaagggatttaaaactttgaaaaactgagctgtttccatgatttgtctcttttgattctcacaaaacctttatgaaatatgtgctgacattttaagctctcacttatagtgagaaaagcaatcttcagcaaggtgatgacttgtccaagggaagacatggtcgcccttgttccttgggagattttgtgctcccaggggaaagcataagccctcaggagccatgatgagaacagctgtagaacagcaagtgaacaggtgtgtatcagtcaggataggcaaggctaagctgcagtaataaataatccccggatctcagtggcggaacattgaggaggtttatttcttctttatacaaatatgctgtggatcaggatgactctccaggcaactgtctgtgggactgtccaggtgggcttggatcacctggtgttgggccttgaagtcggtaatggagaggacatgttagaagagaaggaacttacaagcagtgggagtgcagcgcccttttgtggataggggtcaaggcaatgctttccaaggctatgacttggtgtggtcgaaaaagtcaagcagtcttcactttttgctgtggtcccagcaaatctgcttccaatccaggcttctcccatataaaaagcctcctttgtgtacagtgagtgaactagaacagggaggagatgccagtggagcttggcttgctccttctgtggccagctggcttgttttaccactgcctttggggtacagtggcagctgtggcaaatctctctggagtttctctagcgggagcgaagcacctaaagcacatgggtgcaggagcagccaggcctgcacccatagacatggtacagagaggagcagggaagcccgctgcctgcagacttcaggaggagagaggtaggggtggtgcaggggagagggccttaatgccttcagggaaaggagtcaaagaggaatacccaggagacaactagactttagaattcttggggccagaaacttgattccacctctagtgctttcttttagatttctttctctctttactttctttctttctttctctttctttctctctctctctctctctccctccctccctccctccctccctctctctctctctctctctctctctctctccctccctctctctccctctctctctctctctcctttctctctctctcttcttaagactgggtctcgcagttgggcacagtggctcatacctgtaatcccagcactttaggaggctgaggtgggtacatcacatgaggccaggagttcaagaccaggctgggcaacactgtgaaacccatctctactaaaaacacaaaaatttgccaggcatggtggcagatgcctgtaatcccagctactcaggaggctgaggcaggagaatcgcttgaacctggcaggtggaagttgcagtgagccgagattgcactactgcactctagcctgggtaacagaacaagactctatctcaaaaaaaaaataaataaataaaataaaagggataccgggtcttgctctgtgtcctaggctggagtaccatggtgtgatcatggctcactgcagcctccacctcccgggttcaagcaattctcctgtctcagcctcccaagtgagtacctgggaccacaggcatgtgccaccatgcctggctaatttttaaattttttgtagagatgaggtcttgatacgttgtccaggctggtcttgaactcctgggcccaagcagtcctcccactttggcctcctgaagtgctgggggtacaggcgtgagcctccacctggccagcctccagtgcttttgcatccttcctgttaacttgtgtaggaataaaacattgtcacaataagatttttttcctttttattgttttgattttttagccaatgagaaggaaaattccttattagggagggcgagggtgaggatatgtggggtggggagaagcgaacgttccaagtttcgaaaacagcgactctctcttggactctctagccagtagaaacctccctcccactctcttgccccaagatctggtgcttagaagagaatcaagggaagttggaacccagaagacggagacagattgagggactgctgtgaaatgttggggtgtttggtgaataatattagaagttgggctggcagagaccctgtcacataaacattaaatcaacactggagactgagcatttgttagaaatgtaagcgggaatggcagaaaacttgtttttaagggaaagcatgttacggcttatgttcagcctccatcctctgaaggcaaaagttagcaaagttgatgtatggcgttgctttttctgggaactttatctcgtttggtggggttcccatctctgtctcccaggagccaagactttcccctccctctgctccagcagaagccagtctcaggcaaggctccctgtacctcatttacactttggtgtgaatatgttattgtaacctctctcctggaggtgtctgcattccaagactgaacttttctgtgaaagttactgtcactgtgaaaggcagttcagcccccagggattgaaaaaggaaatcattttgggtaaggggacagttagtccagattttttcagttgcaagtaaacctaactcagccagtaggcaaagggggaaattgctggtttgaactggtgggaagaaagctgaggaaactcctacacttgggggaagaactgcaggtgcctggctgcagggaacgcagcgggggctcaggaccaggcagatgccctgcctctgcttcccttggcacagtggcctccttctcccttcaagtaggcagatgctgcctgtggcagaggacagcagctgattggcagcccagcagggaggatgtggtagacaggcactgagcatctcttctaccctccttctagagggctatcctgtactgttgaggctaaaagactgaaaaccacatttcccagcctctcttgcagctaccaatctggatgagagttagattctacacattagatgcactttagcaagattttcaaaagcagattggagaaggagcccatgcttctgctggttttttttgctggcaagtgaggggttctgtttttcctggagtgactttatcatggtggcatctgaaaaaggctatttcttgatcagagagacagcaaccctctcagtgacctagttctgtgggtgtgtctctcctgagagttaatcccagagctcaaactagagctcaaccctagagtctcttcaggcttcccaggggtgggggtgcatttaacagtccaagttaaagagaaaataaaggccattaaagaccaaacattgagcactgagtgaaaaagttttattgccaaacaggaaacctgattcaggccagggtcttggaaggttgttcaggatgagatgggggaggtgaaatggggtaggtctttgaaaaccaacagattgcaaattctctgtcccatagcaggaaaccacagtctctgatgtcagctggctgccaacacgtcagttgtatcagcattagctggctggaggtggcctgctgtgtgcagatggtacctggtgcaggattgtggtgtccaggtgtctctccttagcacataagaccctgtccgaggactgtggcatgacgtgctggagtcacgattctgtcacccagtcaggtcatcagtgtcagagagctaggtggccaggttggagttgattgccaatgataggtctttttctgcttaaatcagctggactggattctattgcattaacttgaccctgactcatgccgccaggcctaatttataaaccaagacaagaaagggctactccaccccctccaatttgtgtaaggccaggggacttcccccccactccccaacctgaggcatgcaccctcccttagatcaatggctgtttctctgagaatgcggaaccgtgattaatccagccttgatggggaggcagcaggaactgtaggcattctcacttcacacccatcccaatcccctcccccttgctgtcctcttgtacagaggactgaaagcacaacactctctccctccctcccttataggtggtgacgatcatgtgactctcttctggtcaatgagatgcagcagaaagtcctagggaggtctaggaaaagtcctgttgggagagagcattttttaccttctccctgctacttcttgctactagtaacatggatgtgagccttggaggggtagctaccatctggcacctggggtggcaagccaacatggaaaggatggcagagcgggaaggaggagccagccttaccgatggcatcactgtcactgcgctagccccagaccacctgctccagagttctggttatggtaatgaaataaaccttgatttttattccttaaaactacccttcaatgggttttctgttcattacagttgaatgctttcataactgatacaggagggaccctgtgattggcagttccactagactgcatggagatgggtggagttatctaaaagaacagagatagtgtccctagaagaaggggacaggaaagcatcctgggtacacaaaagtcaaggctccaggatctgccctgggggctatctcaacacccctacactctcaccgcacgtatttggtcagctatgaatatgaccaactctcgtcgtttatctctattcagtggaacacagcagcactgtgacctgcccacgagaagaaggatttttagaacttatcttagggcaattttaggtagaggagcagacaagatggtgtacaggagaaacaggtctattaaccctggtattaatattaactggctgcccagaataaatgaagaatagcttattctttgccaggttgaagatagaaaaggaatgaagggccggagaagtacagctgggtgaagcacagagcagcctagtgcttggcatgggactcagatctgaagcagcctctccgggacttctctgagcctgcccctggtggtatgactgtgatatccctgcttctatagttggcaaccaacatgtcctagctcctagaccatagagggccagattcatgtctcattgactgtgtaatctctgtgtggcccagtacagagcatgcacaccgtaggttctcacatatgtttgttgagtgaatgaatacaataccaaacgaatggacaggacagagctgtgggctagcaggaaggatatctggcttttgcttgaattagctagtgaattgctgtgtggcctccttactgagcctcatttccctctgtctgcagagtcaagcaaatcttccattttttgttcccctgctgccagagcatggcagagtaaatgtgtgagttgaagggagcaacctcatgaggttttgctttgtgtcttaattacagccatttgtggaattaggcttttaatataaatatttgtgtgcctgcgcctgcatatatgtatttggaccaatgctctcatgtgtgcaaatacatgtattctaaagaaatctgtccagaaccccagcatctgtggtgtctgtggtgggaggggcttccatattacagagagatgcccacagtgcatgacgttacccgcacaggtgtgacatcacagggtaaccaaatgcttttgccctgggggtgggagagggatgggtgcacggtgaacagcaggtgggggtctttccataggggatgaggaagacaaggccacttggaggcagaggagaccacagtggggcatgatggttggggaaggccttttacttctgccccttaaggatgccctggaattcaggctttcggatcccagagctctcattagagcagccctgcgttgtagacttttctgcagtgacagaaatgttctatatctgtgctatccaatatggtagccacaagttacatgtggctattgaacacttgaaatggggttagtgcaattgacgagctgaaaatgtagtttaaattcacttacatttaaatagctgtgtgtggcttgtggctgcctattggactgtgcagttctggagaatggtactttacttgtccttggggaagcagaaacaaatgaaaacgaggatctggagctcatgaagtttctcatggggtggggtatgtgtgttgaagctgcaccttcagcaggaacctggccagtccttagtggaggacatttctttccatcctgcatccagatggctggtcctgctcctcccagtccatggagaaaaaagaattgaacaaactgtctaagctgggtcaggtactctgcagatgtttgctgagtatcgttcttgatggaaatccccgtggaactcctacattttctcctctcttctccttcctttcagaacctcagagtgacagagccaaaagaccagtgcctcattttgctgacatggaaaaggaaacttcgtgggggaaagagatctgcttgcagtcggccagagagacagaaccagggcagtggtgagctctcatgacctggtgtctgttgccttctggttaagtttttcatttgtaattctacaaacatcccttctgtaaacatttccctcaaaatggagcaggaagctctcaaaaatggaccagaaaggggtcaggaatataactttctctgcccagattccaggacttacagtgagaaagcgccttctgggaacttcacaatggctaaagtgtgctaatgggatgatgtgcccttgtacacccactgcctctgaactctgctctgcattgctgagcaaactacatttcccagaactccttgttggattccttccaaacaggtttaccactgggagagcctgttggttggggagggcaggaagagggaggaaagaggaagggactcacttcctgtttccagctgaagtctaaatcaatccactatcaacaggtagctatcatactaccctcattgtcacccctcagaggtcccactgcagctgcataatgtcccctcagtggcctgaacatgagatgaacaacactcttcttgggagtaccagccttgcttggttcatggccacttttcctgattatcttgcagctatattaggtcatgtgacaaagttctggccagtggcaagggaacacaagtgataggtacagatagaagtgtctgatactacatagattatgcttgcactcactcttaagagagagacatgaacttttaccaacggaagccagtattattttgaacctctgttagagtggcttgaatctgtatcctaacttgtatccctaatgtgtgacccatgaaaattagccaggcagcaccagttccaaagaagctcacactcccctgcggctgcttctgccaaggtcactgatatttccctttgctaaatcttgtgggtgttttcttcagtccttgtcttaatcactcagtggcacttggcacttattccttcttgaaacccttgtttcccttggctttgtggcatcctgtgctcttggttttctcccatatctctgaccctctttccttagtcttttttcttcttcctcctgtcccttaaatgctggttgtgatcctctttttatctcattctacacactcacagcctgagtaattcacaccatcttgatgctgagaacttccaaaatgttggtctagcctgggtcattgttatgagctctagactcacaaggccaattgcttggtgggaacccctcccccatggttatctcatgggtccctgaagtccaacttctccttcattgaactcatcacctcttctgttcctcctcctgggttcccaggctcagtggtggcaccactgtctacctggctgcttagcctgagacctggctccgtcccaattcctctctctcagtcttatcatccccatccaggcaaatcattgattctgtggacctactctttcgggtgtccctcaaatctctccacgtctctgtgttctcactagcactaccttggtccaccctgccatctgctttcctcctccactcctgcattctgagtcattttcggcagcacacgcatccttaaaacccctccactggcttgccagtgtcctcaggattaggcgaaaagtctttgctttgttttacaaggcccttcgctatctggccccctcattacctcccttgctctgcatgctccagtcctgcagaactacacacagttcccccaacaaggccctgctctgttcttcccacacactgctcctctgcctgggccactcttcctgctccttgtcagcaggcttgctgctctcaggctcagcatggacagctgcttctgagagccttctctgcctacccaggctgggtggctgcctctctttggtgtgcccatggcagcccagaatgcctggtggacagggagccctcagcaggccgtactgcagcgccctgcccccgtcagcctccaggagcctggagtccagggacatcaagggcggtcctgtctttctcacccttgtctctccagcccctaacacaggggatgcctgaccccaaactagacgagttacttgacctctctgacccaagacaaaatgggaggaaagtgccaaatttccaagattggccaggggattaaataagataaatatgcaagtctcttatctgggggtctggcttggtaaatataaagttcttttttcttttcttcctttttcttttttttttttctttctttttgagacagggtcttactctgtcaccaaggctggagtgcagtggcatgatcatggctcaatgaaacatcgacttcctgggctcaggcgatcctcccacctcagccccctgagtctcttggactccaggcgtgcaccaccatgactggctaattttttgtatttttagtaaagacagggtttcgacatgttgcctaggctggtctcgaactcctaggctaaagtgatccacttgtctcagcctcccaaagtgctgggattatagacatgagccaccatgcccagctaaaagttcctttttaaaatctgcttgttagatacactcatagaaaggtaactggccacagaagggagaggaatggcagtccatccagggatcactggagtgtcatatgaaatgttataggaatcacaggccttagaacttgaaaggaacccaaggatcatctaggctactttatgcaggtaaaacagccacctgtgcccatcacatagctggggcacagctggagaccccaacagagaggagagctgatgggtgacgagaaatcaggcctctccgccacggcagcctagctaatgggtcttggctggaagctaacaggaaggcctctttccagaaacactgtaagccagtgtttctcagattgctgggtgtaattcataggcagatcatgaaatcagtttaatagctttgaccagcattaacctatttatgcctagcgttcccttattggaacactaagtctgtgagagttatttacatcctactgcttaaggtcatcgccaaaatctgattttttacacaaaaaatttgcaacctccagcataaatgggttaaaacaagacaaaacaaaacaataccagaatggaaaatagtgcatgatctgtacagtatagttgtagaaaacttcttgttttatcatttgatgtcatgaaagtccctgctgtagataaaagatggagcttgtgcttctgagtggtcatgctcaacagggtggggagcccaggggagtggggagtgatcgtatagacagaggtgggtggggccagtgtgagcctgatggtcaattacttctcatttctagggaaaattgaaggaaaagaaggagggggatgtggaggggagagaaggcctcagtagagtttgcactattattagggcaagtaagctgcttctgaaaagaaggggtttgcaaagccaacccaggcaaaagcaatctgctggaagaacttcatccccagctgacactgtgggaaggaccccatgcagaagcaatagggcagcctggtcccatatcctcatgaaatgcctcttataattgtgacatcttgcaattgtggaggactttacacttttcggagttcctagcccctcacttatttctcgtaagaccgctgggaggtggggggatggtatcatcatcccactttagagatgaggaaacaggatcagagtgagctaaatgactgccagatccaaaactagaattcagacctcctagtttctaagtggacgctctttctacaccaccataatgtgagtgttctgtgtttacagggtgtattcaagtccatgactgcccattagaatccccccaaaaaattccaggactggcctgagttgctccttagaccaatgaaatcagactcctgggagtacggcccgggcctcgggatcctttaaagctccatttggagagcctcgggcacagccaggttggatccatctcccagtcccccagccttggctcagcctggccaagctgcccaggaggtcccttggtgccctgggctctgtttcactgttgttttgtagagcaacttcccagtgatgctgccactgggccccatcctaacagtgaagtcccccgggccctcctgagaggaggtgtgaactggaagatggggaggcaggcggctctgacagacagaaagcaaacagctcagaggggtggcaggctgcattttattcatcgttaatttaaacacccttcaagtcctctcttggaatgctgctcagaaaaatagatgtattgtttgagaaaccctgcaggcttgtcccgcatgctctagccccctcctgagagaacagatagcataaaaaatgatttgtaaagcaagggggagcttccttagggaagaaggggaaggggaagagggtttggggccaggtccgagtgcagaaatcctcaatgcatgagactagcgtggaaggtgtagcaattgtgctctggggtgcctgaaagtgccagagctgcttcaggggcaagagtccaggccccaagtccatgctgatgagcccaccctgggggtcaggaatggcctcagcaggccctccctccctccctctccaccctacaaagtgaggagccttgagtcaccaccagcacattatacaacaatacaagaaccctgcaacagataaagccccagcgcctcttctggactcagatgccctaggctggctgtctggctgtgctttccagacagtgtgtatgtggaattgtgctttttgttttttaagaatgtaaaaagttacagtaagatcgaaccacagggcccgtcgctcctatggtctctgcctgactgggctgccgtctgcctcagttccccagaagcttctcctttggccatgagggctcagtcatccctcaccccagagtccacaggaagagggggtctgctgggaggcctgtctgaaggacggaggatcctgggtcaatttagcagctattttccagggtttggcttgggtttggatgctggcttctgtgtgaaacctgaatacatgcaaattgtacataaaactcccccaaggcagagagggattttccaggccctggtacatctctagagagttaaaaatgggaaatctttcttcttaaagtggcccagactgagacttttccttggggaaaagggttagtagctctttgtaaggctggtgtgtatgtgtgtgtgtatatatatatacatatatgcatgatgctgtgcaaatgcccagggctgtctggcattttccacaaaatgagagcctgagattgcctaagccttctgatgccttctccaggcctggaggcactgcttcattcagaggacacaaaggcctgaccacctggctttagcaagctaggacacccagggtggcttctttacctttctcctcagctctgagaaggctgctagccaagactctggattctctgtggccacagtcatatggtgagggcctcttggagttcattcaaactttaagggagccccacagcaccggcatgatgggtaagtccaggcctaaggttaggaagcaaatcctggagcatgaggaaattgtaggctacagtgagctaccagtggtgtgcaaactggagacccccaagacagtgagagaggccacagcatctgagggaatggagctctttcttggcctgaggttcagaagaacctgcaccaaagaaaggcatccctatcaatgtcactgttcctgaaatgatgggagaaccacatccctgcttcagggaagcagtccctgtcgtctggggcgctgagccctttggcctgagatgaaggatgatggtgtgatgtatcatggcagtgtgactgagactggattgggggatggggacaggggaacataggcaaaaatacacatgtgccactggatcctgagctgccattgtaccttggaggactggcgtttctctgggaagttgggaggtgggaagaggaagggtctcattttcctgccccttgaaaccatgcttaccattcctttagaagattgctcaagctgcctccaattgcctctttccaaaaccaaagcataggaaaacaagtaaaaacagctgaggctgcagcataagcaacttaggatagagtctaggaagcaccgccaacagagaagactgccaagaaacattttgagtttttcttctctggaggtgggtcctggttcctcccatggagaccacgattctgtgtagtcctgcacgctgggcgggggattgcctggaggtttctttagacctgtctagctcacacagtcttgatgcctgggttttaggctgctgtactgttgctggggctcacttcctgtgggtaggctgttattttgcccgcagatcaagtcctcactgtctagatgcctctatcatggggatctcttcttccctctctggatggctctgatccccaagttatttcctgttgcctaggtaacacctctaattggatgccttttaatcgttcccttttttaaagggataaatgtggattttatttccaggtcctgtcagagggccctgccctagagaacacgtgcgcccctgcgtgggcaatcccttcactgtgaccgcaaccatgggttggatggggggcactcactgggctggcctgacagtcacagtgaatcctgaaagcatggttttcacaggaacccaccttcaggatttagcaagactgacgtctctcctggccagcgctgcttcactggcttcaccccagattagggcctgtgtttaaaaaccaatcccaactcaaatcagaaattacccaaaatagctggagagtcactgagatctcaggtaagctttcccttcctgccatgaactagaaggggaaagaagagtttgacattcaagtttgactctaatgctgggtgcgtgagcgcatgcgtgcatgtttgtgtgtgtgtgtgttccacgcacatttgccagggagagagatttcacagcatggctccagctggaggcggtgaggcggtgcttttctaagacttcctatcagaagctgtgcatactggtgggtcacgccgtgcctgtataaactctggcacctgtccttgccctcatcatatatgagaaaaatgggcagagagagtgttcgtttacacccccagaccactatcctttcaatgaagcctgggtatctggccttcctccaggtcagggaccccctatgctgcagaaggcaagtctgggagaatctgtccctcagcccgagagcaaaactgtaatcctaacattacttccatccaccagtttcaccagctacctccctcctgccttcctctgcctccaataggctgtgcatggagaagacaaatcctcttgataaacaatatttagaaagggattctatctttcctgaccccaaacacatcatggcctctggagccaaataccctgacatttgcaagatggcttcttttgggttcctggtgctgcaggccctggttcccaaggacgcagctggcagaggtgcctccttcagaggaggaggaggagaagctggagggctgcgcccggcaaccccatgatctcttaaagggggaaaagttgaactgatcaacagtagttaagaaaaaaaaaatccacaccaacaaataaatatcttgtctgagaagactcagatattcctggttaatattgaaaagcactgctgtggatgagcttgtgaaagaaaggacggttgggggattcaagatctgccgatccgagcctggagatcagccagctaaaagcccagcagggctcctgcagcctcaccgctcccctcctcacaggtgccctggaccgcccaccattagaagtagctgccctgtgctctgtgctaaatggactaactctgagctgagaaaggccagctaagcccctcaccactgcaatttccaaatctgggggaaatgccacagtccgcaagttggtgctatgtttcatctcattgcataatactacaccattctctgtgtgtagtggctgttctatatatatacatcgggaggcaacatatggctgtcccaacccccacctgtcaaaactgtgactatatcacttctgacgaccagaaggaagctgctaggctgggccaggattctaaatgctgaggaggtaattcagagccacgaaaagttgcaccatatgctttggggttgccggctgcttctgtgcatggggacggggtttagtgccagtctgcaaaaccctcctcgctgcggtatgccctgggtgtgggcctggggggccacgttttctctccctgaaggagaatctgctgggggccacggttctccaagaggggactcacaaggaacacaggcgtccccaaaacctgcccttgataacatcaggcctggccaaatagtatttctttaaaaaaattttttttgtttcattttattggataaagattaagaaagcgccagcagtgactgagagaagcaaaccacgcccggcggccccgcggcctggagagggtccccggcgcgggcggacgggcggtctacctggaggcgctggtctcggccagccggttgttcatgatgcccagcgcgcccacgccgcccgagaagccgttctggcgcgtgttgacgcacacgctgcgcgggtagccgttggccgtctccgacagctgcttctgcagcagcgccagcgacaccttgttggaggccgtgaggtcgcgcatggagatgagctcgcccgagaggcggcggccctcggcgtcgctgtcgcgggccgcggggtcggcaccgagcgcggccaggcggcggcgcagccgggagcctggggtgatggcattgcgccgggccaggggcgcgccaggagccgggcagcagcgcgcgcagcagcggcagctcagcttgcgcagcatccagttgagcacctgcttgatgaggatggagatgacgttgaagagcgagtaaatgcagcacacgccgagcaggatgaagaggaagttgcccaggcggtagagcccctggttccggtaggcggcgtgctggctgctcaccaggtccccgaagccgatggtgctgaaggtgacgaagcagaagtagagcgagtccacgtagtcccagccctccacgctggtgtacatggccgaggcgcagcaggacagcagcacggcgaacaggcccaggatgagcagcacgtggtacaccgagggcttccagcccgccaggctgtcggcctccgagagcgcggagccgcggcggaaggtggcgggcagcaggccgctgcggcgcagctggcgctcccggcaggcgcgcatgatgaaggccagcagcgagatgatgcgctccaggaagaggttgaagaacaggatggtcccagcgcagccgaacagcccgtaggcgatgaggaaggccttcccgcccaccgtcgcgggggtggtcatgccgaaacctgtggagacagggcagggtcagcgcggtcctggccgcgcaggtggtcctcactgggcgagggtggggggtgtgggggcgggggcatgcaggtgcttgcgcggctcctatctcgagtggcaccactcaggtggaggaagaacagcacttagtcatttatctcccttggtggcacttaataggtttcctgatcttggcagcccctaaactgatggaggagacatggcccttcatcttggggacctataaacccaagtggttgggacaggtagtcactaggaaggacccatcatgacacaaaaaatagaaaccactgctgcacaggtgcaaaccactgagctacccacaaagccaacaagggacacctgctctcccactcctccaaatttttttttaaaaactgtcatctttattttagttcataaatacattaatatactagtctaggtgagttttgttgggtgaattacaaatatttacattagaaatcaaaaccaacatagatctcttcaaagatatctagcttcttatgtgcttgtgcactttttataccagtcttgttacttggaaactccactgcctacttgagaatggtgaaaaaagccaagtaatcttagtgctgtgactaattttcactttacaggcacttcgaaaaggcctttggtcaaacgatcatattttcttttttggggggataggttctttgtcacccaggctggatgcagtggtacaatcatagctcactgcagctttaaactcctgggctcaagtgatccttccacctcagcctcccaagtgataggactgcaggtgtatgccaccatgtccagtgaattctttgttattttttctaatggcagagaaaggaccatattttcttagtctgccaacatttcatgcctctggaattgggcctaaggccaagtgggtagtccgtcacttccctagttcttacagtgtgaatatggggtgacaagaaaatgtgcatttcaaatcaattcccagatgactccaaagtcttacatactagaatagcagacttttctgttcaaagggcagtttttaaagagttgtcatatgtgcccaattttttttcccaagtgtgccatagattttcggtccctccctgttattaaaaaaaaaatcagtttaccaactctgcctactaactaaaggaccccaaaattaagtgtcagtgctcaaaagtcaactgcagctcctcttctttcctcaagttatttggaattgtgagtgaatccgagccgaacaactgttgactacgagtttttctccaaaagcctggtttttaaatgtaacctgtagtacacctgggcagacagccttgttagggaagcattccatagggctttgccttaattgggattgttcactctgggaccaggtagagtgtaaccaggtagctagagttaatggtctctgaaaagagctttgtgaggctgacaaaaggattgcttgagagtagtccacccacacccttcagagactgagcatggctctgccattgggtgccggctccttctcaaccaaggatcaccatcagtcatccttgctcacacttgtggccaaagaaaggctctggcccagctgggtcctgtgctgctggtatatcaaattgctttgttctgggaggtctatacaactgcgtattgcttcaggcccttatcgttgttaacttaccacttgttcaaagcacaggctttaagggtgtctttatcaattgatttctgcagaaggtgtggctgcctgccagtgtgctcgcccatgccatccagggcagtgcagagtggcagctctgcctctcaactgagctccctgcccagtgctggctgtggtctgtgggacccgtggttgcctgactctggttatgggagggggtttcatctcttggtggaaagattcacttactgcttggagtctgagctgaaaaaatggatcatttgagcagcaccatgatactgttcagcaagtctggcagcgatcaggggcatccctgtttaatttgtgccctatggcagaagggctacctgtgctctgccagtggggtggggccagccctgggaaagtggagaagagtttgtcctatgtggcttactagtttcctaaacagactatagaaaatatttcttgtaatactttcagagtacattccttaagcctatgtgctaacaatcattttctagactgtctgaaggaaatgcccagttgcccgagtgtggtgttgatcttacgcttaatgactcaggtgaggggaaaatcttatgatgttacccatgttgaggaagatggattatgtccctagatttacagaaagtgaaaaaaaccaaaatagctgtgtaaccaagaacttgatagagggattttgctacattttaaagccacactcaagttcttgagtttataaagaaatcagctctgaatttacatggctataagtggagtgggagtatatgtgtatatttataaaacgttttagaccagtaacctaaatgtctaacaacacaactaaatgattgtctattcataaaaaggaaaactatacagcaattaaaaagcatgaaccatagctacttgaaacaacatggataaatctcacaaaaagaatgtggaacaaaataagctggacacaaaataatacattctgcattattccattaacataaaattcaaaatcaggccaaactacagccttttttagggatgcatgcatggttggtaaaattataagggaaagcaaggaagtaattttgataaaagtcagaattgggatttcctctagagcatggcagggggtagtagctgagaggggacataggggacctctggggtgctagaaatgtttttgttgacctgggtggtagttacatgtgtgttagctgtgtaataatctgttaaattgtatgttttgtgagtttttttgtactcatagtgagaaaaaaattttaaacttctagactgttagaactctcagatacccaattctgacgtacccatcactgtataggtgagggagtaggggctgaggggctgtgacctgcatgttggggacagactcccacctctttgtcctggcttcaagcctggtgcatagatcggtatacagaacactgcatctactcactgagggaacacaaagtctcttatagaaggataactctgttaaattcctaaggtaattgaaaatcctgggcctggaaaaccaatactttgtctaactaagaaaatactgaattggatttttcagctaaagcctcaaagctgagaacagtatgtgtacatttctccccattctaaagagaagttccagacacatccatgctggacttaataaaacagcaaaacaggtctggggctagcaaccccccacacccccacctccaggctgtacggaaaggctggggattgatgggatcttccatcagttgggaagttgttatgggtagttgttgtggcagtggagagtgctgtggattctttcactcacccccaggccaggggatggttggagcagggaaggtcaagaggacttatggagtgtcagcaagagcccggcagctcacttcctagctggctgggcacagccgctcacaggcctacccagagtggagcatggtgagggttctgggagaacccggcagtgtcccctggagtccagagctgtgctggagagttctctgggtgggaggctgactggggcagcccccacaggcaggggaggaagagggcagtcccaggggccatctgtacttcaagggcttgcttcatcaggagatgtgagggtgacatgggtcaccagagggtgacaagtggatactgaaaggaagagatctgaagagactgctcaagagggctgcctgctggagcaagggggccctaggaagaagaggctgaggggcagagggctggggacagcatgagagggagtcacaggaggagggatggagagggcagtgcccactcagggaatggggcagggagtggtccctgtgcagggctcccaaggacccataaatagatgccgtgaaagcacatatgcctgttctaacagggagccttgcagccccaccagcaaaagttaagaaggaatgatagtggctccagtgatgtaagatcacccccatgccccatccactgcgggtcccctgagccatgtgtcagcccagagctagagggggaggctaaataagctctgattagaagtgaatttgaagatttgattaaacaactgagaacgagtctcaatcttaaaactggtacttaattaacaacaacaacaacaacaaaagaggccgggcgtgatggctcatgcctgtaatcccagcactttgggaggccaaggtgggcaggtcacttgaggtcaggagttcaagaccagcctgaccaatatgcaaaaaccccgtctctcctaaaaatacaaaaaaaaaaaaaaaattagccaggtgtggcggcgggtgcctgtagtcccagctactcgggaggctgaggcaggagaatgccgtgaacccaggaggcggagcttgcagtgagccgagattgcgccactgcactccagcctgggcaacagagtgagactccctcagaaaaaaaaaaaaaaagagaaagaaagaaaagaaacaaagaaactggctgagcctggtggctcacgcctgtaatccccagcactttgggaggccaaggtgggtgcatcacttgaggccaggagttcaagaccagcctgggcaacttggcgaaactccgtttatactaaaaatacaaaaattagccgggcatagtggagtgcacttgtaatcccagctacttgggaggctaagccaggagaatcgcttgaatccgggaggcagaggttgcagtgagccaagatcgcgccactgccttccagcctgggcgacagagcgaaactccgtctcaaaaacaaacaaaaaccccaaaacacaaaaagacataaaaactatttggataactctagcatttacccaagatgttaaggaatctaaaagggagttcttaaagacaatagatgagacaaagccatttccagtgtcggcccatttaataaactggttccacctggattttctcttcattgtggtgaaagccaccacctaacaatgctggccctgcctgcatcatcgcatgtcatcatgacaacctatgggggagaacagctccattcaacagatgcagaaactgcaggttaaagggtgaaaagcagttgcgaagtccccacagcttggaaatggtggagccgagactgaaacccaggtgtgctagcatctaaagttcatgctctttccaccacattagactgtattctgagggcaccaaggaagctccatttttcttaagaaaccaaattgcagtcctccaggaccacagccaggggagcatcttcgtgggagagtggctgctgctcagagttgtgactcccatccttaagagtcctctgtcctctctggcctcctttctactgatcattgctgtccccttcacaggggagaggggccatggcctatcccctaaagagtctgccaaggtagactcataacctccccgtggcacagctcagacaagctgggctatttacataagacttgacccagggcttgaggacagcgcgaggaatgaggtgcagaggagactgctgcttctgggtgacagtctgcctggctgaccacagctggggtactcattggcctcttgaggccccccacaggcctgccctgcctgacctactcttgtgaggccaaggccatctcctccactctctgggggcctcttctgactcctccaaactcttccatgtctggactcctggcttctgcccaaggccatctattggagtttgggtttccagttgaggatctgcctttttcctggatgaccaaacctagaatgtgaccggcctcatgctccctcctcacaagggtgtggctttatccgagggcctcagcaaggcaaccaacaccagacatgaagctggtaagaccaacatccacctattcattccttcagcaaacatttactgtggacagcatcaggttggcagtatcatgcaaggctcagaaatatggtggaaaaccagacagatgcagttcctgtcctcagtctctaggctgccttcctagaggcccctcactgggtttcttagcagttttgtacagatcctaccccctttgctgccagcaggctcacctctgggacagggcgcatatagtctgggccagaacttgtcctggggtcttcttacggccctggttcagcttgcattcagcataacaacttagctagggagtgctgcaggccccaaatgatgctaaatactagactagctgtgtaacaccatctgcccagaatgaagggacaggtgaggcagaagggtctccgacagcgcacagggcaaccagtgaaagcgtccttactgtcctgttcctgaggtctctctgtgcctgctttactgcccttcgctttcctacagagcacactcagctcatcctgggagacaaggtgggggtggaggatggtccatccttcttccgcatcaaggtcagtaggttcagagctctgggggggtgctgagaccctgggacaggcttcctgctgagggcactggggcctatgcttgtgccactgcctagccagttgcctcccagagtagagaagcagtctcccaagctcttgcaatttgtggggagccaagctgctctggagaggggcctcaaagcttcagccagagaaaaggcaaacccagccaccctgagaatctcctcctccccctcaatcacaccctgcagaggcgtgatctgtccctgggttcgcaccaagcctgctattttgtttatgccacaattgatctgccatcccagtttgcaaagagcagacacttgggggctttattatgccactttgacaaaagctgtgaagctcgttcccacagcctgtctggtgccgccttcgcaaatggggccctggtgatggggccttcggagttcagctcagagagcatggaagtgagatggagaggccagcactgatctgtatcgtgcagccctgggcggcagcctcggttgggcccttgacacactcctcccatccaggcccccagccaccctgtgagggaggcactattacgcccaaaaatgcaggcaaggaaatgggctgagggaggggaagcattcactgaagttagtttgtacgtggctgagctggccctgaagcccatgccctttccacttgccagacagatgggaagtcttgactcattacccgctggagacttttcctgctgggctctgcactgtcaactgtgagagagggaaataaaacgtactgtacagtccaatctgggatacttctgagagtgaaagtggctctactagtaattaccccaggacagcatgtataaaccagggctgttccaagcaactgggacacatgattaaaatgcagattccatggcaggtcccgctcagaggtttatttagtgggtcagaaaatgggcccaggaatttcattttaacaaatgtctccagataaatctgatgtaaatggaatattcctttaagaatgccattcctttaagaaataatgttaataaggtattccagatgaccctattggttggaatctgtccaactacaaatattttgatttaaatttccattgacctaaaatttttgtggtgggcactgcagctctctccttaccaatcattctcccagcctgtactatattgagtagcagccaggctacttggagaacagactgaactccaggaatgggctctattagtctaggccaatcaggataatccagttccttaccatgactggctcaagaatgggtagacctaagtcaatcagtgcagagcattttcatgactacagagaaaccatgggaaggctgaggcgtggactcagtgggcagggatggaaaaagactcagaaatactgggcatggcccatggctcattagggttgccaggtaaaatacagaacacccagttaaatatgacttgggtaaacaagaaatcattttttaagtataagtatgtcccaaatattgcataggacatacttatactaaaatatagttgattatctgaaattcaaatttcactgggcatgctgtctttttatttcctaaacctggcaaccctactcatgactccacttgtcagcttggtacactcctctgagaagcttctcccaatattcccatctcatttgatccttcctgactggccagtgttgggattaagagcctcactttaatcaaggaacccaaggctcacacaaggctgagccctgcccagccaggccagcggccaggcctccccatgtccctctctctcctaacagggaggagtgggagatgggggagggctgtgggatggagggcggggctgccaacagcctgctccgtggctggaactgcgacatcgcctctctgggagtaggagtgggcttctggccagactcagtgggggaggactggacacttgagagggcactgggccaaagacttccctgggacatgtgccccagccctggtacctcagggctgcacatgtcagccatctccatgtcacacccccggggaggacaaccgaccaccgtggacaagccctgaaccttttgggaaagctggtgctaaaagaatagctggagaagtcactactgaggactgaaaatgcggagggtataataactgctgttgtgtatcgagcctcactatttccacgcaccgtgccaagtgctgcacgcgtatcaattcatttaatcctcacaacaactgcatgaggctccatgttttcactgattccaagtcacagcttttttcctctcatgttaacatctctaaaatcgtgcatcttacagtcaatggcctgatagtttatttggcagtattttaaattcctaatggtacgtaccatgatggtgtgttcataaccaatagtgtcttagatttgatgaactatagtggggatgattattgtccccagttgtgagattagtaaactgagttgcatttaacagataaagacattgaagttcagtaacttgcccaagatcacaaagcaagcacatggcagagatttgaaactagaggaaggagcttgcaatgtgataaagcagcaaatgtacaagagtttggaagaaggagaggtaggttgcttttggcaagagcagcaattctcaattctggctgcacaatagaatcacctggggaactgaaaataatccccaatccccgggtgcatccagaccagtttaggtcaacatcagaactgaggccttcctggtggaatgattaggaaagacatatggaagaagagatatttgtgttcagtcttaacaactgggtggggccgggcacggtggctcacacctgtaatcccagcactttaggaggctgaggcggttggatcgcttgagcccaggagttcaagaccagcctgggcaacatagtgggaccccatttctacaaaaaatttgaaaatcagctgggcgtggtggcgtgtgcctgtggtcctagctactcaggaggctgaagtgagaggatggcttgagccctggaggtcaaggctgcagtgagccatgactgcacccttgcactccagcctgggtgacagagcaagaccctgtttaaaaaaaaaaaaaagattaggtgggatttcaagagattgacagggagcagaggcctaggcttgggaaaggcatcccctgctgggacagtgcagtgcccagggccactgggcagggtgagggggttcagcctgctggtgaagcctggcccataggaaacgtccagtgactctggctgatggagcaggggaatctgtggaagaaggcaagggacaatgctggtgaggcaggagaagagggaattggggtaaccaaaggttaaggcgtaaaaacagtgggtgcagccagttctaggcaagattaggcagcacataggccacatcctcactcctgtgataagacagaagtttccacttcagcctctgattgattgtgggccaagctgtcacttcagcctctgattggtcacaggccagtccttcatggggtgtaactaaccctaggcctctaaagggcacctaggggtgctagcaaattcttttagctttataaaaaccctggggagaggcagaggttgcagtgagctgagatcatgtcactgcactccagcctgggtgacaaagcgcgactccgtctcaaaaaaaacccccaaaaacaaaaaacaatattcattcattcaacaaacatttatttgcacacggtgtagcaggctgtcataggcattagggatacagctttaaacaaaacagacaacattgactatcctggagcacacattctagtaacaataagcaaacaaacaaatttgtaaatagcataaaaaaaaaaaaccctggggagcactgcagtagagaggctcttgggccacctgcttgagtctgctcccactttgtggaatgtacttttgcctcaataaatctgtgcttttattactgcttttttctttttctttttttaaagtttattctttgagacaggatcttgctctgtcacccaggctggagtgcagtggtatgatcttagttcactgcaacctctgccccctgggctcaagtgatcctcctgcctcagcctccagagtagctgggactacaggcacccaccaccacacctggcaaccgttcttttgttgctttgtctttcattgctttattcttttgttgctttgtaagggtttttctattctttgtttaacgtgccaagaacctggacaactcacagtcaaggcgttccatctggtaacattgggagcacctcctagccacctgggactcaggttgaccctacaggagctttgtgaagtgagcattgcctggcacttttaggtgccagcatccaagcctagcacctggcattgtgccctgctctgtagaaacttctaggatctggtaagcctcatgttcagaagacaaactcagcaagtcttaactcctgcaggcttgggaagggcctccctcggagagctgagagcagaactaggaacagggacggtggtttcaggctctggcgcctccacctgctaaggaggtgacatggacacattccttaccttctcggaccctcgcttctccctctaaaaatggcccaatgccctacttatttatttattttttatttttttgagacaggctcactctgtcgcccaggctggagtgcagtggtgtgatcttggctcactgcaacctccacctcccaggttcaagccattctcctgccacagcctcccaagtagctgggactacaggtgcgtgccaccacatctggctaatttttgtatttttagtagagacggggttttaccatgttggccaggctggtctccaactcctgacctcaggtgatctgcccaccttggcctcccaaagtgctgggattacatgagtgcgccactgtgcccggcccactgccctacctctgaatgtcactgtgaagattaaatgaggatgtagttcccacatgcatcccacagtgcccgggacatagtaagctccccaaaagcaccaagcttagctgggaagcacgatgggtgaggcatggaccttatttcacagcaaagtggctcaggtgaggcaggcaaggaatgggcaaatcacgacatgacatatggatttccatggcagggaaatgcccccgtaggcacagtcaagcctggctctaccattggctcgccgttctcctacctcgctgggcctccatctccccacctctggctcacttcctgctttggcccctacgctgggtaggaggcccggctagaggttaggcaccatcttttccagtccccaaagtgagagtgtgtgtgtgtgggagagatatttttaaatggggctgttgtggaaaagctgagaccgtgggctgctctatttgttggcgcttgctggtttgtctgatttgcagagctggatggactgctccctgaggacagaagctcttggttttcttccctccgaagccaggcgtggggtgggagcatccagtgcacccctcttgcattgggtgcgcagtgatccggacagagaggctccagtcagccaggcacagagaaaatggccctctgcccctgttctgcttgtttttgtcttgttctctgggggcctttgaggtgactttcttcatttgatgacaacaagatgggaggcggggacagctgaggtggcaggagtaggggagctagggacagaggatgaaccccacaggctcaggccagtgacttctaacattagagaggttttggttaactgggagcaaatgcaagtgacttctttgaatcgactttgtacctcggcacagccttccttgctagcagggctgacttcaaccaccccccactctgtgctttatctctgggattaaggttttctctcctcaccagaaatcattcagcaaaatgagttattaaaagccggttaaccactcctgcctccgggtagctcccgtttaacaacctctcctggggagcagctgtcaagctcggccctgagctggcgggaagatgactcatttacatacagcccgtctccaggccccccccaccgccaccccaagatctgtccctgtctccctgatgactaatcctttccagggatgagatcactgccccttctaacccccccccccgcccccacacacagaaagagcagagccctcatctcagcccagaattttgggagaagactaaatccaagaccaagggaggcctttgatgggacaaagacgtgactgatgaacccggagtgaggagcaatgagatgaagaaagctctgcccacctaccccgtccctcactcctccctcccacctcagggcgctcatgtggggcttgtgtggggaacagctccagggtcataccacctctcagaagggagacagaccagccaggcgtgaggtgacagaccagcgggcagctcagagcagcaagacaatgtcaattcaatcactttacctcaattcctctatcacacaggaggagattttaaaaggaagtctctggtggtttgtaaagcaacaaatcctgctctcaagtggatagttccaagccctctcaatgaattcagttttatacacctggagaagcacagcctcgtcctttccatggagctacaagccacatctgggggcgctcagtgcccaggctgagggggcacgcagagccctcggggacgactcaatgcacagaggccactccttaagggcccggctccctcaaactgaggtgtccccatgcttggtcttcccacagaagccagcctggttggctgcttcaaaggaggaataaagatgaggagccatgatgcaaacaaacccacacctttcagctgcagccagggaggtgctctagaggcccacggagagctgtgtgtctgctctgctagcccgacctgcacctgccctatgggctggtaaaggggctgcccacagcacctcagcacatgggtctctctctcttttcatccagcccaaaatgtcaaagcacaagggtctctgtcagggcctggctgtggtcactggactgcggctgaggggtaaggtgcacccctcctctaatgggggcgcacccctcctctaatgggggtggggctggagctaatggcacattccactctcagctgccacacacagatggggaggttgatggcccgcacacaggaagtgagggatggtggggactgaatttatggagcccctatcccagaccaagcactctgctggtactttcacaggtgtaatccccagagcagctcctgggggaggtgtcattatgccggtgaggaaaccaaggctcagagaagtaaggcagcacaggtcccagccccactccacctcttgaggcctgactcagccttaggttcagagaatgcaactgtgatttttccctgagatgagcattcaatcatactgcgccagggtacttgctgtggccaaaacgcctgccctggatctgtggcatgactttgtgtcagaccctgtgcgatagaaggagatggaagctgaggttcagagacgttaatgaccttgaaggtcagggtcacagaaaatggcacaaccgggattgcaactcagttctgcccaatttcaaatctaccttcctgccacctccttgccttgcctattgtccccctcccttcatatgacctgggacccagactccctggttttctggaaatattctctctccttttggctcattctgtgcactgtcccagttggtggtattgaggcacagctctgcccagatcactctccagctcagctgccctgagctccccagccccacctttcaaggtcaggaatgacttatttccttttctcttcgcctgtctgaatcctcgccatcatctgacagcactttcagctcaccaggcatttaactgtgtgctgtcttgtgacagcccctgtcctgaccattgtcccagagatttaaccctttgtgtttttctatgttagcttgccagtgaggacatggcccatgtcttggacttcttgccaccctccagaatgcaggtcctcagggagcagctgctaaattcccaacagaactgacagtttgtccagtgatcaccagcagacactgtaccagaaacattgtctccatcttagtttcagttaactcaacatgtttttgagacctgctgtgtgccagacatgagggcaggggaaggaagactatggtgaataagattgcccacagacctccaggaacacacctgtagtcaaaacacaattgagcttactggctcactgcaatgaggaagcttggccaccatggattctggggcatctcagtcagagggtatcaaagagggctaattctaggagttgggcttgagttcttgagttaggtgatttatggaggacttaaggaagcaggcttcgctctggatgggatgctgccaaagagcggaagtacttctatgactgggcatcttaattcttagctggaagatgggaacgacatagcgaggccaagctgtgattggccaagaagcagcagttgctcatactaaccagatgagggatgtttggtctttttagtggtttggacgatgttcttgttttggtctgtgtttggacatgattatggggtgaatggtcttgtttttctctcactccatcttggtcataaggcggccttgcctgatcaggggttctgtgaaatgcttatgctccatggcagatcctcccagccccactgtgagtgccaggccagctctcggcgctcaggggctgccttcatctttctcaaaatgctgctgtgctttgcagcccataatagcattttactggatgccattcattattttttgtaaatgaaattctttccaagtgttccaatttacttggctatatatgtgcatgtgtgcacacacgcgtacttaattccgtacatggagcacactgctcagttgtgaaaatgggtgattttctttcttttttttttttgagatggcatcttgctctgtcgcccaggctggagtgcactggcgcgatctcagctctctgcaacctccgcctcccgggttcaagtgattctcctgcctcagcctcctgagtagctgggattacaggcgcccaccacgacgcccagctaatttttatatttttaatagagacagggtttcatcatgttggccaggatggtctcaatctcttgacctcgtgatccgcccgcctcggtctcccaaagtgctgggattacaggcgtgagccaccgcgcccagctgtgattttcattttaagtttcttctatttgcttttataaatatttcacattttctgtggtgcaaataggatagttgctacttttgaaaccgtaagttcactcccaacaagcactgttaagtttataaataaaaatgaataagatatgatccctgtcctcatacataatgaccacaatgccctatgaaaatgacagtaagggagatgtcaggggattccgggaagcaagagaagcggtttgggagggtgccccagagcaggtgccattggaactgagtagtgaagatgccttagccaggagatggaggcagttgggcacaaggtctgcaaggtccaggttggcattcaagggttcaggtgtcatgtggataagactttccagggagcacgtgtggtatgagaatgaaggcccctgaggaacttcagtatctaaagggcagaagaggagtctatgaaggagaccacattcattcaacaaacatttattgagggcctactgtggccaggaactgtgctaggcccttgggattcaacagtgatctaaaagacaaagtcccctaccctcaagaagcttacatttcagtatgggagatggaataataaactacaaacaattacgtggcctgtgagaaagtggcaagtactacaaaaaataaaaaatagagcaggctaagagggtgaggagtgtgcgggcagggaggaggcaggtcatggttttaagtggggtgggtccagggaggcctcgttaaggaacggatgtttgataaaggactagggtaagagtgtttcaggctagtcaacagcacgagcaaaggccctgaggcagaggggctggaaacagagaagaaaagagtgaaaaaggactgggcatggtggctcatgtctgtaatcccagcactttgggaggctgagacaggtggatcacttgaggtcaggagtttgagaccagcctggccaacatggtgaaaccccgtctctactaaaaatacaaaaattagccaggcatggtggtgcatgcctgtaatcccagttacttggaaggctgaggcaggagaatcatttgaacccaggaggcagaggctgcagtgagcctagactgcaccactgcactctagcctgggtgacagagaaaacaatggacaaagagattagccagcaaatccctcctgcacactttcagggcaaagtttaggtgatataaatgtccctgaaatgagaaaaaccatgactttcatttgattttaatgtgagggagaaacataaactagtagttttacaaaaagaaaaagaaatataatattcaagtagatttcaagcaacagcagatatgctgaatttatttgataactgtcttctttttctctgtcagcagagtctcatgcaattttaaaaggaaattcgatgaaacgaacacccatcaacatctttaatagctgcaagcaatgtggagcaaattttttgtcttatttaatgtggtcatcaccataacccagtaaagacaatatcatcattgctcccattttgtagacagggaaactgaatccaggataaataatgtagcttgcatgacaccaatcttcctcaagtctgagccagaatttatatctcccatttctcaacctcatctctcaagcctataatctttcagttataagaagggaaacacttgagggtgtatcagtttgtgttttgttcatagtgtttatatgctctcaatcaaggactgtttattaaaaaattttaggaggtggtagtcaaaaagtgtctctggctgcagtactggggacagactgcaggggtgagttcagcgagtctagttcagaggctgtggatcaaacaggtggggtggcccagaccaggagagtagccaaaaggggactaaggaagggaggccaaagggaggccacaaacgcaggagaggatgaaggtgctgaagctagaggccattcaggaaggaaggaatgacggggcaaggggtcagaaatttctagaagaatctagtaagatggaaacctaacagtcctactgggatttggcaactgggaggaagctggctctgtgcaggaaagaagggggcaccgctgtgcggacgccagactgcgaagggctgcagaaggagccgaaaggggaagaaacggacgcaggtaggggtggctgctgttaaagccgcttcccggggaggccaaggacatccacagctgaagtgctcaggaccatccacagctgaagtgctcagacactgcgttttctttatctcagagaggctgtgtgacttgcccacgtatgagtacagtggctaaatcacaagccctggagtcaagggtttaggttgatccagcccccactactcactggtggctgtcagcaagctactcgctgtgcctcagtttccccatctatcaagtagacagcactgccttacagatggttgtggggatcagaggggaggggacagctggcggatttagcagagtacgtggcacagaggaaacactaaatatgcttcttcagctccttatcaaggttaggcctccacaaagggtggagcagggaagagaaggcctcaccgggcagacctatcttggagaagatacaagcaatggtgctgaagtttcacaacagtgtcaaccccctccctcatgtgtgtactcacagctactcactttcctactctgtgccagccatgaggtgtagtcactgtgccagggggctgagtgtccggcctgggacgtgagagggcatgggctcacctgctcagggtttgaatgagaccccggtaaccgcagcagtaaagacccctcaaatgccatctctaaattaaaatgggtgatcagaaaatagcaggtgaacgatagtgccctcactgcccacagaagtgccttcagtcagatttagcgctccatcttctgcctttctgaagggacagtggaagcatccatttgaagactcttcctgtgtcttctgcaaaaccaaagaaaagccatcactgccgatgtctctctttaaagatctgttaggctaggcacggtggcttatgcctgtcatgccagcactttgggaggccaaggcagggggattgcttgaggccaggagtttgggaccagcctgggcaacatggtgagactccatccctagaaacaattaaaaacaaacaaacaaacaaacaaacaaaagcaagctgggcatggtggctcacacctgtagttccagctactcaggaggctgaggcaggattgtttgagcccaggaggtcaaggctggagtgagctgtgattctaccactgcactccagcctgggcaacagagtgagaccctgtctctacataaatcagtaagatccatctgtgcaattccttcctcctagaattcagaatctgaggtgctggtttcctgaggacacttgtgacttgctgccttttattgaactctgagtgccctattgcccagtttgagtgttccaatgggaagtgcagagccaccgtggccattcattgctgtagagctgcgccccagtacctgatacatccctcacccttttccaattgatttttagcttccttcatccctccctctttcccttgtcctcttcgtgtccacaggaagcctgttgggagcctgctatggcaagtgctgtgctaggacacggtcctgcactcttagagtttgtggttcagttattccagtttcagcacttacattcattcaaatgctttgtggaagcaagctggcttttagtcaccagcaatagcaatttctgaaaatcaccaagccacaccaaatatatgaaatatctttctctaaggtggtctttaaaatttgggctgactctcctccctctaggaatgttctgatgagtttcagtctgaaggcagggagatggtctcggtgacctcctgggcccctgttctgcactgaactgtatgcccatacattcataggttgagatcgtaacactccagtacctcagaatgttactgcattggtagaaaggctttttaaaaaagggaatcaaggtaaaacgaggccattagggtgagccctaatccaatatggctggtgtcctcacaggaagagtgtattaagatacagacatacacaaggaaaaccacgtgaagatatggagaaggtggttgtctgcaagccaaggagagagtcctcaggagaaaccaaccctgccagccccttgatcttagacttctggcctccagaattgtgagaaaatacatttccattgtttaagtcccccagtccgtggtactttgttatggcagccggaaggagactggggccgcctgtttgcttggctgcagaagccccacgtggctgcaccctggctcattctgttttctgtagcagcagcagcagcagcagcggcagcagggagcccaggatgcaaagcttggtttctgagccctgatcaggaggctgtgtttatatttatcctgctaactgcaggggactgtttattcccagagaaataacctcctgggcaggataggggcagccaaggaaccagctgcttccatcaggcctgctgggctcctccaggttctcatcataccacttctgtcgaggctctctctgacgcagctctcctcactccacaccaggcttgggcccaggggcacagcctggtcttcctgaggatgctcagacgcagggaccgactgctcctcacaagcaccctggcacatgcacagcccagggactggagccttcgcaaacaagtcacagtcctagtctgagattcagtgcaacactaggcgcttagtagatgctcagtaaacagaacaacaaggattttcttttttagttttaaaacattagtctacccatgccttgataaactgtaaaatgcctctgccacccattctcccttcttgctccctttcatgggagctctgaggggaaggtctctggggtgggttccagcaaccctgggcctgttctggggtcctgcagccaggttgggctttcaggagcctatatttcatctgggccccagtcacactacatagatttttgttttatcacagaaatcactgccacactgtgacccttaaggtcctcagcagggatggcgcgaggtgagagtatcaaagccaggtgagagcactcagatggcttctgcctttgaacgtgtgagaagctcactcatgcacagcgacaagcaagaaagacatgggaaactgacaggttttcatcactggctagtgaaaacacattttatacttctgggccaacaaatacttgggtcaattcacacattggcttgagaatgagttctttttctttttctttatttatttagagatggggtctcactgtgttgccaagcctggagtgcagtggctactcacaggcacaatcataacgcgctacagcctcaaacctctgagctcaagagatcctcccacctcagcctccgagtagctgggactgtaggtgtgcactactgtgcttggccaacgtgttcttttttgaggtgggaactttaatttacttgagcagatgtatcaacgtagctgtgaataaggagctaccagggcattagactgcagactctgacacaaccaccgtcaccacaataaatagcaacaaccaccaccacaacaagcacagacacctacatttttttttttttttttagctttgattactacactgtgttgctttcctcactgaggcttatgtggggttttctggttttaggaatcattttcacacacggtttatttacatttcttcacaaccacctagtgaggtaagcattatcctcggtttttagatgcacaatctgaggctcagaaaagtgcagtgtgaggtcactttgtgaataagtcatagaggtaatgtcagaatttgggtcagagactccacaagggctgaccctccttgcggttctctgaagacactgtagaaacccgtgggaagctctgctgtattgctgggtgctcctgttctgtggcaagacaacctagaaggtgatagggggtcttctccgagacatgtgctctgctggctctttggcagaaagggcagagtcggggatcaggacggtcatgcaggctggcactgcccaggggctgatcttccaggagctgggctagcaagctcgggatgggggatgggtcattccctccttctccccactgtcactataattctggagatctgtaaaaggatgtttaacatgtttaaagtctttgtttcccatccttctgccaaggattgagacatcgcccacccagcttcaatcctcatagctacttctgccactgatgggaggaggattgaggttctttctaccaaggagccaggaggatggctgtcactgctcctggaagcagggactcccagatgtggggataagtacgcagggcctgccttccctccactcttggtggcttccaaaggccaacattctagaaagccaaccacccatgtctcctctctttctattggagtgactctgctgcttcaacagagtattaaaaacaaagacagccttccaccctgacgtcagacacacagacacacgagcacgagcatcttgtactaccctgtgcccccattccccatcagcatacacgtggtgtttcggggataaagctacaccaaaggaaccctcccatacaggcttggtacagtctcagcctgtaacgcttccctttcgaagagctgtccctccagcaaggcctcataacccagggaacccctggcatctctgccgagggcataaaccatattagctctgaatcataaagaatgtttactgagaaccacatttgggaagacctttctctttcaaaccctttcttcccaggcccccagtgatggctaacaccattgttcgcagcgttcctactgaaacacattggtcgtgtgtactttcttgtctaactcatagattgcaaaagctataatttcatgggatttgttttaagcgcccttttctggcagatgtaggctcagtatgagcactctgtaattttccagcctcctaaatggccccctggcagcttacataccacatggtgtaacccacccttttcctatcctgcagacaacccaattactcacacagtcttcaccagggccctcctaggtgggtcccccaggctaggtcctgtgggggatgcagttgcacttataacaaaccatggcacatcctttctgaggaatactatgcatccaacaagagggatgcttagaaagttgattctgacatcacataccaatacacaaaaacaaaacccaaaattcatccagaaaatagactcaaggacaaaaaaatccctggagtactattttagtggtgaagctaaaggctttttttccctgtcactttttttgagcttctctctttttcaaatgttctataagaagtatctgttattcgagtgaattaaagaccactcgttttgtcattatttttaaaggcagagtctcaccgtctgggtggggagggaagtcatacacaagagaggagatggcaaggtgctaggaggttagatcatcactggcagaaggcaaatgaaggaggaggctccatgaagcctggatgatgaaggtgggctctgaagagggagtgggccttagatacatgaagggtaaaggacaggcagggatgctccaggcagggagaatgctatgaatgaagactggagggacagttcagggtcttgctgactagtttggctggaggaaaggctgcagtgagggtagcattagccacacttgggcttggaaaggctggggaccactgaaatgcaaagtagcttcccctgaaagaaaccagggaggctgctgtcagagagtggaccctttgggaagcctggatacagatggatgtcttttcccaattcagtcatttataagtagctcatatgtctctcaattcctcatcattttcgcagcaccaactttgtgggggagtagggggactagctgtggagtcagggacacctgggctagaatctcagctctgtcacttgctggctctttgatctgagaaagccattgagcctctttttgcctcaatttcctcatctgtaaatgagatgtgagctgtgctcacctccacaggatgctgatgaggattaaatgagaagaagtgtgtaaaatgctcagcatagtgctaatagcatgaccacctcaaaatgcaagccatttgtgctaactgatggacagcaaggaacagaatttctaaagagagtagataagaaaaaaatagagaagaggaggtcatggaatataaagccgagactgaattgcacttaacttcttttttttttttttctcaaataatttgctcagggctggggcagccagtatcatctacatgctctctccctcagggaggaacccatccaacactaaacttccagagaaagaggcaactatggacagggaaaagctgtaaatgaagcaagtgtcataagttcttcagtaacaccctctctcttattcaaaaacttccagtggcttcctagggtctagaactgtgagtcccaatgatcaggcttggaatcctttgggaactctgcagttattgcaaaggcatatcaatctacttggtcaccaattgttgtttgcaaccttaactttctcctacatggttatgctattactttccaaaaatatgtaaatggttttctgatgaagatgcacttaaaagtgctactgaattaattcagaggactttgtgtgtcaatatgcattttccctattaattaacggatactgaaagtacatgtaacttccatcatacaggtgctgtgaaactattcctcgcatttaaagcgattctcatgtttaaaaagttggaagcagcctaagcaaaatggcaaagccccatctctacaaaaactacaaaaattagacaggtgtggtagcgagcacctatagtcccagatactggggaggctgaggtgggaggatcttttgagccagggaggttgaggctgcagtaagctgtgatcatgccactgcactccagcctgggtgacagagagagactctcagtgtcaaaaaaatagttgggagacttctggttcaagatgattatttaattacctcaatttacctactctccctcttaagatcctatttaaatgatggtaaaaggacataaaggtgtaaactagcaataacacagggaatgggcagagggtttacagtggaagggcccgagaagtttcaacatgcttgtgcaagatggacagcttgagagagctgtaactgatgaaggcaggtggagaaacccacagctcagagggagtacagctgagaaggggagggagggaggggaactgccctgaagaaccctggagagacttgggtgtgggaaaggccatatagataatgggtagctgcccaccctctgccccaaaaagaaagcccgcagtccacaagccccacctatgcacactgagtttccagtccaattttctatttttaattcttaaatgtgagtggacagccacagttcagacatttgaggaaagcctgtaagccctctcttgcagctcctcctagcttagcctccttcatcttcaagggcactgcggctcaatcttcagatctcttcttttctggctcccacgaacacgccctgggactctgtggttctaaccttgacagcaactgaaattactctcatgaggagttttacaaaatgctaattcataagcccccacttccagagagaatgatacagttggttagggcacaacctgggcatcaaggcttaaaaactcccaggtaattttaatatgcagccagggttgagaaccactctcctaggtgatcttttctttttctttttgcgtctgggtctggctctattgcccaggctggagtgcaatggcacgatcatagctcactgcatccttgaattcctggcctcaagtgatcctcccacctcagcttccagagccccctagctgacattggcagggctttatttatttatttatttacttttgagatggagtctcattctgtcacccaggctggagtgcagtaccatgatcttgactcacagcaacctctgcctccctgtttcaagcgagtctcctgcctcagcctcccaaatagctgggattagaggcatctgccaccatacttggcgaatttttatatttttagtagagagggggtttcaccgtgttggccaggctggtctcgaactcctaccacatataagtggttctcactcctggctacatattagagttgatatggtttggatttgtgtccctgcccaaatctcatgttgaattataatccccaatgttggaggaggggcgtggtgggaagtgattggaacatgggggtggatttcccccttgccgttctcatgatagtaagttctcatgagatctggttgtttaaaagtgtgtagcaccttcccctttgctctcttcctcctgctccagccatgaaggacgtgtctgcttcctctttgccttctgacatgattgtaagttccctgaggcctctcctgccaagcttcctgtagcttgcagaaccgtaagccaattaatcttcttttctttataaattacccactctcaggtatcttcttcagtgatgataacattgctttagccagggttaagaaccagtggtctataggctggcaaatcccaaatttgtatctcaaacccaacctgtcccttgagttctagactggcctatccactatctaactggcacccggcttggaagtggaaaagtcatttcagaattaacatttccaaaaccaagctcttgattctccctcccaaccagcccctccttgattccacttcagccttccctatctcagtaaatggcaaatccatccttgcagttgctaagggcaaaagtcttagagcccttttttattcttttgctttctctcacaccctacatctgatccaggaacaaatcgtgccaccctactgtcaacacttatccagattctacacactgactttcgcttcaggccacgagggcgtagctgaatccagacttccctcccaccataatcaaccaggaaaccggaaaaagtctatgagataattattttcagacattggaaaaaaggtagttcaggattatggtccctgagagaagggaaacaaacaaggtgagcccttcaaaagccctggtttttgcctggtggcagctttcagacagccatgggagtggagagatccagacagagcccagaactcttgctgaattgaggggagagaaattcaggttcagggaggataaagcagctgtcactgcttaactgctgtaactactgtggagcactggagaggaaggaaccatcaagaaaaaggactccagaaatctactaggggtccctctttgttactcgcaaaggtctgaataacaatctgtgcaggtacagggtaaaacctagaaaaaaataagaccaaggaaaacaacttccaggaaatcacaatttccagagagctgtaaaccaaacaatttccagagccctcacaaagccaggaatcacctgagttcctatcagtcaaaggaggaaaggtttcactgaatccacaaggcattcagtagagaccccaaaaaggttattctttaatagtgtggctcatctagtcccagagaaaagactcctttagacctgcctttaaaaagcttaaaaacaagtctggaaaatatcaactgatctataaagaactgtctggcagaacaaagtccaaccctgcttgaaagagtacaaaacaatcaagcatcaacaatgtaaaattcatgatgttctgatctctaataaaaaatcagatatgcaaagaagcaggaagatgtgacccagaaataagagaaaaatagtcaatagaaacagacccagaaatgccagagattatggaattagcaaaggcatttaaatacctgttaaaatatgtaaaatatgctcaagatttaaaggagaaacataatgatgagaaaaatgggaaaaatttttttaaaaccaagtagaatatctcgagatgaaaaatatagggggctgggtgcggtggctcacgcctgtaatcccagcactttgggaggccaagatgggcggatcacgaggtcaggagttcgagaccagcctggccaaaatggtgaaaccccgtctctactaaaaatacaaaaattagccaggcgcagtggcgggcgcctgtaattctagctactcaggaggctgaggcaggagaattgcttgaacccaggaggcagaggttgcagtgagctgagatcgcaccactgcactccagcctgggtgactgagcaagactccacctcgaaaaaaaaaaaaaggaaaaatatcatgtctgaaatgaaaaattcactgaatagagttaacaacatactaaagactgctgaaaaaggttgaacttgaagacatagcaatagaactattcaaaataaagcactgtaaccaaaaaaagactgaaaagagcctcagctacctgcagaacaatgtaaattaagactaacatatgtgcagttggagttcaaaaagagaggatagggtagcaaaaataatatttgaagcaataatgtcaatctttccaaatttgagaaaatttataaacacgcagatccaaggagctctataaacacaaaggaaactacacaaaggcacatcaaaatcaacttgttgaaagtcaggaatgaagagaaatcttaacagcagccaaagaaaggaggcacaattacttacagatagagaaaaatattcacagacttttttttttttttttttttttgagatggagtcttgctctgtcacccaggctggagtgcagtggcatgatcttggctctctgcaacctctgcctcccgggttcaagtgattctcctgcctcagcctcccgagtagctgggattacaagcgtgtcccaccatgcccggctaatttttgtacttttagtagagacagggtttcaccatgctggccaggctggtctcaaactcctgacctcaagtgacccacccgcctcggcctcccaaagtgttgggattacaggtgtgagccaccacacctggccacagacgtcttatcagaaactatgcaagccagaaaacaatctttaaggtgctaaaagaaacaggaaaacaaaacaatgaaaaaaaccccacacttcagtaaatatgcatttcttttctgaaagatataatcacttctcactgcctccaccaaacatgccccggtccaaatcatcatcatctctcacctggaatatttcaaaagcctgctaatgagtccccacacttctatatttcccccgtacagttttttttgaacagcaatgagtggtcttagaaatcagatcatgttatgcctcttttgtctccctgctttttttaacctaagttttgcctcaggatctaatcatgcttcttctcaaaatcctcccgtggctccccatttcactcagagtaaaacccaaaggtcttgccgtggcctggagaccctgcatgacctagtctctggctactgctctgagctcacattctaactcccacttgcccctcctccaaacactattccagacacactggcttccttgcggctcctccagcaaaccctgcaagctcctcctaagggaccctggcactggctggagccctcttcctccaggcagccacatggctcactcccttacctcattccaagcctccactcaggggtcacatcatccaagagaccctttcagaccaccctacttccatcactttattcttaccctggttttgttctttttgcagcatttaccaccacctgacatttatttgtatgtttattttctatctcccccaactagaatgttagctccataagctagggactttgtctacttgttcactgctgtatccctggggattttcagttgctggcacatagtggagcgctcaagaaatatttgttgaataaatggatcaatgggaatcatgttttctggatgccaaattagaatacagggcctgctaactgttctggaaagtatgacgtgtgaaatcagtattaccccctaccccacacggcaccatatttttctggagctctccagttctagactcgttgacacataaaaatattttggtgctagtcctggggaaggcagattattggtttaagattcagttctagccacaggctgcactgtgcataaatctaggggactacatggagttctgaatgacatgtgtctcactacagtggcattacagagaaagcctggaaacattacaagggagtagagccagggccttgtagatactggctcattcaatcctgcaacccagaggagctgggcctcctcctgaagggcctgcatcacctccttccttcttgtttggccctggggacgaccggtggtggggaggtggggggaaggtcaggaactgagatagaatttatcagcgtgctggctccgagtctgcagctaggatgccctttagccacaaacagctataaaagaataagctttatggaaaaacattaaaaaagaaataaagcaagaatgtagatggaagtgaaggggactctagggacaaaaatgctatgaattaaggtcattgccacacaccaacctctgctgcacccccgcctccaccaatggtagtgcctttcccacctgcagggcacagggggctgccctcagcaatctccgagcagtgaggggagggctgccctgctgagcccagctttggaggaggggtatcctcctccagcctcagcctgcttcattccccacttcctttgtggctgcagcatcttcaactgccttccccccattatgagacatgcccacaaatctccagatgcattgttagaaaccctggggccctgtagagcctggcggctcatgcctgtaatcccaacactttgggaggctaaagtggacagattacttgagtccaggagttcgagaccatcctggccaacatggtgaaaccccatctctactaaaaatacaaaaattagctgggcatggtggtgcatgtctgtaatcccagctactcaggaggctgaggcacaagaaccacttgaacccaggaggcagaggttgcagtgagcagggatcgcaccactccactccagcctggatgacagagtgagactctggctccaaaaaaaagaaaaaaaaaggaaagaaatccccaggcccacggtcagcccctttgcctagatcttcctgtgtgggcatgatgtcaagaaatgaggggggaatggagagcaagaagacccaagatcagcagaggtcttgttgagtcttgttgagtgccgataaccaaattctgtctttggctcctgaaaatatctcttaccccttttcttttgctcctttccaaaggccacatgatcccccagttcctatccctagtcccctctacccaattcatcctgccacaaatattcagcatcctgggctgccatataaacaaatgaacaaacatttactggttctcaggctatgcaagggtcctccccatgaccctgtgaggtagacctcattgcaagagtatatagctcttcagtccaatgtgacgaattctgctctttgtttaaagtgtgaacaccagtagctataaaataaaattataacgcatagattatgaaccacttagagcgcgtaaagaaacaagtcatgttggcagtcctcttgaataagtttggaatcatatagcagttcagagctgaatatacaaactaagcacatattcctcagtgatttatcactgatagagatatataagctgttttttttggtggggtgggggggcacccaggatctcactctgtcacccaggcagaagtacagtggtaagctcttgataaagtgaggggacagttgataatggcctgatttaatgtttgaggtgaacagccaaaacaagggacttcacaattatctggttgtttgaaggtagttctagagactaacagtttagactaacgaggttgcctgacttaacggcataactatatagtgactaaagtgccagaatcttcttctaaaatagtcatgatcacattacacccctgttcaagaactccagtggtttcctgttgcccccataccaagtttaaatgtttccacctggctttcaaagccctccaatatgaccttaacctattgaagcagtttcacctgtcattgttccttaacttgcttaaggcaggctggtcctgacctcactcacactgttctttcaaacctgcctaccctgcaacctgagaggtggcatcagacatactggaaagaacaaaagatctggggtcagagaactcagctcagggtttagctttgccacttacatgtgaactcagccagattatctattaataaaaatataagcccacattaaagtgcttatgaaataccagggccagactaagtacctgcattcattgtctcatataattctcccaaccaccacatgatacaggtgttattatgattcccattttataaatgttaaaatggaagctttggaagttcatctattcaacaaacacaaggtactgtgctaggcaatgggaatataatagtggacaagagagacaagaaccctgttctcatggagcagggagtgagcagaggtcagggaacaaacaaacacataaacacgttatttgctcatgaacaggatgatttccaaaaacggtacatgttctaaggacaataaggcagaatagtgtgagggacagtgactaggggttagtgggggacactactgtaatcagggggaccagggaaggctcctcaagggtgacattttagctttagatatgaggcttgaatgtggttaagagaagtcagccatgccgtgactcacagagcagtgcgccaggcagcaggaacagcaagtgttaagtgcccagaagtctgatctgggtaagtccagcgtggctgtagtgcattgagtgaaggggaaagcagtgccagtgaggctaagaggggtcagggccaaattatgcagggccttgagtgtcatggtgaagagtcagattttttgcaacaggaagtcactgaaggatttcaaacaagcaaaggacttggcctgacttccgcttttaaagatctctttggctgtgtgtgaagaacaggctgtcaaggagcatagagaaagctgggggattggttagaacgctaacttagttgccccagcaagaaatgatggtgacagctggagtagactggtcgtgatgggcagcgagacaagtggatggaatcagaatgtattatgcggattgagctgacaagagttgatgatgaattggatatgaaagtttaggaaaaaaagaggaatcaggacaactctttatatggatgacatttattgatatgaagactcatggagcagtgtaccaaggagcaggaacagcttgtgaggggaacagtcaagagtgggatatagcaggaatcaggagttctattttgggcttttaaaagttttgatacatattgaatatccatgtggagatgtcaagtgggcagttggacccatggttctgaagcttagtgtagaagatgggttattcatcaatagataaatgggtttaaagccaaagggtgtgagggggatcagagtatgccatccccaaatatgtcactttagcacaaggattgttttgagctgcaggcaatttggaagcagcagatgcaaagaaagctccttatcctcccctatctgcctaaaggcaggacataaatttccctttgccaaggtgtcctccttaccctctctgtactcttaatcactggggaccccactgtcactctagagattttacaagattgagtctgcataacaaaccttactaaaaccaaagcttattctccattagtttccctcctatatttatcttcccataatttaccacttctagaagtccaaactccttttatctcatcattacttcacaatttatcactctttgttaaaatggtatacaacttctttttaggtaattccttttctatgaaggcctccatatgtatatgcaataaatcttttctcctattaatctgtcttttaattcagggccctagcggctgaaaataagaaaatgtaggggaaaagcttttcctctacaggtgagagattgtttggagacagtccagagtgaggactgagcatggggccctctcatactgaaaggtcacatagagatccagcaaaaaggaccaaggaaagcagccagtgaggatcaaggacagcatgatgttctggaagccaagagaaaagaggagtttgaggataaatggtcagccatgtcaaatgttgctgagatgctgaggacaggcaagtcatcactggatttttttaggaagggggccactagggaccttacaataacgtagtcactggaaaggtggggctggactcctgattgaggtggatccaggggagaagggcaggtgagggagaggttgactactcttctcagaagctttcctgtaaaggagggcagagaaatgggaaagtagcaggagggtgatgcagggtctattaagaaggaagaatatacatgtttgcataccgatggagtataaattaacaatgcatggggagtgggtaatgacaggaactaagccctggaggaagttagaggaagtgagacccagtgaagctggcatttgtaagtgggcacttcatccactgccacaggagagaaagcagctccacatggtgggtggatttaggggtgtgaagattacttctgattacttttattacctcaatggagtgtgaaagaaaggtagttagcagagagtgaggggaatgggaggctaaagatggaagagggaggataagtggtggacacagtaggaagtacagtgggatgtggggggtgctgccagtgtggagtgtccagctggtactcagggtcaccaatttaaagttggaccagtcagcatctctgcatagtttgttagccatattcagctgcttgagggcagatgaagaatacgtgggaagttggtattttgataggggtacaacatagggagagaggggcaaggaagttaagggtctctgaaaagggaatgaatccaagctgagttaaaaaagaaatgcaggctcaaagaagatggtggaaaaataagagtgggagtgtaaaggacctgtaggtcttacagccaaaggattatgatctcacccaaacagggtgatatcagaggatgggagctggaagcatgggaggtggtggtcagaggtgagatgtttagagtcaaaaactttgaaggtaatgcagttactagtaatagcaaggacatacatagatagaaccaaatgacctgctggggtgggatggaaagaaatatggttatagatgagatggttaaggagcccagttcttggatgcatcatctgtgggaggctggagaaggctggagaggaactcagtgaggcagacttcagtgaatgggcaggagatgcatgctggcaaccccaatgacagagcttgctatggtttgaatgtctcctccaaaacttacgttgaaatccaatggctattgtaagacttttaagaggtgagaactttaagaggtgattggatcatgtgggttctgttctcatgaatggattaatgtcatcatcactggagtgggttggttattgcgggagtgggctcctgataaaaggatgagtttgggctgattctgtcctgcacttgctcaccatgtgatgccttccacatggatgactcttgccagatgccagagccctctatcataaacttcccagcctccagaatggtgagtgaaatcaacttttttttgtttgtttttttttaataaattacccagtctgtgatattctgttatggaagcagaaaacagaccaagacaagctaaaattcatacccaagaccagggcccccagcattctctccctaaccactacattgtactgcaaattgtcacttggcaatgcagatttcttcattcttaaaatggatacatgaataatgcatacctgcccggctgaacaatgcacatcaaggagctttgtaaggcaatttccgtatgttaggcatacaatccaatctctgcttgactgcaccaagaggcccgaacaactccaatcagtacaggtgtatgacccacttcagctcttgttatatactctgctgaactgccttctgggtcatgtatattgctcactaatttgatgttaggaactgagatgccttagggattcggggactgtgaaggtagaaacggcagtaaggtggacttcatgcagctgctgggttcctgacattggttacaagttacatctctctttaaatataatggggtatgttgctgcttacaggagctttggaatgaatccctttgagaagcaaagccttcttttacaaagcaggtcatcatctgatcatcatattttactttttataaaacaggtgcctaggtagagttgggaatcttggaaacggccattcattcaaatttacattgattctgaaaatatttctgtagcccctcccatgtgccatgccctgtgccaggcactggagacatggaggggaatggaggagatagcgttctcatcttccaggaacccagaatctggcaagagaagcagatgctaagcacacagtcacacaagtgattccatgccaaaccagcaggaagtgtggggagtgacaaagagggtgctggcaggggcaggccctgcagtcccacttctgcactgacacaggcaaggacctcttccctgcctgccactgaggctgccagaccttcagaattagctcccatgcaatctcagctttctttcccgaccttccattttagaagagaacccagcaatccaaacctgcatggcctccaaaatgcaccccgcccctaggaaatgccaacacactcagcacaggcagaggcccgtgcctacctttccccctcgcacctgggctgtccctgcagaattcctggcaggtcctggtgttagcagctaaacaggctcacacgaggcgctcagaattcagaacacttggcagcagggaagaggatcatggccatttggaaaggattagagaggagtcacgcggagtgcgattcggagtttgcgtttatctcaactgaaactttccagaaagctaggacaactgattccaataaaagcttccccaagtatttttggaggcattgtgatggtgctgggccgtgtgggtgggggtggcttttcctggtttgtggaattgcatttcattactgattaaacttccgtcaaatgtgtgaagcaacctccagtttctaaggaatgtgtcctgggcaggtgaagagaaaaggcagaaccactggactgagaggtggaattgagcagggcctctttatggctaagagatgtggccaaggccagggccagataggaaatctgagtcagtgggaaaactaggaccagaagcccccctagttcagaactgaacttttcctactgctttctgagggtaacaagggctgaggcttagaattgtctagtttggtttcagtccagggcagggtcaggataaggacccagctgactcagagagccatggaaacgcactgccagggaggggagctccagaatgagctggctgccctgctgcacacctgccagccactgagagagcattaaagcaacggcccagcagaggggctcatgcacagccagcccctccagctgtaggagtggggagcccagcagggaggccctgggaggttctggaaacgtggtctgggcccagcttgctcagtttttattttttgttgttaatttccagcagtccagggttttcagttactcattcattccatccactcaacatatgttgattaatcacctactttgtgccaagtattatgctccatgattgacagaaattacctctttgctgcacttcgaagtagtcattcaatgcatagctgctgccatgatggttattatcatgttattaattgtaacagtgacaagcactactaagatgtagcttctgaggtggagaaagaagaaactacgttttctgcatacctactatgtgctgggccctgggccagctttagacacatcttaacccactgaacggtggcttacttcgcagatggggaagctggcatagaaacaaatgattggcacaggtctgagggcagtaagagggacttcacagtaggtccctctctagtggcaccatttgagctggatcttgaagactgatttcacctggtagaaaacagggaggaagggaagggcattccaggtggagagtacagcatatgtaacagcctagaggcttaaagtgcgaggtaagggggacagaagttaagggtggctagagaagagagtagcactggcaggcgcttggtgcaaggtctaggcagggtctgtttcaggacatgaccttaggcagagtctccctcaagccaaccacccttcaggaggcgagttctgagctggctatgtccccaggctttccttgctggtgtgcttaagggaggccctcctgtttttttggttttctgtcccgcctgtccatgcccactgcagctgtttccagtgcaaggctgagggttctcaggtctgggcgggagctcggtcctcttcaacaagttcccagagttctggtgagctctgtgggaagcacgtgctctaccctctccgatctggttggcagcctccttcacagagaggtactaggtggcgaaggatgggaagcaggcagccctcgctttagtgtagccactgacactgccagaagcacagcacagccaaatcccagagtccccaaactgtgcttcagctctcactgatgcctcctcatcctcctcctccacccacacaaccctgcagaccccaggctgggctatggttcttccccctctgtggaactgcacaattcagagacagcagagatcttgagcagtcaggagccgtggatcctctattctgccattgactgacttgctgtgtgatgccaagaaagttgcttaacctctctgagcctgtcatctgtgaaatgggatataattttctttgctgtcctaggatttttgggagcttactgagtaaacacagataaaaacacagtgaactggcaaacatgacatgtggcagggaggggagtcaatcagggagaccaacaatgcctcagttatccccctcactccccagaacaaaggcattggctgctggcatgatggagagtttggaaaggggagatactggtgggctctgtggcctcccctggccccagatcctgtcctgctccgggaggcttctgcctgggaagggggtcccggtgcttcctccacccaccagggagtcatggtagccctggggtgcagggagcagcagcctggcacccacacatggggctatttgctgcagtgccttccttcagcgaccttcacccagcagccatgacactggacccacctcagagaagtgtggcgggacctggcctcagccagcatctggcttccctgctactcttcaactccatgacctcctcctcagcctaagcactgccaagaggcctcagcacacctggaaacaaggagggtggccaggattgtggctgcccagggctctgctccgggtgtggggggcagagaagcactggatgtcactggtctaactcaccactcaatcattcattcagttatccaccaattacatccttgacaatgattaaagagcactgcgcctatgagggatgattaagatattctagttgaggacccaaagaaaatgcattttcaaaagtacccttccaggctggttatgtaacagcataggacacaacacacccgagaggcagtgaccaaccagagtgcagcaggtgccacacagcaggggggctgaggcccagaggactggaccatgcacagggtggtgtggccgggtgagctacagggaaggaaatgtgccttggcctcccctccttcacagagaggcagggcagggctcaccaacagggttgccgagatctggggagcagatgctactcatggttaccaggcactgcacccatgggttagagccttcagtctttaaagtaaccccatggggtaagaaccatcatggtcttcactttagagaggaggcaactgaggcaaggagaagtatatccactcaccagaaccacacagtttgaatacttaagaattaggacgtgaatccaggcaagcaggctggctgcagtgctggtgtgtttagagtcgacactaaactatactggaaggaaggatatgagccaatagtcttcccagatataagaacatctgagctaagaaggggctcaaaggaccttgggcattcccttcttttagtaagggagaaactgaggcactgaatggtgatatgtcctgcctaaagccacgcagccagttagtggcagagccaggtctagactcctagtgcctgactcaccgctgttctctctaccctagcgactccaagtgcatcagcataggcattgccaggagctcatgaggaatgcagactgtcaggtcccaccccagacctactcaacagaaactacttggtaagcagattcccaggtggttccaggcaccttacagtttgaaaagcactgctgcatgctatcctaccttcctggtctgtaacatctgttgctgttgagtataaagacactgtgaacattgtaaaatc

SEQ ID NO: 417 - DNA, 130123 bp, Homo sapiens
gccggagttgcgtgggttttaatttaaagatgtaagtacaaatctatgtgcattgtagaaaattcggaaaaggtccaactgcctagcaagtaaaaagctgtcattccagcacgtggggggtgaccgcttctcccttcttgggtgttttttggtggattttttttggtgaccccgactggcctagactccattcaagggcacatcttgtgcagtaaaacacgcatgtttcagggctcctcactgcaacacgtgcacctccaggctggcgctcagcgctcccagtaaaagctgcaggcggcggtgtagatagtcgccggcctttcctcctccccacctcgtgacgctttgtgctgcggaagcaaaggcccgttccattccccgtgtcttcccagcagccgccaccaatgctcctttctaggaaacagccttccattctctcttagggccgatcttagcgagagccgcgatgcgggcgactggtgccggggtgggttgggggcgggggtgggaatcaggccccactgccaggagcccgggccgcgccttccgctctgacctcatccggccgcccaggcactgggcgcggcagcgaatcggcggcgcgggcggccgggaacgcccagcacaaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggtaagagagggcccgcgcgcagcctgcagcggccaggcgcgccggtcaccgccccaggcctgccccgcttggctctgtggtccccacccgccgaggccgcccccgcccgccgattccccgcacggccttccgcgccgccgccccggacgcccgcccggccgggatgcgactcgcgatgccgcacaagccgggcggcccccgcccgcctccagccggctcctcctggccgcatctccagggcggcggccgcgccacgggccgtttgggcgagaaagccaggcagggacggggcgggcggaggtcaatgcacagctccagagcccggcgaccggcgcccgtgggccgccccgcctcgggcctcgcccgagcatcccggagcctcagccccgtggtcctgcttagcctcctcgaggattcgggatcattacctcggcggttgtgctgcgctaaccaaagcccccagaggtggaggggaggtgcccagagccgcgcgagcccctcggtgggtgcccctgtgggaggaggttgcagagctaccgtcttcagtgcactgcttcggtttgggggagggcaggtgttgaaaggaagaacagataatactgtctacctctaacagtttactatgaagaaaagggaatcagtggtctgttgggcctgaaagcatcttacacaatagaggcaaagggttgtccttctagagcaccccctcttcttccaccaggtactgagtagatagatgcaggcccccagaggaagctggaggctggagatcatgaacaagctcatttcccataggaggtggggagggcagcctgaaggttactctgcagttctcttcggcagaatcggaagcagcaggctggcatttgtgcatgagctaagtgaggacaaggagtctaggttttcagccactgcacacaggctctgtggcctgcgaccggtcctatcctgcttgatgaactaccaggagtgagagctgctttctgttttggtagtgggttcctcacatttgggggttgggcatcacagactgaccttgggctcaagccaagtccaatagaagcaagttactttcctgtagatgttgacatctccaggaaggctgggcatatagcaagtcctgggtctatggcgattcttgactctcagtctcatcttctggcctggtcgagggcctctccttacctcaaggtcggttttgacttttccagagggggaacgtctttgggggagccctgcccctttgactttggctctgtggctgttctggtcccatcgactctggaggtggggaaagcggggcaaaaaaaaaaaaggaaataactggagacagacagcctgcatcaggttcctgaatcagctctgctgagtattggctgggaaacttgggctccatggtttgcaaagagcttatacctgtctcatcccacttggtttgcccaattccctgggaggttgatggtcggtagtgccacccttacctgtgtggaggaggaaatggcagttttgggagttgagtaactgtgtaaggtcatcctgctccaggagatccagggacagcccctgcccaagtcttctgactccagatccagtattcttcccacccctctcctgaataaaggaaaccttgatttaaatcttcccgtggaaggctggccttttatttacttcttcagggtggtgaatagccaatttatacatgttgtcttttttcacccagcttctaacagttactagattttttgttttttgagacagagtctcactctgtcacccgggctggagtgcagtggcccgatctcagctcactgcaacccctgcctcctgggctcaagtgattcttgggcctcagcctcccgagtagctgggactacaagagtgcgccaccacgcctggctaatttttgtgtttttagtagagatggggtttctccatgttggccaggctggtctcgaactcctgacctcaggtgatctgtgatctgccctcctcggcctcccaaagtgctgggattacaggtgtgaaccaccgcacccagctggaaaaagttcttgtgcctcagcctcctgagtagctgggactacaggcgtgcgccaccacgcccagctaatttttgtatttttagtagagatggggtttcatcatgttggccaggctggtcttgaactcctgacctcaggtgatcctcccgcctcagcctctcaaagtgctgggattacaggcgtgagccactgctcctagcctagttactagatttttgtatagctttagacacttccatacagtaagtgtgtgctttttgtttgtttgtttgtttgtttttgagacagtctcgctctgtcacccagactggaatgcaatggcacgatctcagctcactgcaacctctgcctcctgggttcaagcgattcttccacctcagcctcctgagttgctgggattataggtacccgccatcatgtctggctaatttttgtatttttagtagagacggggtttcaccatgttggccaggctggtcttgaactcctgacctcaggtgatctgcccgcctcggcctcccaaagtgctgggattacaggcgtgagccactgcgcctggcccgtgtgtgtgctttttcttacccactgtaaaccaagtctgctatctcaggttcacaattgcatattgtttctttattttttggagatggagtctcactctgtcacccaggctggagtgcggtgacacactctcggctaactgcaacctctgcctcctttgttcaagtgattctcctgtctcagcctcccgagtagctgggactacaggcgtgcaccaccgtgcccagctaatttttgtatttttagtagagatggggtttcaccatgttggccaggctagtctcgaactcctgaccttagatgatctgcccgcctcggcctcccaaagtgctgagaattacaggcatgagccaccgtgcctggccaattgcatattgtttctaagtggctgccttggccagacgactggtgaggaggatgcttggctgcccctgctcatgagtgagcaggtgagcctcaggtgcagagcgtgactgccaaaggagtaggcgggagtggtggtaggggtaggcctgtgaagagaaggctgtggttccatcggcttgactcagagaaaccgcaggacactggagagtgactgtactaggatggggagccctttaaggacatctgagctgacaccccaagttgaaagaggagcctcctggcctagcacagccaagcccatgaatttaacaatgctttactggacactgccaagaagcatagcaccaggagggaaacgtgtggaaaatgtggcccctgccttaaggggtcacagtctagcaggggtgagaacgtccaaattcccaccatcttagacacaatggtcacatgttctcagttcagacattgttgaagggataggggcttttttttctttcttttttttttttttttgagagggagtcttgccctgtcccccaggctagatgccatctcggctcactgcaacctctgccttcgaggttctactgattctcctgcctcagcctcctgagtagttgggattacacacgcccgccaccacgcccagctaatttttttgtatttttttagtagagatggagtttcaccatgttggtcaggctggtcacgaagggaacagaatttttaattgcatcaatttaaattcaggtgggtagccacctgtggctggtggctatcttttggggagtgcaatatgtagagaaatttaaacatcaatttactagtaggtctgtggggggcagggtgttcctaaaggaagctccaaggctttctggggactgtagccagctctggaataaccatgctgatggagggggaccttggcatggacaccacccagcaggcagataacttggcatgctttatttataggtagatgtgtgaaatctacaaggtttttttgtgttttctttgcttgccatgctcttagatgcagatctaccaggaagtttcctgagatcaggaattgtgttgtaccatgtggtaccatgaatgcctagaatagtgtctgaggtctagttgacaggtcaataaacagcagctgagtggctatgagtttcagtatgttatggggttagaattatttcccccaagggaaaagacaaagaggggctctacctttgtcttttttttttttttttcttgagacggagtctcactctgttgcccaggctggagtgcagtggcgcgatctcggctcactgcaagctccgcctcccgggttcacgccattctcctgcctcagcctcctgagtagctgggactacaggcatccgccaccacacccggctaatttttttttgtatttttattagagatggggtttcactgtgttagccaggatggtctcgatctcctgaccctgtggtcctcccaccttggcctcccaaagtgctgggattacgggcgtgagccaccgcacccggcctttttttttttttttttttaagagagtctcactctgtcacccaggctggagtgcagtgacaggatcttggctcactgcagcctctgcctccccagttcaagcaattctcctctcctcagcttcccgagtagctgggactacaggcacccaccaccacactcggctaatttttgtatttttagtagagacggggtttcactgtgtttgccaggctggtctcgaactcctgaccttaagtgatctgcccgcctcggcctcccaaagtgctggaattacaggtgtgagccactgcaccaggccgggctctgtctttggttttataatggaattaatgaaaagaaagaacctggccaggcgctgtggctcacgcctgtaatcccagcactttgggaggcccaggtgggcggatcacgaggtcaggagatggagaccattctggctaacacagtgaaaccccatctctactaaaaatacaaaaaattaggcgggcgtggcggtgtgcgcctgtagtcccagctgctggggaggctgcaggcaggagagtggcatgaacccgggaggcggagcttgcagtgagctgagatcccgccactgcactccagcctgggcgacagagtgagacttggtctcaaaaaaaaagaaaaaaaagttagctgggcgtagtggcgggtgcctgtaatcccagttacttgggaagctgaggcaggagaatcgcttgaacctgggaggcggaggttgcagtgagccgagattgtgccattgcactccagcctgagcaacaagagcaaaactccgtctcaaaaaaaaagaaaaaaaaaaaaacaaagaacctgatttacagaagccacactcagagcttgtattctggagcattccgcaaaatgatttacagtgctggctctcttgctgctgggatgtgtggaccctgggtgaagatgcagtctttgtaacccagagagcctgtgcgtggggaggcctttgtctacccactgtccaacctcacgctgtaagtgggccacttagcctggcattgccctggaattggcacctgcagctagctggctccccagttctggtcagaccagaagtggctttctcctgtgtgacccacctggcctgtgtagcctgcaccagggggtgaccccataggctgtcttgccatcccaccccttggcctctcactctcagagccctcctggggagggggatcaaggatgtgcctccccatccttggacccctgcatgggaataactggggaagtctgttacaaatatgggttttctgcatgtgaacagtacttcagcagagagtcaacaagatgaagattgaggagataatggggaaacttgaatagtcccttgataatgattttaaggaatcactgcttttttttttaaggtaggataattgttttgtagtttgcttttttaaaccagctttattgagatagatttagaatgcatacacaagaatatttgaaacgtacagtttgctgagttttgatgagtgtgcacactgagtagtggcgggcccagttgtgatgtcgaatatttccaaactcccaaaattcccctactgttggcccctggcaaaaagatctgctttcactcactcgctgtgcctcttctagaatttcgtgtcgatggaaccggatcgagctcagtgctgggcctcgctcctgtgtccccgtagccctgtattaccctgttccctgcacactgcagtttctcttcaccaggccacagagacttgggatcttgtgaatgaagttcacaaatgcagatttcaattcatttaggacagaaacgtgaagtcacttgctatttaatgatattaggaatttggatgatattttagatgagatctttgttttgtggtttttatttttatttgagacagggtctcgcttagttggccaggcaactaagtggtgcagtggtgcaatcatggttctctgcagccccaaccttctgggctcaagggattctcccacctcagcctctcgagtagctgggactacgagtgcacgcctctgtgcctggctaatgttaaaaagattttttgtagagacatgatctcactttgttgccgaggcaggtcttgaactcctgggctcaagtgatcttcccacctcggcctcccaaagtgctggaattgtgggcatgagtcaccatacccctcctttaggtttttcacaaggagcttttatctttgagaggaaatgcagacatatttacgatgtcgtactgggaaatccgggatttgctgcagaataacctggcatggggagcaggtgggagcagagaccagaggtgccctgagctgactgttttggggctgcttgatggggacataggggttcactccctcctccctctactcttgtaagcatttgatgtttaccacaatgaagaataaaaagaaaaccaggctcctgagcctccaccccagagctactgcctctaactccaggggcggggaaggtcagggaggggtaggcccaggaatctgcattttcctcggccctcctggagcttgagggccactgtcagaggagggccaggcacctgccgtgttgtgcggtgtgttggccttcctcggcttccccgcagccttccagctctcccggtgcctgtgagccaagacctctctgcccaggtggaactccgcccaggtggaactcattcttctacttgcctgagggccagcctgagtggtgcgaggtttaaggtcctggaggtgggaacccttatgagtgttgcttgtggccccacccagttcatcctctcccgcagaggggtggtggccctgtcctgtttccctgtctgtgagttcaggccgagtcatggattccttgcatcactggtcttttgtagagaacatcctgtgatccagttccggaagccgaggaggcggcttgccgggggctggtgggggaggggcggtcctaggaggagcaggagcctggtgctttctatcagggagggatcacaccggctcactgctgagccggccaggcagacacaggcttgggctctgctgggcatcatacttgtcactgggtaaacagtttgcccacttaccgcaggatgaagctgcttgccagggctctccggctctgtgagtttgggaggcaggcatcttccaggaggctggtggctggccagggatgtgtggggccccggcgagggtgctgcgctcccgtccaggtggttgggcccagggctgatctcccaccctgtggagcctgcattactggaaggtaggatgactgggaatattttgtgcccatggtgtctcacttgcgacgccgactgggcagccagggccttgggccgcataacttggaggagttttggggagggtagtagggtcgggtgttggatgagctgtgtgttttgctggattgaaagtgcccacttaagtggccaccctcagtggagacctggcatgttcttcccctagggacgagcggaacacccgggctttgttggaggaggtgacctggcaaccctgggctgtgggaatctgggcctctgcagatcaaggctcctgcaagccagcagctgtgctggctcacagctggcagctggcatccgtgccctgctttgtccctaggctggatgttgagctgtgattttagaccagaaggttggtgcagggccagagggagctgttcctgcacgattggctgatcctaacagtgcagtgttgagctgcttacagatggcttttgcatactttatttctcctaaactttacagaaactctgttgagtgggcatacatacctccccctttgtgccagctttattgggttatagttcacatgccatacaattcattcactaatgtgtacaagctagtagatttcagttttatgttcacagagctgtgggatcatgacctccatcaattttgaaaggggtggtaggaggattttttgttctcctgacatggagctccccaagcccttgggacctttgtagtcctaagagtgtctagtatgctaatgagagaactggtggctgggggccctagatatagcttcaggatgggagctggtctccagaaaggccaagggaggattagcgggttagcgctttcaaccttaccttcctataccgcagaaggtagtgccagactttacttgaattgtaggacacccacctagtgtcggagagttggagaagtggggttgaaagagacacccatgtttgttattaaaagcatgagtaaaaacagctcgcctaggaatataatttttgggtcatatggtaattttgtggttattctcttgaggaattaccagactgtttccaaagtggctgcaccatttcacattcccaccagcagtgtaaaaaggattcaatttccccatatccttgtcagcacttgttattatccatcttttgaattctagccatgctagtagatgtgcagtggtatctcactgtggctttgatctacatttccctaatgagagaagatgatactgagcatcttctcatgtgcttattgaccactgtgtatttttagagagctgtctagtcaggtctttcctgtattttccaattggtgtaattgtctttttgttgttgagtgatgagagctctttatatattctagatgcaagtcccttctcagataaaattttttaattaagaaaattttccaattcaaaaaagttgtcagcctgggcaacatagcaagatctgatctctattaaagattaaaaaattagccagatgttggctgggcgtggtggctcacacctgtaatcccagcactttgggaggccgaggcgggcggatcacgaggtcaggggatcgagaccattctagctaacacagggaaaccccatctttaccaaaaatacaaaaaattagccgagtgtggtggcgggcgcctgtagtcccagctacttgggatgctgaggcaggagaatggcttgaacccgggaggcggagcttacagtgagccaagatcgtgccactgcactccagcctgggccacggagcaagactccgtctcaaaagaaaaaaaaattagccagatgcagggtaggtggggtgtgcctgtagtctcaaccactcaggagattgaggcaggaagattgcttgaacccaggaagttgaggctgtagtgagcttattgcaccactgcaatccagcctggacaacagatcaagactcttgtctctcaaaaaaaaaaaaactgtgttaaaatacacataatatataatttaccgttaaaaaaatctgccatcaggccgggcgcggtgactcacgcctgtaatcccagaactttgggaggctgaggcggatggatcacgaggtcaggagatcgagaccatcctggctaacaaggtgaaaccccgtctctactaaaaatacaaaaaattagccaggcgtcatggtgggcgcctgtagtctcagctacttgggaggctgaggcaggagaatggcatgaacccgggaggcggagcttgcagtgagctgagattgcgccactacactccagcctgggcaacagagcaagactccgtctcaaaaaaaaaaaaaaaatctgccatcttagccgggcatggtggctcacacctgtattcccaccactttgggaggccaagctgggtggatcacctgaggtcaggagttggagaccagcctggccaacatggtgaaaccccgtctctactacaaatacgaaaaatagctgggcgtggtagcccacgcctgtagtcccagctacttgggaaactgaggcaggagaatcacttgaacctgggaggcggaggttgcagtgatccaagatcgtgacattgcactccaacctgggtgacaagagcgaaactctgtccaaaaacaaaaaaaaaacaaaaaaactgccatcttaatgatatgtgtatatgtatatggttaagatggcaggttttgttttgttttttaaattgagacagggtgttactctgtcttctggggcgcatgtggtggtgcagtctcggtcactgagcctctacctcaagtgatcctcctgcctcagccacccgagtagctgggaccacaggcatgtgctaccatacctgggtaatttttgtagtttttgtagagacaggatttcgccatgttggccaggctggtcccaaactcctgagctcaagggatctgcccatctccgtctgcctcctaaagtgctgggattacaggtgtgagtcacagcgcctggctaccatatacgtatttgtagccatattttcttgctctgtcacccactacgtctcactatgtttcccaggctcattttaatcatttttaaatgtccagctcagtttttttgttttgttttttgtttttgagacagagtctcgctctgtcgcccaggctggagtgcggtggcacaatctcggctcactgcaagctccgcctcccggattcaagcgattcttctgcctcagccccccgcgtagctgggactacaggtgcccgccaccacgcccagctaatttttgtatttttagtagagacggggtttccccatgttggctagaatggtcttgacctcgtgatccgcctgcctcggcctcccaaagtgttgggattacacgcgtgagccaccgcgcccggccaagtcttgcactttcgcccaggctggagtgcagtggcgcaatcttggctcactgcaagctccgcctcccgggttcatgccattctcctgcctcagcctcctgagtagctgggactacaggcgcccaccatcacgcccagctaattttttttttgtatttttagtagagatggggtttcaccgtgttagccaggatggtctcgatctcctgacctcatgatccacctgcctcggcctcccaaagtgctgggattacaggcgtgagccaccgcgcccggctcattcccttccttttaaagactgaatcatgttccatttcatggatggaccacattttgcttattccatcatctgtggatggacacttgggttaatcccacattttagcttgtgaataatgctgctatgaacacagcagagaccccgtttttagttctttaggatatattcccagaagtggaattgctggatcatatggcaattctattttaaatctttaaagaaacgaccatactgttttccacagcggctatgccattttacatttccaccgacagtgtacatgggttctggtttctgggcatccttgtcaatacttgttattttctgtttttttttgatagttgccatcctaatgggtgtgaagtggtgtttcattgtggttttgctttgcatttccctaatgtttagtgatgttgaatgtcttttcatgtgtttatttgtcaactgtattttttctttgtagaaatgtctactcaagttgtttgctgatttttgaatcaggttttttttaaaactgaaaattaaatatattgctaaactgtttgtatatttattcatatacttgaacatagacatgtataggtgtatatattatgtgcatgttatatacatatccttgtgtatctatataagtatccatgtatatatttttcaaattttcatcagtattctgaaactgaagactatagcttttggtgtttgagaaagtccgtgtccatttttgcttctattgtttttgacacataataattgtacatatttatgggtatagtgtggtattttgatacatgaatgcaatgtgtatggttggtttttttattgttgcgttttaggagttctctatatattctggacactaatccctcatcagatatatgatttgcaaataatttctcccattctgtgggatgtgtttatactctgttgatattgtctgttgatgcacacattttaaagttcttatgacatacaatttgtctgttttcttttgttccttgtgcctttgatgtcatagccaagaaatcatcaccaaatccaatgttgtaaagctttagccttatgttttcttctaagagttttatagttttaggttttacttttcggcttatgatccattttgagtttttttttttttttgtatatgctattaggtaaaggtgcaactcattcttttgtgtgtaaatatccagttccttagcaccatttgttgaaaagattgtctttccccattgagaggtcgtcttcttgttttttttttttttttgagacggtcttgctctgttgcccaggctggagtgcagtggcgtgatctcagctcattacaaccttcgcctcctgggttcaagcctcagcctcctgagtagctgggattacaggcacatgccaccatgcctggctaatttttgtatttttagtagagacggggggtttcaccatgtcggtcaggctggtcttgaactcctgacctcgtgatcctcccacctcagcctcccaacatgctgggattacaggggcgagccaccacacccggccgaaaggtgtttatacccttgtcacatagatcatttgaccatatatatcatttgagtttatttctgggctctctgttctattgattcttatatctgtctttatgctaatgccatactgttttgattattgtagctttgtggtaagttttgaaatcagaaagtgtgaatcttccagctttgttctttttcatgattgtttggctatttccgatgtgatttgcaaatatttttttccactcactgggttgtctttttactttttctttgctgtgatgcccaggctagagtgcagtggcatgatctcagttcactgcaacctccgcctcctgggttcaagtgattcccctgcctcaacttcccaaggagctaggactacaggtgtgcaccaccacacctggctaatttttgtattttttttccagcagagacagagtttcaacacgttggccaggctagtcttgaactcctgacctcaagtgatatgcccacctcagtctctcaaattgctgggattataggccaccacacctggcctattttctttaaagagttttataggatagatgctgtggctcacatctgtaatcccagcactttgggaggtcgaagtgggaagactgcttgagctcaggagttcaagaccagcctgagcaacataggaagaccccatctctacaaattaaaaaagttagccaggtgtggtggtgcatgcctgtagtaccagctacttgggaggctgaggtgagaggattgcttgagcctgggaagtcaaggctgcagtgaagtgagttagagaccacagcactgcactggggcctgggtgacggagtgagaccctgtctcaaaaaaaaaaagttacatagctttagctcttaccatttaggtgtttgacctatcttgagttaattgttatgtgtgatgtgcggtaggggtccagctccatttgcacgtgtggacacacctctttataggctggggagcaggcattagaggtggagctacttgcttgccgtcacagctggcaagtggaggccaaagacagccgctgcatcctttctttgaactcttatacctgagggtcatttatctctgacctggaggacagaaacagaaagcccttgagcaggctgagcgcagtggctcacgcctgtaatcccagctctttgggagaccgaggtgggcggatcatgaagtcaggagatcgggaccatcctggctaacacggtgaaacccctctctactaaaaatacaaaatattagccaggcgtgatggcgggcgcctgtagtcccagctacttgggaggctgaggcaggagaatggtgtgaacccgggaggcggagcttgcagtgagccgagattgcgccactgcactccagcctgggcaacagagcaagactccgtctcaaagaaaaaaaaaagtccttgagcaataataaaactaggactctagggacattacttctcaggggcaggccacgccgtgcacctgtccacatctgtttccctccccttgctgaacaccagcccctgccctcgccagcctttctgtcctccttccctcctcctccccctaaatgttcatctgtggcttttgcctgtcccatggcacatgataggctctcgctgtctgggcctccctgggggtaggtccccacaggagaccttaccagggccatgccagacagctcagatgtctctgtgccctgccttgaatcctttggcctcagggctggaggttcagctatggcaggtcaggggctggcagctgagctgtgtgaggctgggagcttctctgagccttgggagagtaaaggaaaccaagtccctgattcaggagggccagagcattcctcttgctggctgtgtgcccatgagcccgggactgggagaaggcccaacggtacctgcccccatgggacttgttggctgggacctgggaaggcccgtggtctgtgtgctttgctgtaaaatgtatcactgggggactggaccatctgccgcagtctggcgctatcgaggagcaccccggccaccagcagagggcatgctgatcatagacactgcccctccctccctcccctcccgacaatctccaggccaccagttccagtcttaccttgagccactacctctcgggcacccagggctgctctggtggaattaatttgaacagtggtggcattgtagcgagtggatgctttggccttgtaactggtgccgttgtttgtttgtttgtttgtttgtttgttttgacgagtcttgctctgtcgcccaggctggagtgcagtggtgcgatctgggctcactgcaagctccacctcccaggttcacgccattcacctgcctcagcctcccgagtagctgggactacaggcgcctgccaccacacctggctaattttttgtatttttagtagagacggggtttcaccattttagccaggattgtcttgatctcctgaccttgtgatccgtccgcctaggcttaccaaagtgctgggattacaggcgtgagccaccgcacctggccattgtttacagtaagtgccaaactttgatgtttgtgtgtttctttgctgttttgttgctgtgttcactcaggtgtcgcttgtatttagaactcagcttttacaatggaattgcttttgatactacactttggtgtctcaggaaactacatcctgcatgattgatactctgtgcttcctttaatgacaggcaaatctcaccttgtcttgtaccttataaaagccaggctcttagaagtggtgacactcataaaccagcctgaagttgctgaattgacccatgttatctgacacctattaagattctactaagattcttaattcacccatatccagcttgaatttttacttgattttgcatttaattgcttccatgtacctactaagtttttacataatgtatttttttattatttaaatagagatggagtctcgctatgttgtccaggctggtctcgaactcttgggctcaagtgatcttcccgcctcagcctcccaaagtgctaggattataagcgtgagctaccacacttggcctttacatgtatttttttaatgtctttaatggaatataggattgatttaattgaagagtacatttagctttgtacaaaactgccaaactgtcttccaaagtggctgtgccattttgcattctcaccaacagtgaatgagggctcctgtgctccacatcctcaccagcatttgatgttgtcagtactttgggtttaggccattctgacaggcatgtagtggtgtctcagtgttgttttaatttgcagtttccaaatgacataaggtgttgagcatcttttcatgtgcgtatttgctgtctgtatatcctcttatatcaggcatctgttcgggtctttggccctctgccgccaccctcccaccttattattatttatttttattttttattttttagacagagtctcactctgtcgccatgttcgctctgcctcccaggttcacgccattctcctgcctcagcctcccgagtagctgggactacaggtgcccaccaccacgcccagctaatttttttttttttttttttgggatggagttttactcttgttgcccaggctggagtgcaatagtgccatctcggctcactgcaacctccgcctcccaggttcaagctattctcctgcctcagcctcccaagtagctgggattataggcacatggcaccacgccatgctaatttttgtattttttgtagagatgggattttgccatgttggctaggctggtctcgatctcctgacctcgtgatccacccgcctcagcctcccaaagtgctgggattacatgcatgagccaccgcgcctggcccctcccaccttatttttaaagagtcttgctctgtcaccgaggctggaaagcggtggtacaatcacggctcactgtagcttcaacctcctgggctcaggtgatcttcctacctcagcctccctagtagccttgactacaggtgcaccctactgtgcctggctaatttttttgttggtttgtttttgttttagaccaagtttcttgctgtttttcctcaggctggagtgcactggcgccatctcagctcactgcaacctcctgactcccaggttcaagtgattctcctgcctcagcctcctgagtacctgggattaaaggcgcctgccaccacgcatggctaatttttgtacttttaatagagacagggtttcaccatgttggccaggctggtctcgaacttctgaactcaagtgatccgcctgccttggcctcccaaaatgctgggattacaggcgtgagccactgcgcccagcacctggctaatttaaaaaaattttttttttttttttgaggtggagtctcgctctgttgcccatgctggagtgcagtggcacaatctcggctcactgcaagctccacctcccgggttcatgccattcttctgtctcggcctcccgagcagctgggactacaggtgcccgccaccacgcccggctaattttttttgtatttttagtagagacggggtttcaccgtgttaaccaggatggtcttgatctcctgacctcgtgatccacccgccttggcctcccaaagtgctgggattacaggcgtgagccactgcgcccggcctaaaaagtttttttgtagagacagggtctccctatgttgcccaagctgatcttgaactcctgggttcaagcgatccttctggcttagcctcccaaagggctggaattaatctccaagcagggattgcaggcatgtgccaccacacccagctaatttttggggtttctctacgttggccagactggtctctaactcctggcctcaagtgatccgcccgcgtctacctcccaaagtgctgggattataggcatgagtcaccgcgcctggcctcttattgttgagttttaagatttctttgtatattttagatacaagttgtttatcggatatatgttttgtaaacattttcctcagtctgtggcttgtctccattatctttttttttttttttttgagaggagtctcgctctgtcgcccaggctggagtgcagtggcgcgatcttggctcactgcaagctccgcctcctgggttcccgccattctcctgcctcagcctcctacaggcgcccgccaccacgcccggctaattttttgtatttttagtagagacggggcttcacagtgttagccaggatggtctctatctcctgatcttgtgatccgcccgcctcggcctcccaaagtgctgggattacaggtgtgagccaccgcgcccggcctgtctccattatcttaacagtgtctttctcagagctgaaatctttaaatcaataaagtgggaacttcagccatgtaactgatcaggatgaacaggggaagccatcgttttcagcagatgccaaacttggtttttctcctctgactcttgacgtggttgttcccttcaactggccgagacctaggggctcactgatgccggggtttgtcctaggttagacggggagtctgtggaatagtgtagggtgtcccagccacggagaactctcagcttggcagtttaccctccatttacaggtgaagacactgaggccctccaggcgcagtgacctaggggtgtgtggcaggtggggcagggaccccagtagagtgcagacctcacctccttggccatttccacctgcccctcatccaccatgtggcctgcaggtggtgcgtggcaggttgtggtgcttgatctccaggatgttgggcaaggcagagtccttggcccccacgctgtggagctcagcttctccccacaggccccaagcctgtgtgttcagggcatcctccttgacatttggagagtgagactcagggtggccgtactgacccactggccccatactctggaagtacttagggcctgctggtctgcccactgagggacatgccttcagtccccatgggcctgtgggagggctttaaccagtgcctggctgggcagggctcttagtcttagtgactccctaactggagctcccagggccatttggccacctccctcccgcctctgtttgggctgagggacgtgggcgcagctgccagcatggggaccaggcctctgtcctcaggtgacttcatcgcacctgctgccaccttcccttgcagaaattggcagaattccaggaaacttgcccagagtaagtgcctcaagtagaaacaagcccaatgcatttgccatggatatttaattctctaaaaggcagaggtgggaggtgaaagagatacttatttaaacagagttatacaggaataatttctataactgcacatatggaaagtattcagtttgatcagttttgacctaggtacagacagacttcctttcattgcactttgcaggtcctgcatttttttttttttttttaagatggagtttagcttttgttgcccaggctggagtgcaatggcacgatctcggctcactgcaacctctccctcctggattcaagcgattctcctgcctcagcctcctgaagggctgggattacaggcgcctgccactgtgcccagctaatttttgtatttttagtagagacggggtttcaccatgttggtcaggctggtctcaaactcctggcctcaggtgatccacccaccttggcctctcaaagtgctgggattataggcgtgagccactgctcccagccaggtcctgccttctttacaaattgaaagtttggggcaggcgtggtggctcaggcctgtaatctcagcactttgggaggccgaggcaggcggatcacctgaggtcaggagttcgagaccagcctggccaacatggcgaaaccccatctctactaaaaatataaaaaattagctgggtgtggtggcatgtgccgtagtcacagctacatgggaagctgaggcaggagaatcacttgaacctgggaggcagaggttgcagtgagctgggatcatgccactacactctagcctgggcaacagagcgagactccttctcaaaaaaaaaaaagtttgtggcaaccctgcattgagcaagtctattggcaccatttttcggccagcctgtgctcatgtagtgtgtctatatcatattttggtaattcttgcaatatttcaaactttttcgttatcatttttgttatggtgatctatgaccagtaatttttggtgttactagtgtaattgttttgagacatcacgaaccacgtccatgtaagacagcaaatgaaattgataaatgttgtatgtgttctgactgccccactgaccggctatttccccatctctctcccttttcgtgagctccctcattccctgagacacaacaattttgaaattagaccaattaataccctacctctagtgttccagtgaaggagagagtcacacatctctcactttaagccaaaagccggaggccaggcacggtggcacatgcctataattccagcactttgggaggctgaggcggttggatcacttgaggccaggagttcgagaccagcctggccaacatagtgaaacgccatctctactaaaaatacaaaaaactagccaggtgtgttgacatacgcctgtagtctcagctactcagaggatgaggcagaagaacctcttgaacccagaggtggaggttgcagtgagtcaagatcgtgccactgcactccaacctgggcgacagagcgagactctcaaaaaaaaaaaaaaaaaagccaaaagttagacatgattaaacttaggaaggcatgttgaaagctgagataggctgaaagctaggcctcgtgtgccaaacagttagccaagttgtgaatgcaaaggaaaagtccttcgaaggaaattacaagtgctgctccagtgaacacatgaatgataagaaagcaaaacagccttcttgctgataacggagaagaagaattttagtgatttggagagaagatgaaatcagccacaacattcccttaagccaaagcctaatccagagcaaggccgtaactctcttcaattctatgaaggctgagagaggtgaggaagctgcagaggaaaagcgtgaagctaacagaggttggttcatgaggttgaaggaaagaagccacctccataacatgaaagtacaaggtagagcagcaggtgctgctggagaagctgcagcaggttatccgaatctggctgagatcaccggtgagggtggctacacaataggttttttcttttttttttttttgacacagagttttgctctgtcgcccagggtggagtgcagtggtgcaatctcggctcactgcaacctccacctctcaggttcaagagattcttctgccacagcctcccgagtagctgggtctacaggtgcacgttaccacacctggctaatttttttatttttagaagagacaggatttcactatgttggccaggctggtctcgaactcctgacctcaaatgatctgcctgtctcagcctcccaaaatgctgagattacaggcgtgagcccctatgccctgcctaggttttcagtgtgggtgaaacagctttctgttgaaagaagataacatctaggactttcatagctagggaggaaaagtcaatgcctggcttccaaggacaggctaggtctggtgactcacgctgtaatcccagcactttgggaggctgaggcgggtggatcacttgaggtcaggagtttgagaccagcctggccaacatggcaaaaccctgtctctactaaaaatacaaaaattagctgagtgtggtggcacttgcctgtagtcccagctactcaggaggctgaggcaggagaatcgcttgagcccaggaagtagaggttgcagtgagccaagattgcacctgccacagcactccagcctgggtgacagagtgagattctgtctcaaaaaaaaaaaaaaggacaggctgactctcttgttaggggcttatacagctggtgactttaagttgaagccaatgctcatttactattctgaaaatcctagggcccttatgaattatgctaaatttactctgcctgtgttctataaatggaacaacaaatcctggatgtcagcacatctgtttatagcatagttttctgaatatttttaagcctgccgttgagacctactgctcagaaaaaagatttctttcaaaataatactgatcaggccgggtgcggtggctcacgcctgtaatcccagcactttgggaggctgaggcaagtggatcacgaggtcaggagttcaagaccagcctggccaagatggcgaaaccctgtctctactaaaaatataaaaattagccaggcgcagtggcaggcgcctataatcccagctactcaggaggctgaggtaggagaatcacttgaactcaggtggcagaggttgcagtgagccgagatcgcaccactgcactccagcctgggcaatagagtgagactctgtctcaaaagaaaaaaaaaaatcaaaataatactaatcattggctgtgcgtggtgactcatgcctgtaatcccagcactgtgggaggccaaggtggttggattacctgaggtcaggagctcgagaccagcctggccaacatggtgaaaccccatctctactaaaaaatatacaaaaattagttgggcatggtggtgcatgcctgtaatcccagctacttgggaggctgaggcaggagaatcacttgaaccagggaggcggaggctgcagtgagctgagatcgcaccactgcactccaggccaggtgacagaacgagactccatttcaaataataataataataataataataataataataataataataataatactaacactgctcattgacaatagacctgataaaccaagagctctgatggagatgcacaaggagattaattttgttttcgtgcctgctggctttagtccatttgtgtggctgtaaaggaatgcccgaagctgggtaatttatgaaggaaagagctttatttggctcatggttctgcaagctgtacaggaagcatggcaccagcatcttcttctggcgagggactcaggccacttctacttacagcagaaggggaagggaagctggtgtgtgcaggtcacatggccagagaagtgagagagaagggaggtgccaggctccttttaactattagttctcccagaggctaataaagtgagaactcactcatgaccacgaggatggcaccatgcccttccagagggatccatcctgtgacccaaacacttcctattaggtcctgcctccaacattgggattgaatttcaacatgaggttagggatcctcatatccaaaccatagtggataatagcacctattaactcaacatccattctgcaacctatggatcaaggagtaatcttgactttcaagttgtattgtttaagaaatgcattttgggcctgtaatcctaacactttgggaggctgaggcaggtggattgcctttgttcaggagtttgagactagcctgggcaacatgttgaaatcctgtctctacaaaaaatacaaaaaattagccgggcgtggtggtgggcgcctgtagtccaagatacttgggaggctgaggcaggagaatggcatgaacctggaaggcggagcttgcagtgagctgagatcgtgccactgcactccagcctgggcgatacagcgagactccatctccaaaaaaaaagaaaaaaaagaaattagctggacatggcaacatgtgcatgtagtcccagctactcaggaggctgaggcaggagaattgcttgaacccaggaggtggaggttgcagtgagctgagattgtgccattgcactccagcctgggcgacagagtgagcctccttctctacaaaaaaaaaaaaaaaaaaaaaaagaaatgcattttgtggggctctggctgccatagtggttcttctgatctgggcaatgtaaattgaaaaatttacattggaaagcattcactattctagaagccattaagaatatttatagaccaggcgaggtggctcacgcctgtaatcccaacactttgggaggtcaaagtgggtggatcacctgaggtcaggtgttcgagaccagcctggccaacatggtgaaacctcgtctctactaatacaaaacgtagctagatgtggtggcatgtgtgtgtaatcccagctactcaggaggctgagtcacaagaattgctttaacctaggaagtggagaggttgcagtgagccaagattgtgccattgcactccagcctgggcaacagagcaaaaaagaaaaaaaaagaaagtggtttcttaagatggaatgtagtcttggggaagatgccatgaacattgctgaaatgacaagaaagtaatggcaatggtgggccatctggagcaacccctgccctcacgccaggtgcagtggggtggtgcaagcagtggtggcaggagcagctgtgggagcagcagtggcagcagcagtggcagcagtgggtcccctgtgccctgcattccccgggcagctgactgcaccgcccccatccttgcacagccaggcaggacctgctcccaggcctggagccttgccgctccagaccctggctcagtgtcagagctcttacccgctctcactgtggggaggggtgtgcagaggaaatagtcagtccctggagtctacccctgggagtctcccagagcccactgccctgggagccaccacaacggggccaggctgagttgcctgctggtggggaagcagcatgattgggcatggaggtgcgggcagagaggggccccaaggtggagctgggcctggggtgatgctgcacctgcatatggagtgtgggggctgggcctgggatgcagagcttgggttatgcttcagggccctggggcgggaagtgggagcggcattcactttggggacctggactgcggtgcagccaccgcacccaccctgctgatggtgcccttcagactttgggcaccaacaggcatgggagggaggccaagtgggggctgaggataggctggcacaaacagcctggatgccatgaacagtggcgagagacagacaggctcctgggtagaaggggtctggtccccagtgaagcctcaccttcaaactggggagggcctgaagcctgggggttggctggccagtcccgaggaccagaggggaagcttgtggtgctttttgctggcccacccatggaccagtcaacacacacttcctccactctgaggcccataaaaaccccggactcagccagactagagcagaggacagaaagatgacaggatgaccagctgcaaagaagagctaccctctctgctgagagctgaacactcactgggatgacctggctgtgactcaataaagctcctctttgtcttgctcactctccatttttctgcgtacctcattcttcctggtcacagggcaagaactcgggacctgccaaatggtgaggctgaaagaactgtaacacaaacagggctgaaacatgccccttcttgccacgttgccagtgaagggaaggaaagaagagctgtggccctttggggagtccagacctgggagctccctgagtcagggttgtgactccctctttggggccctgcagttcctggcgtcaccaagcttccaggcaccacagcattcccgtgtgccaaccaggcaagctgcttgaggtgcgcttggtccaggtgcagccttgcagagaaccagcacctgtgccagcatctggagctgcctgccctgcagcagcagctggcatgtctgactgtgcagtggccgtactccatgctcactcacacactgctcgctgctccacaccaggcttgtccttggcaggcatgggagctccaggctggtagcatgagccaagcgcagcctgccaggctgagtgggtggaataagcccagtgggccccagcaaaacttaggcaaaggtgccacaagacacagaggtttctggccagaaaagggataccccaaagatcccataacaaaaggatttagaatattccataaacttagttgataaaacaacataggttttaagaggactgactccacttttttttttttttttgaaatggagtctcgctctgtcgcccaggctggagtgcagtggtgcgatctcagctcactgcaagctctgccttctgggttcacgcaattctcttgcctcagcctcccgagtagctgggactacaggtgcctgccaccatgcccagctaatttttttatatttttagtagagaaggggtttcaccatgttagccatcatggtctccatctcctgacctcgtgatccgcctgcctcggcctcccaaagtgctgggattacaggcatgagccaccgcgcccggcctgactccacttttgaaagttctactgggctggtctaggagatcgagaccatcttggctgacatgttctccccatctctactaaaatacaaaaaattagcctggtgtggtggtgcacacctgtagtcccagctactcaggaggctgagccaggggaatcacttgaactcgggagacggaggttgcagtgagccgagatcatgccactgtactccagcctggctgacagagtgagactctgtctcaaaaaaaaaaaaaagtaagttctactgtgggtaaaatgctatcaaacattgcatgctacagagaaatctttttttttttttttatttgagataggctcccactctgtcacccgggctggagtgcagtggtgcaatcacagctcactgcagctttgacctcttgagctgaagggatcctcccacccttagcctctcaagtaactgggaccacaggcaagtgccaccatgagtagctaattttttaatttttatttttagagacagcatctccttatattgcccaggctggtctggaactcctgggcacaagcgattctcccacctcggggtcccaaagtgctgggattacagacatgagccaccgtgcctggcccagagaaatattttgtggaaagaagggtcaattgatgtggtcaatgtcattgttgtcttattttaaggaactgccacagccatcccagccttcagcagtcgccatcctaatcagtctgcaggccgggcggtaatcccagcactttgggaggctgaggtgggcggatcacctgaggtcaggagttcaagaccagcatggccaacatagtgagaccctgtctctactaaaaatacaaaaaattagctgggcgtggtgacgcgtgcctgtaatcctagctacttgggaggctgaggtaggagaaccacttgaacccgggaggcagaggttgcagtgagccaagatcgtgccactgcattccagcctgggctatagaatgagactgtctcaaaaaaaaaaaataaaccccaaaacaatatgaatcagtctgcagccatcaacatcgaggcaagactctgccagcaaaaagaataccactcactgaaggctcagatgattgttagcattttttagcaataaattttttttttttttttgagatggggtcttgctctgttgcccaggctggagtgcagtggtgcgatctcggctcactgcaagctccgcctcccgggtttacgccattcttctgcctcagcctcccgagtagctgggactacaggcgcccactaccatgccgggctaattttttgttttttagtagagatggggtttcaccgtgttagccaggatggtctcgatctcctgaccttgtgatccacccaccttggcctcccaaagtgctgggattacaggtgtgagccaccatgcccgattgcaataaagtgtttttaaatgaaggtatatacttttttttaaggcataatgctattatacacttaatagactacagtgtaacttttacgtgcactgggaaaccaaaaaaatcatgtgacttattataaagtgcaatgtgtgctttgttgcggtgatctggaaccaaacccgtaatatctctgaggtatgcctgtgtgagcctgtgaagccttcaccacaatcaagaccgagactgtgaacagacctgtcaccctgctgaggccctctgcttctctggtccctccctgcccccaggcaacctctgatctgctttctgtcactatagtttgtgtttcctccaagtttataaacatggacttgcacagttctctttttgtccagcctcccttgctcagcacgattacttggagattcatccacatggttgcatgtatcagttattcattcctttcctttttttttttgagacggagtctcactcttgttgctcaggctggagtgcagtggggcgatctcagctcactgcaacctctgcctcccgggtttaagcgattctgcttcctcagcctcctgagtacctgggattacaggctcccaccaccatgcctggctaatttttttttttttttttttttttttttgagatggagtctcgctctgtccccaggccggagtgcagtggcgtgatcttggctcactgcaacctccgcctcccgggttcaagtgattctcctgcctcagcctcccgagtagctgggactacaggtgagcgcaaccacgcccaactaatttttgtatttttagtagggatgaggtttcaccatgttggccaggatagtctcgatttcttgacctcgtgatctgcccacctcggcctcccaaagtgctgggattacaggcgtgagccactgcgccaggccaaatgctgggcttttttttttttttgagacagagtctcttgctctgtcaccctggctggagtgcaatggcatgatcttggctcactgcaacttctgcctcccggcttcaagggattctcctgcctcagcctcccgagtagctgggattacatgcatgcaccatcacgcccagctaattttgtatttttagtagagatggggtttttccatgttggtcaggctggtcttgaacgcccgacctcaggtgatccacctgccttggcctcccaaagtgctgggattacaggtgtgagccaccacacctcgccgataattgcttttagatgttacttttgtattttcctaatgtctaatgatgttgaatatcttttctttttttctagaggtggagtctcgtcttgttgcccaggccggcctggaattcctgggctcaagtgatcctcctgcctcagcctcccaaagtggtgggattacaggtgtgagtcactgcatctagccttttttgagacaaggtctcgctctgtcatccaggctggaattcaatcttggcccactgcagccttgacctcccagctcaagtgatcctaccacctcagccccctgagtagctgggaccacaggtgcagctgggaccccctgagtagctgggaccacagaaaacccacagggtcggtggcttttctccccatgtggggagatgagagattgtagaaataaagacacaagacaaagagataaaagacagctgggcccgggggacaactaccaccaagatgcagagaccggtagtgtccccgaatgcctggctgtgctgttatttattggatacaaggcaaaaggggaggggtaaagagtgtgaatcatctccaatgataggtaaggtcacgtgggtcacatgtgcactggacagggggcccttccctgcctggcagccaaggcagagagagagggagagagagagagacagcttacgccattatttctgcatatcagggacttttagtactttcactaatttgctactgttatctaaaaggcagagccaggtgtgcaggatggaacatgaaagtggactaggagcgtgaccactgaagcacagcatcacagggagacaggcctccggataactgcgggcaggcctgactgatgtcaggccctccacaagaggtggaggagtagtcttctctaaactccccgggggaaagggagactccctttcctggtctgctaagtggcgggtgtttttctttggcactgacgctactgctggaaccacggtctgcctggcaacgggcgtcttcccagacgctggcgttaccgctagaccaaggagccctctggtggccctgtccgggcataacagaaggctcgcacttgtcttctggtcacttctcaccatgtcccctcagctcccatctctgtatagcctggtttttcctaggttatgattatagagcgaggattattataatattggaataaagagtaattgctacaaattaatgattaatgatattcatatataatcacgtctatgatctagatctagtataattcttactgttttatatattttattatactggaaaagctcatgcccttggtctcttgcctcggcacctggatggcttgccacccgcagtgctcaccaccatgctcggctaatttttttggatttttggtagagatggggtctcaccatgttgcctagaagagtctccagctcctgagctctagccatctgcccacctcagcctcccaaagtgctgggattacaggcgtgcacgaccgcgcctagccaaaggtcatttgtttttttcacattgagctctgagagatctttctggagcctggatgtaagtttctgaccctaccagcttcctctagcatgaggcagtgagtttcggttggggagagggatgtggcctcccattctagggcatgtcgttgcggagttctccttgaattctctcttccgagtgccctctgatgagctgggctcagtgtgcttttgagttctaggtgcctgtctcatttcctaccttctttctatatgcttggctgcctgggtaggtatgggagggatgggggaagaggtgctgccatctcttgacttttttttttcttttttttttttgagacggagtttcactctgtcacacaggctggagtgcaatggcacaatcttggcccactgcaacctctgcctcctgggttcaagcgattctcttgccttagcctcccaagtagctggcattacaggcgcccaccaccatgcccggctaatttttgtagttttagtagagacagagttttgccatgttggccaggctggtctcagactcctgacctcaggtgatccgcccgccttggcctcccaaagtgctgggattacaggcgtgagccaccatgcccagcccacctcttgactttttagcttccagatgcctttgaaagctgcagaaaactgggtcttttccccagaaaagtagaaaccagacacaacctcgagcatgtttttagggatgctcacagcctactgagccagttctactttgttttgggttagagatggatgccacatctgcagatctctgccaagctgtgtgtgtttttctttagattttgggagtgcctttctgtggcaaaggtaagagcgtttcgagggctcctgccatgtgtcacccacatggccagtgcttatgtagggaggggccacagcttctggcatccagttgttagtagtttatttatttatttatttttacagagtcccgctctgttgcccaggctggaatgcagtaacgcagtgacgtgatcttggctcactgcaacctccgcctcctgggttcaggtgattctcctgcctcaccttccctggtagctgggattgcaggagcacaccaccatgcctggttaactttcttttcactagtggtggggttccaccgtgttggccaggctggtgtcaaaactcctcacctcagatgatccgcctgcctcggcctcccaaggggctgggattacaggcgtgaactactccaccctgccttgtttgtagtttataacagctttcctgagctataactctattgagtctaccctttttgattgtacaattctgcgtgaaccttaatggattcacaaggctgtgcagccaccagcacgatttaattccagaacattttcatcacccccggaattaacctgcacgcattagcagtcactcccatttcccctcctccagcccctgccccccaccagctgactttctgtttctgtagatctgcctgttgtggacatttaatatacatggaatcagatggcgtgtgaccttttgtgattgacttctttcacccagggtggtttcaaggctggtccgtgcattactgtggatctgtaggtcttcattttttatggtcagataatatctcattgtatggatttatcgtattttgtttacctacccatccgtggtggacaccgggttgtttccatccttgggtggttgtgaataatgctgctatgaacatttctagacatctcgttttgtcaattaaaatgatttttaatttactagatgggaaatagcaccttgtagttgtttaactttgagattatttactcataaggctaagctatctgagaagtgcttcctctttgcgggaccatctggttgtggcttgaatctgtgttgctgtggaagcctggtaggtcctcactgatttggggtgggtggtgggcctagcacacctggactgggaccagctggaagggttgcttagggaggcagcaatgcccgcctggagggatgaggccaagtccaaagggcacagtattggggcccaggctcattccttgagttccatttggctgcagcttctggagggagccgacaggagacgtggggagacgatgctcctgcttcggagaagcttgtcactaaacgtcctcagaaaggaagtcgacagggcctgttttggggagaaggccaaacagtgagttgggagctgagaggaactatgggctatttggggtcaggggagggaagtgtgtttgggaggacctgtcctgtgtgccagggtgggagacgctgtggcttcaagaccctggccctgggatgccggctactcaggaagatgggccgagatgggcagccagggggctgaggaggctgatggcccgggcctgggccccggcaggctgcctgggtggggagggctcagggggcattttcagccagggttagctgccaggcttgggccagactcagccctctgacctcccctccgggcagacattttgggtcggtgggatccctttagaatcctctcctctgctggcttctagacattaagcatccctgggcgggggcagcaccagcctccctgtgggacccagtgcgtgtggggtttgtaagctgaaaatgactttttctttctttttgcacataggtgagaggacttgtccttttaggacttgttatttttgcacataggtgaaaggacatccttttagtaataatttacctatttaacttttaccagagtgacttcccaggctcagtgcctgccagctggttagatagaataagcccaggctctggcagtttgataagggccttgataagggccggctgttccagtgggagtggcctaatcagccctctctgccctaactttctctttcacaactaaacatgtgaaacttgcccagaggccggcgggtgcagcctggttgaggctgtgcggcctgcactctggctggggactttccatttcccttgctggtcacaggattcctgggaaagcagccctggtgggggcagcattgggggaggttgtggtgataacacatcccgcctcctgcactgggcctcctgtagcctgcaccctggccgctgtgattgtttggcctctttctttcttcctgacacccagtagaaggggaggcggagtgaagagagtacgggttggggggcacagggcccacaggtggcagccggcagcctaagagcccgcgggagtggaggaagggtagtggagttgctgagccccaagacaggcatggcatcctctgaagcaggggttgggggaaggaagagggggagtggggaaggacaggggtgtggcctgaggagaggggaggctggaccgcctgtccactttgcttcagccagggagctggcccttgggacaggctttagatgccagctccatcagcaggatgcaggcttggacctgctggagtccttgctggcctgtgaccttcctcccctgtctacatttcagggagctctagaaggcggcagtggggccagacctggctttggctgagaccctggagaaagactagggggtcttgtgccctgtcagagaaggcagagcctcatagccgcttccctgaggccgctcagcagcggcccctctgccttcctgatctcctggcatggcagccagaagagctcacagaattacttcttctgtaattatttataaagcaaggtttccatgacgaccggtttctggtagacgctctggattggcgaggcagcctcttcctggccagattgggcagctcaggaagctgggggtggggggtgctccccaccaagcccggtgtggcagggagctgggacagtcctgggtcaggcaaggactctgtgatgcttccctgctccctcgcctttctctgcatctgatcctgggatgtcctagccaccatggctttccagctgagcaggtactgccagtcatgggcatgtctaggccgtgcaggggccactgtgggtggattgtttagggacatttggaagggaagggtgggtagaggggactcggcccctgtgcccagcaggctggctggtgtcatgcagccaggaagggcagtagggcacccacctggcctggctcttactgacccccaagattaggtggtcagccgaagctgggataggaagtgcaggcctgcgtgagctggggtcccctgacggaccagggcactcccctgcctgctctagtccccagggaggaaggcacctggttttctttccagccttgctcctgtggcttccctctgctcccttcagctgggctgggttcactgcggtttcccagcgctgctgagcttcctacctgcggtggagggggggtctgtgggctgcacaaggagcctcctgggtcagtcccctgcccctggccaaaatggaggctgggagctcagggccattgttggcctcttcccccgtcctgcttgggggcctgcaagtgctgctggaactttccttggcacagcccttcctcccacccttccctcttctggagatgcagtggcgtgtctgtgggttgaagggacttcgccggaactgccttaggcagcaagtcaaagaggagaagcaggggccagactctgtgactcacgcctgtaatctcagcactttgggaggccgaggcaggtggatcaactgaggtcaggagtttgagaccagcctggccaacatggtgaaacccccgtctctactaaaaaatacaaaaattagccaggcatggtggcacgcacctgtaatcccagctacttgggaggctgaggtaggagaatcacttgaacccgggaggtggaggttgcagagagccaagatcacgccactgcattccagcctgggtgacagagcgagactccctctcaaaaaaaaaaaaaagaggagaagcagggctgcttgagcttctgtttggcagagtcccccatggaaagaggaggcatttatgtgtgcttgtgcctggactttgaggccccacacccatccacgtgcctgttttgtccctcaaggctgcctggtgtgaggcccccgccccccatgccataaggagacccgcttctcctttccttccgggaagggcaacccctgtcccttgtctactcctggccaaggcagcctctgctgagctcctgaaggaagctccgagtgtctgcaggccccaggtggtggcccccagccatgagtggcatctgcagccctatgactggggacagtctgcccagacacctctgtcccacccagctttccagctgaggtgagggtggagcacacgcacctggtgcttgacctctggtttgaggcctttgtcagaagggggcagtaatgagccgcctgccctgcaggccccgtgtgggcctgacctgcctataccccagacccttacctggctgtgcaccttcaggtgggcactttagcttccaccatggagtaaaggaagcaaggctcacctacccctggttaccctgggtttcacgtagtaatgttttcattttagcactgactttttttttttttgaggcggagtttcgctcttgttgcccaggctggagtgcaatggcgcgatcttggctcaccacaaacttcgcttcttgggtttaagcgattctcctgcctcagcctcccaggtagctgggattacaggcatgtgccaccatggttggctaattttgtatttttagtagagacagggtttctccatgttggtcaggttggtctcaaactcctgacctcaggtgatccacctgcctcagctcctaaagtgctgggattacaggcgtgagccactgcgtccagccacaaaagtgtagtcgtcgtcgtccttttttttttttttgagacacagtctcaccctgtggcccaggctggagtgcaatggcatgatcttggctcactgcaacctccgcctcctgggttcaaacaattctcctgcctcagcctcccaagtagctgggattataggagcctgccaccacgcccagctattttttttctatttttaatagagacggggtttcaccatgttggccagcctggtctcaaactcctgacctcatgatccgcccgcctcggcctcccaaagtgctgggattacaggtgtgagccactgcgcttggccagcactgacatttttgtgtcagagtcagagacactggtgacactcccagctggtcgtgtgctgggctgtggaaggggcaggcagggttcagtgccctgcagggctgctgccaaggtcaccgcacaggggcctgtccagggctggccaggtgtgggtggcaggtgctgagctgggctgagggtgctgagcggggctgagggtgctgagctgggctgagggtgctgggcagggctgagggtgctgagggtgctgccgctgctgcctcggggctcccctgtgccactcagtgctgctttctttgggagcatcagagacctccgggcatggccacaaaccaggtggcaggtgacaaccggaagcagtttcctcaggctggagaccagcggtgggcagggccatgctcccgaaggtttgacgggaggctgctcccgtctctgccttcatcttcacctggacctcctgtgtctcatgtcgagacttccctgttcctataaggacaccagtcattgggttagggcccttcctaaggcacggcgacctcatcttgattgtatctggatgcaaagaactcttttcaagtaaggtgacattcatagtttctgggggttcgttctcaaacacatcttttgggggacacaattcaacccagtactcaggctccatgtggcttaggtgggactccaccttgagaggaccccagggcacaggaggcatggccagccctcaaggtgaggccagggggcaggagcggctcccctccctgccaggctcccctcaattgttccaggcgcctcactcccgctgcggaacaggctcgggctgtcctgcgaggatgtgggctggaccccagggccgctgctgtaggcgctcttgggatgagtgctggccggcctctggtgtgatgagatctgagttttgagctgtgccttgaagcgttttcaaagaacacttattaatttgaaagggttgagatggtttaaaggcatccaaaagacacaggcatctcaccgaggtccctgcccagtagctagtttcttcctctgggggccatggaggcctctggtttgtcacacctccttcctggaatggtcgtccctgcgccccaggtggtcaccttgctcccatggctctgtgccttgctgtttttcacctgacagctggtctctgagaaggttcctcctcctcgtgcaaggctgagcaatattccaatgtgtggctgttgcttttatgtccttatgtggacatctcggcgctggcccatgtcctgcgttatacacggctgtgcagtgagtacccttgcagtgcttcgtttaaccgtgtgtggaaacagctgtggggtaaatttctgcgagtggaatcctgggtcagggtgtccctgtgcatctggggtttgggtgggtggtgccgggtgccctctgtgagtgggtattcgcttacactcccctatttgtgaatggttccctgtccttcacaaagggtgggtcaggcgttgctgggacaggtagaacggtgggaagggccaggcgtgcctgctaagcagcagtgctctggcaggtgcaggtcggagccccgcagggcagtgagagttgaggcggaaaagttcccaatccctgagagctccagatgccttactaggagattgagtctttattctgtagatgggaaaggccctggaaggtatggataagggagtgacttggtcctggggctgtgcagtcggggccagttaggatctcagccaaggcaagaggcaagtgcagaggccatggggggtgaggggcagtgcagaggccatggggggaacaagaggccagtgtagaggccatgggagggctagaggccagtgtagaggccatgggggggctagaggccagtgtagaggccatgggggggctagaggccagtgtagaggccatgggggggctagaggccagtgtagaggccatgggggggctagaggccagtgcagcggccacggggggtgagaggccagtgcagaggccatggggagtgagaggccagtgcagaggccatgggaggtgacctccccaaacagtgtctgattgtgtggttcctggacttcagcctccccagcctcccctcctttcaggatggatccagactttgtctcagccctgaggccctgcatgacagctgcgtccctgtctcaggacatcgcttcttcacccccttttgggccatgcgccagctttgtggggttgctttctgtttctggagctcgctgggcactcctggccttgggccccgaacattccctctcctcgtagccttctcggacctctgctcctggctcacccttcaggacttggccaaggtgtcacttcctctgggaagctttcccagagattaggtggggtggcgcccttctgggagtggctccttgacccatgtgtgctcagcttcctcagagcccttgtcatcagctggatgccacctccagaggggacaccggccgggagtggggtggctgagagtgggttggcagcatctgcgtccattagccttgggccccagcacctgccactcatgctacaaggactggacagacatggttctgatctgggacaggagcagctggaacagaaaaagggtggggctgtgggcccgggtgacattccagacctgcagtcagcccgggtcactggctgccaggacccggcaggcagaagatagagcgggggatgtttggggccaggcccagagaaagaaggcagccacgtaggaaaggccccaccctgggcagcttgctttctttccttgaagtttctggggtcagaggagggggaagaagtgcaggattagcgtgttgggggctgggggaggaataacatgtcagactcagcagtaaacagtcctccagaactgggccaggcctgtgccgttgcccgagctggcctgtgtctttctttatttttagataatttttaaccccaggaatcctagagatagacaaatgtatttctttcttttcttttttcttttgagacgaagtctcactctgtcacccaggctggagtgcagtggcatgatctcagcccactgcaacctctgcctttcaggttcgagcaattctcctgcctcagcctcctgactagctaggattgcaggtgtgtaccaccacgccccgctaatttttgtatttttagtagagatggggttttgccattttggccaggcaagtcctgaattcctgacctcaagtgatccgcccccgcctcggcctctgtaagtgctgggattacaggtgtgagccaccgcgcccagcagccaaatatatttcaattttttttttcttttgagacagcatctcactctgttgcccaggcttgagtgcagtggtgcaattgtggctcactgcaacgtactcttcccaggctcaagtgatcctcctacctcagcctccctagtagccactgcgcccagcctgtatttcagttttttaatagtaaagaggggccgggtgcggtggctcacacctgtaatcccagcactttaggatcacctgaggtcaggaatttgagacagcctgggcaacatggcaaaaccctgtctctagtaaaaatacaaaatttagccaggcgtggtggtgcatgcttgtaatcccacttactcggaaggctgaggcaggggaatcgcttgaacccaggagacggagtttgcagtgagccaagatcatgccactgtactccagcctgggtgacagaatgagacgctgtctcaaaaaacaaacaaaatagtaaagaggaacatgaagtgctttcggtacccgtgtctttattagaaatgggatcacgaacgaggtcaggagatcaagaccatcctggctaatacggtgaaaccccttctctactaaaaaatgcaaaaaattagccgggcgtggtggcgggcgcctgtagtgccagctactcgggaggctgaggcaggagaacccaggaggcggagcttgcggtgagccaagatcgtgccactgcactccagcctgggagacagagcgagacgccgtctcaaaaaaaaaaaaaaagaaatgggaaaacgaagtctccagtgagacgcagcagcttccctggctccctggctctcacccctgcctgcctttagacagaggcagtcatgaccctgtcctgggatggacacggttggccttggccaggccatggggcggggcctgagagagtgacagagctgtttatgggtcctggaggctggctggatccagcggttcctgagctgtttggaaggaatgagggaggtggggaggggaagagggaggggccaggtgtggagcagctggtggtggtatgcaggatgggaaggaatcccagctgaggctgggactcactggctgccctggcttggagggaaggtgtctgatttggggaaagggagaaggggtaagtgagttgggctttgagccttgtgcattggaggtgacagcacagtccccaggcaggagtcaggtcctgtaggggagagggttgtgtctgaccttgagggcaggggctggcttcctgggtggtcagttggggagttaggatggtccttggtgcaggacccaaggtgccgaagaaaggcggccaggcccgtggtagccagctggcgtgcggtctgcagttcctggcatgtactcctgatggcacagcgccaagtgccgagtcctcactttgttgccaggtggctccaggctcttcctcggggcctcaggcactgtccctggtcttctgtcttaaaggctacccacatatctgtcctgtcttcagtgcccaccgcatgaaagcacttcctccgctgctctgcagcccttggcccgcgtcttctctccctggccttgtgtcattcctgggggccagcctgctgtgtgtggctccacttcacagacaggcaaagtgaggcctgcagcagtcattcaggctgctctggaggctggctctgctgctcctgggaaatgctgggctgatgtttcctcactgctctagaaccaggagctgggccctgctctccgcacccacccacagccttggctagtgcccccaggacaggcctgtgtggaaagtgaccctctgcccgctgcagctggtgcggggaaggcccttcctactaagtggaaaacaaagggaagaggctgatagaatcattttgtgacttataattggctacctcataactcagacaaaaaaagcccaaaaacctttcatagagtaagttcaatttttaaaaacaaaggtattttaaaatgaacacttgagaagccaaatgaggtttcttgtgtgctctggggatcccccggccactgtgtcacgccgtgccggccgctccacaggcaactgtccctgagcctcccacggaaccttgggccctgcctgacctcagagccagaagccagttggcctaagtgggccctggtttgcataatagactctcacccagggtggaggggtgacactggggatgggcagctatgggttgctgggggacatctgtggtcatttgctctagaagtggcatcctgtggccagatggtgggtttcttggagcttccaaccaagttggctaaatacttaccaaaaagggaaaaattctcctagttaacgtgtggactatctactgtgtaccatgtgtctgccagcgctgttgtggagtgagtgtgcgatctgcgtgatctcccagttaggcgaggcagtgttgtcattctacccattgtacagatgagcacatggaggattgagggttctgacagcttgcccaggttacctagcaagtaagagccagagccaggaacgctcttggagagtgacttgctcagccttggagctgctagagaagcagagaggagatgcagacctggggagacgctgctcctggggcccccacactgtccagcaaggctgggcaggctacacaagctgcaggtggatgctggaccctggacctgtgcccgctgcctgtcactcgtctccaggcctcggcctgtgaaggcggctttcatcagctgggtgctgtctgggaaggtgccaggcaacttgccctggcaggactgccaagctggcttgttgggattccagagatttcgtggagctcccacactaccggctgctcacggcaaggatgaagttgttcctctttggggaagtgaggtggcgtttccattccttctgacctgggaggctccttgccttcaatccagggcctgattccacactgcccccgggacccacagaggagcttagcgcgcagtgggcaggcgctcacctgctgacagggcctggggtcttgaagctgcgactcatgtttagttctcagaacagccgtggctacctggcttctctgggactcctgacgggggtggtggtggtcccgggaatttgctcctagggtcacagtctgtgtgttggtcactgggaaccccaagggctgatcaccacctccctgccctgtggctttgcttaaaggtcttcaccatcagcccttccctgccagggcagtccagggacatgtggcttcagggggagaaagtgcccctctgccctccttctctctcatggaaacagcatctcagggccccttccgtggcctagcaggtggcaccccaccctgacgaacacaccacctaggaagagcccaaacattgggaaggttctctttcctccgggagccattgagccctttggggaccttctcccctccttggattgtcactgttgcacaaatggcatcctctccagaggcctcatcctgcttctcctctgccctaggatcatgcggccagatgatgccaacgtggccggcaatgtccacggggggaccatcctgaagatgatcgaggaggcaggcgccatcatcagcacccggcattgcaacagccagaacggggtaagggtctgggccccatacctctgggccctggaggccgcaccagtgtgagttcaggacaggagttccccggggagccaggcctgcagccttccctccccttgtgcactgggccttgggaactgtgggagaagtggcccaagtatttctgcaccggaccctcagagctatgcttggttttggcctcagccaggaggtgtaggaacccaccagagatgaagcgtcaagcaagctgacaggccctccctccaccactccccgccatgccgagtcccccgccaacctggccctgatcagaagcatgccccgcctccgtggggtggagtttattgtgatggccaacagctgagacataagaggccagacagcagatgtaggagaggtcccacctctgccctgaccaaccctggtggccatggcaccatagcaagtgccgtggctctctgtgacttggccacttcctggctttgaagctcacaggcctggtaccactgtgcccacaatgggagcagctctccacctgccccaaaattgtgtagctcgggagggccctgtgaccctaaagctggggacaaggggcacggtgtctagtgtcaacctcagggctgctgtaggacattcagccatccccagccctggggaggggacattttctctgaagggcggctgttggggggaagccagcccttgggtgctgaggacagggcgtctgccttggtgccgcagctgcagcctctgcactatggggctcggtcagcacaccttctgtggcctccagggaggcagagaagaggaagactcagccccagcttggagagtgggagtgtgaggtgcaggtccccaccatgggcacgggcataatgccactctatcaagaggccaagtggaagccacgtcagagaccagggaccagcggaggcactgtgagctctgagccacactgttgagatgcaggaagtggctgctggctctgtcagcctgggctgccggaactaagaccacagcctgctggcttgtgaacaatggaaatgcatttctcacagtcctggaggctggaagtccaggatcagggcgccggcagatttcgtgtctgttgagggcccatttgtttcctggttcatagatgtcacatcacttcctgtgtgtcctcgcttggtaggagtggctctctcaggcccttttataaggacactaatcccatttgtgagggctctgtccccattctctcatcacctcccaaagaccctgccttctactaccattcccttgggggttaggatttcaacacagggattttgggaggtggggacagccatgcagagcatggcacatgcattcagcctggaacagtgggtagggtgtgtttcagtggaggagtggaagctgtgtgtgtgtgcgtgtgtgtgtgtgtgtatctgcgtatgcatgtgtgtgtgcatatgtagaatgaaccaagccacagtaagtgcggatggttggacgtggatgtgggggatgtcgtgtggtacaggttcaggagtgggtttgctggcagtgcctggtttaggaggggctcgctggctgggctgggggtagattgattctttggacccgaggctccggtgcagctcagtcacgttcagagagcaccctctggtggctgtggggagggtgggcctgagcctgagagcctggggcaggggtgagggccaagtcccaagttcctgttgcacccttccagagagagacagtgagggtccctggcaggagagcatggacacagggaaggaaaagtccccaagatggggaggaaagatgaaggaggggcttgggaggccagagggtgatgctgtcactcagaatcgtggaattattttgctgccatttggtcagcacttgacattctgcaaagctccagaatgcttcaggagctaaagtttagctcatggaatcctcacaacaccccggagaggcagctgttcttgtcttgtttttttttttctgagacagagtctcactctgtcacccaggctagagtacaatggtgcgatcccggctcactgcaatgtctgcctcccaggttcaagcgattctcctgcctcagcttcccgagcagctgggattacaggtgtgtacaaccacacctggctaatttttttgtatttttagtagagatggggtttcaccgtgttggccaggctgatctcgaactcctgacttcaagtgatctgcccacgtcggcctcacaaagtgctgggattacaggcgtgagccactgcgcccagctgctgttgttatttttattatcccagttgcatagataaggaaactgaggtacagagagattgaacacttgcttgaggccacctggggaggcagatggtaggtctgggctgtgactatacctcgaacctgtgctttgaacacttgcccctccttgctccttctccggatctggggctgctggagggacagttttgacacattggcttggagaagcctctgggaggctggtccccaggatggtgatccagaaattctaggcttaggagggggtctctgagttccaggcagccccagggcgtgggggtgagaacagtcccagtgcctagaagggctttgctggggccctaggtggggcaggggacccccgcatccacactcccctggtggtgccttccagtctgtggctggaagtcccaaggttctgtctctggctggggcctcttggccagcccatctggatgcctacttggcctgcttggccttgatgtgcaaaaaaacgacactcctgtccttgccccaggcttgcttctcccagcctccctcccctcagtaaatggtctctgcagcaccccggtgctcaggctcaaagcctggagcctctgtcagcctctctccctcccaaactcatgaggctctgggagcagatcccactgctctaccttccaggaagtccagatctgagcacaacccccaggcccacccccactttgggtccaatggtgctgctcttccgatcacccgatcacctgatcactgcagcagcctcctggcaggtcaccctgctggtccctgctgcctggtttgttctccagcagtagccagggagatgtggagtcagggcacagtgctgcctgctcagagccctccagatctcctgtttcgcccaaagccaaaggcacgtccgcacgagtccctgtctctgcctagcgcggctcggggacctcacctcctacatctctttctcaactctccctctggccacattggcttttctgcttcttctcggacttgctgggtgcattcctgccttgggcctttgcactggctttccccagatatccacagggccctgccctctcctcttctaggctctacataaaaatgttggaatcccagcactttgggaagctaagatggacaggtcacttgagctcaggagtttgaggccagcctgggcaacatgatgaaactttgtctctacaaaaactacaaaaattagccaggtgtggtggcctgtgcctgtagtctcagcttcttgggaggctgaggcagcaggatcacctgagcccaggaaggttgaggctgcagtgagttgagatcacatcactgctctccagcctggatgacagagtgagaccctgtttctacaaaaacaaaacacagcgtccggccatgcccctgatggcctggctccctctctgcttccagctgctgctccactcctgacctgctgtgcttgtacagagtggtagccccacgagggcaggcaggacttctgcccttggtttctccagactgagcatagagcgtgcttaggcatcatctgatgaatgctgggagctcgggcctggcaccgtcaaccgtcatggagagcgtccaccgagtaagcgcttacgatgagcccgcggccacgctggggctcacccttcctctccctgtgtagtcttcccagccacctgctgagacaggcactgttcttaaccctgttttacaagtggggaaactgaggcctagaacagttaggtggctttccagacagctgcatcctcagagctgccgtcagccagaagacggccggggctgggcatggtgatgagaccgcaccctctctgggccctcactggatgccgggcatggtccacgcacttgacgtttgtcaattgccttatccccgcatgtcagagagagacagctatccctgcctctcctgggcgtttcctaagcaccgagttcttcccattcgttatcccctcgaatctctgcagcagcctgttgggaccatttattatctgtgtttacagagactgagacgtggagaggttgtgtcgctgcacaaggtcacagagctagtaagcagtagagctaggatttgaacccagggcccagagctgttcttttaggctctgcctctgcagctgctgtcctggctggaagccctgtggccatgaggaacccagtgcctgtggtttgctgggatgcctgtgcctcacgggccgtgtgataccagttgcttttgagagcgtggcagagggcacttccgggcaggtgctgatcaggagctcgtgtctctgtcccagggcagggtggggcttttcctgctcctgcagtcctggaagcaggaggtgtggggctcatccgaggcactggctgctgggagatcttcccatggaacgcaaatacttgtcagtccatgtattgaagttttggatcacactggccttcagggactccctgggcctggtccagagccctgcccgctcctgggaagcagccgcccaccagcaaatcagagccgtcctgggtcccggctcctgccatctgtacccatcagacacacagagccacctctgcagcctcccaggctgccagatagtaaaacaaaatcctcccacagggtctcctgatagtgaaatgggaccgtggcaagactcctgtgtggatgcctgggagacattacttttcttcttcttttctttttttttttttttttttttttttttgagacagagtcttgctctgtcgcccaggctggggtgcaatggtgcggtctcagctcactgcaacctctgcctcctgggttcaagtgattctcctgcctcagcctcccgagtagctgtgactacaggcatgtgccaccacacccggctagtttttgtatttttagtagagacagggtttcactctgttggccacgctggcctcgaactcctgaccttgtgatccacctgcctcggcctcctaaagtgctgggattacaggcgtgagccactgcgcccggccctacttttttctttagtatgttaagctgggagagaaccaagctcaagggtcatcagtggccttctgccctatgaaggacaggcttgaagccatcaccaggtgtccccgtggcactgtggggaaggctactggatggttctgtgtgaggggtgtcccgagggacagcacagagaggtgcgctctgccttcctcctgcctcaagtcactctttgagtgaacctgcttttgtgcctcctctgagcgacccttggacctgcccctcacatcctggcctgcaaggcctggcagcctgcctctttggacctttgtccatgtctcccactgcgtccctgtgttctggtggctccccaccacctccccactcctgctgctctttcctctccctgtggtaccaacgctccccctacctcctcctgcctaacacctggtcttttaggcctcagctcagatgcctctcatctgaagtcacaccctgccttaacatcgttgggctgtccccatcgtggcgtggccccatttacttctcgtccgtccccccagctagaacccaggcttctctgacccacacccctctgtacacccagcactgagaggccccacagatgctgccagaaaccagctgcagagcagggaggtggaaggcctctgccccggaaaagcatgcgcccataggtctgtttgatctgtgtcagcatagcataccgtaatgtacttaatcaccctcaaacaacacacacttggcttcattccacttttaggtcttgcagacagtgcttggctccttccaagatgggcattgccctgcccagaggcggtgcctaattcttgcctggctctgtgcagccctgccctaacagcctttggccaatgggtggcgccatagccacatacattgacttgggggtgaaagagacagttccaggcatcgctttactgtgacctgttgtgagtagggcagggtttgctgggggacaagcccgtgcaaaccagaatggggaagcatcgggccacccttgccagctctagaacttttcttgcccagccccagatgcagtcacagagtccctgcgcctgtgtgcaggagagtcacctgggaaagggctcagacagaggctcccagcctacctccaaagaagcaggtgctgggtttggggtgggccccggagcttgcatgttaaccccacctcagtgagtcctcatgtaggtgggtgagctgcatgtcggtgctttgggggcggcaggcggtaggtgggagagcacagacgcacacaccagggcttgaagtgactgccacatactctgtgtgctctgggacgcttgcctaatgtggcaccccttgtcggggtgctgtgaagatcacctgggccagtgatgtcggagctggcccaggcccctccctcacctgctccctgcccgccctgggaagcctgagggctcctcagtgtcatgctgtcaatgtcctaaggaagtgattgttgcagtagaaagtcatggcagtcctctgggaaatggagactcacattccccatggctcaaacacaaggtcatcttttgtgtcatttattcagcaaagatgagaaataagtcaattctgagtgttggtcaggatgccgtgaggtggcaaaggccaggccagtcactgctgttccgagaaacacttaggaccatatataaaagtatttgtccttgggcccagaaaataatcccaaatgcagaaaacggtttaagtgaaagggtgcccatcacagcattgtttgtaatgagaatcaactgggggtgccccacatctctaacagaagaagaatgttcaattccacctggctagcaattgaaagtaattttctaaaaaaaagttaggtgtggttgcatgtgcctgtagtcgcagctactcaggaggctgaggctggaggatcgcttgagcccaggaggagtttgaggctgcagtgagcatgattgtgcctgtgaatagccattgcattcctgcctgggcaacacagcaaggtcctgtctctataaatgataataattttacattggagtgctatgaaaaggaagtcactggaaaggataaggaagtctttcagacacagccaccgtctgagtgttcgtgtctctcatgtgttgaaattctcacccccagggtgatggtattagggggtggggcctttgggaggtgacgagggtatgggggtggggcttcatgaatgagatcaatgtcttcatgaaagggtcccgagggagctcatttgccccggccaccacgtgaggacacacgagaagcactgtctgtgaaccaggaagccggcccttaccaggcatggaatctgcccgtccctgatcttggaatgacccaagtccctggagacttcccccctccaggactgtgagaaataaatttctgttgtgtctaagctgcccaggctatggcattttgttctggcagcccaacgaactaagacccaaagctacagaggatgatccccagggtagatgaagagagaaaagcagggtgcagcaccacctgtccatgtccaccatctgggagccccaccatgtggttgtagatgcggagtccgatctgacacatgggacccagctgccaaggggtcctgtgtgacaggagacgaggtggccagaggtagacccagcaccataggcttttttgttccttttacattttgaatcatgagaatgggtcgcctatttgaaggataaataacattgaaaaaaatttttttttttgagacggagtctcgctctgtcgcccaggctggagcgcagtggtgcgatcttggctcactgcaagctccgcctcccgggttcacgccattctcctgcctcagcctcccgagtaactgggactacaggcacccaccaccacacccggctaattttttgtatttttagtagagacggggtttcaccatgttagccaggatggtctcgatctcctgaccgtgtgatccacccgccttggcctcccgaagtgctgggattacaggcgtgagccaccacacctggccacttttaaatttttaaaaagaatagttgggccgggcacggtggctcacgcctgtaatcccagcactttgggaggatgaggcaggcggatcatctgaagtcaagagtttgaggccaacatggtaaaaccccgtctttactaaaaatacagaaattagccaggcgtggtggtgcacatctgtaatcccagctactcaggaggctgaggcaggagaattgcctgaatcctggaggcggaggttgcagtgaaccgagattgcaccactgcattccagtctgggcaacagagtgagactccatctcaaaaaaaaaagaatagtgattgcaaagagccatgtcacaacacgggcagattatttttcccatactgaatgaaaaagaatcaaggtgagagtgtatttagtgttttgttgttgttgttgtttttgagatggagtcttgctctgtcacccaggctggagtgcagtggcgcaatctcagctcactgcaacctccccgtcccgagttcacctgattctcatacctcagtctcctgagtagctgggattacagatgtgcaccgccacgcccgggtaacttttgtatttttagtagagatggagtttcaccatgttggccaggctggtctcgaactcctggcctcatgtgatccgcccacctcggcctcccaaagttctggaattatagtcatgagccaccgcgcccggcctaaagaagaatagtgattgcaaagaatgtgtcacaacacaggcagattatttttcctacgttgaatgaaaaagaatcagaaggtgagggtgtatacttagtttttgcacagctatattagactaaaactgtgaaacgagccaggcagacgaacaagtgagacaacaaaacccaccccgattcttgggaaaaaagcctggaaagacagatcccaaaatagtaaccatggttatctttgaatgggaggagtgacgttccccttctttctacttttctgtatttcccaaattttccataatgggtatgtatgcatttgttcactttatattaagcaaataatgcatgcctattgtgagaaaatcagaagaaaggaagaagcagctggtgatcccatcacttggggaatcgcctgcagcagttgctttgggctggactctgcagggctcctctacatccctgtgcttttgtgtttaggaatgcgcggtgctaggccgggcgcggtggctcatgcctgtaatcccagcactttgggaggccgaggcgggcggatcacgaggtcaggagattgagaccattctggctaacatggagaaaccccgtctctactaaaaatacaaaaaaattagccgggcatggtggcgggcgcctgtagtcccagctactcgggaggctgaggcaggagaatggcgtgaatctgggaggcggcgcttgcagtgaggggagatcgcaccactgcactccagcctgggtgacagagcgagactccatctcaaaaacaaaaaacaaaacaaaacaaaaaaacaaaaaattagctgggcgtggtggctgtagtcccagctactcggaaggcccgctgtagtcccagcgggcgcctgtagtcctagctactcgggaggctgaggcaggagaatgtcgtgaacccgggaggctgagcttgcagtgagctgagatcttgccactgcactccagcctgggtgacagagcgagactccatctcaaaaaaaaaaaaaaaaaaccgcggtgccaataaatggtgatacattggttgctttcacagtggggaatgaaagcaaaggcaaagaccgtttccagggggcatgtcctgggtggggctctcggggctgggctggctgacctgggctgacaactgcctctgtctccacaggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtacttctgggagcgacagtgttgactggagcagtaagggccgtggctacacagctgcttccctcctgagggcagaggacgctccagggcctggccccttttccaccaatgagacctctctcacctcccaccatggccctgggagcagctatgtccattgccctgattttgcagacaggaaaggggcacagaggggttaggaaacgagttcagttacccagagcaggactcaaccctgctgtctgggtccggcctgagcacatcatgctgcctgtcctgctgcccgtggccagctcatccatggcaggggctgggcgcgggctgtgaggccggtacgcaccatccacccctctgcaggtctccctgccctgcttgccctcctcaagcgtagggaggtgttggctccagagaggacagtgcttgctcctgggagccccagaaaccaggctcagatggaagctcactgggtgaacctttgcctctgctttcatctgaatattctcctccttggccatggtaaccatggaaacccccttccccttcccactgggcgctgcaggagggggcggctccagtgttcaccagctcacgcttctttttatacccaggctggggacgggaggtgagggggaaggcgggcctcttcccctgcccctggtcctctccctgccacctcccaggtcaccagtcctcccatgcagagaggctgggccggtttcctcctcttccccatgcctgttcctcagcagtggctgccccgtggagtgccagctcacagccatttgaggggcttgagtcctcttcctcatgacgggccggtagcaagcacgattatgcatctagaacattctgaggacctcagcagggttgattagaatggctgtgtcagcccagctccggcaggtgggcagatggagctgagcaagggcctggggtggaaggtggtctgcgttcccattgcctgctgctccctcagcaggcacctctgacatcagagggaccctggatgctggtctcaggatgtggcccaggaaggggtgtatgggcacctcccacaacaggagcagcgcccacgactcgggagaggctcagggctgggtgggttccccactttaggggccttgggggttccctgccatctcctgtgagatcgcagctcttctccgactgtgctgggggtggagccttggccccttcctggagaggagggatggcctgccgcgctctcctgcttcctaggaccttcctgcttgtgagggcccagtcagcagtgccctttgtcattgcaggagttggtggcttcaaaaatgccaggaagggatctgctttgcagattttctgccatgaaagccccctttgtggtccatcagaggccatagcctcagaggaagccctgaagagcaggtttctttttttttttttttttttttttgagatggtgtctcactctgttgcccagtctggagtgcagtggtgtgatcttggctcatcgcaacctctgcctcccaggttcgagctattctcctgcctcccaggttcaagctattctcctgcttcagcctcctgagtagctgggattacaggcatgagccaccatacctggctaatttttgtatttttagtaaagacagggtttcgccatgatggccagggtggtctgaaactcctgacctcaggtgatccagctgcctcggcctcccaaagtgctgggattacaggcatgagccaccgagcccagccgagcagtttgggatgatggggagagaggcagggagacagaaaggcgttctcaggctttcagcatggctgggacccgctgtccccacagcagagagtgatgcaggccaaaggtcaggggtactgagcttgaggaactccctagatcctgaacttccctttcctggccgcttctgctggcccataatagatatggaaccgatagtggatgagcaaatgaatgaatgaataagtgaatgagcagaggcgaccaggaagaactgggcatcagtgctgagacatgctggctgatggggttttgatgaggacgacacaatctgacatattcgtgaggatccctcgctctttaggggctgagagggggagaggctcctgtgcagagccaaggcaggcgtgagcatgagagagcagcccccaccagctcacccagaaggtgctgggagcttctcggcctcccagctgtgtcctggccaccacagccctcggccttctcctcctcctccgaaggatgggctcagagagggacagagatgcccacccctcctccctggggacatcagggctggcattgcgctgtcgtgcgcgtgaggcttggagaaggcaggatacgcttgccagcacatgaaggcttttcccagtggggctgggcggtgccccaggttcttcttcccagcttcagccttttccctgtagcaggggctgggcagggaggccttggagccccaaggctgtagcttttctccatatcttggtcaggccccggagcccgctgttgtctcactctgtgactgcgagtctcatctccccctctgtctcgctcatctcctcgtctgtgcttctgcttctctgccatctctctctgcagtctctattgttctcttgaggcccttctctgtctctgcccatgtgtcccctggaaattgaactcgaaggccccaacagcaagaacagtgcctggcacactgtgggcacacggggagcactggctgaatgggtggtgacctctgaaagataggggtattgcaggtgggggcagaggatgcgcgcggggaccctggcccggagcaggctgagtcataagctgtgtgcgtgacatctgtgtgctgtctccaccccaggagacaggggtcccctgttctgtgtgtcccctttacctgggctgtgctgcctgtcacgaggccgctgagcgagcacaggcccaggcagacgacccgcaaaccttgcctttgaggcagctcatttatctccagcaactgtcaaaatattaagctaactgggatgtgattgctgtgaattgctccagaaaaatagctgggagctcttaagattttaagagatttttttttttttttttttttttttgagaccgagtcttgctctgtcgtgcaggctagagtgcagtggcgcaatctcggctcactacaacctccgcctctcaggttcaagtgattctcctgcctcagcctcccgagtagctgggattacaggcacgtgtcaccatgcctggctaatttttttgtatttttagtagagacctgttagccagcatggtctcgattctgagctcgtgatccgcctgcctcggcctgccagagtgctgggattacaggcgtaagccaccgcagctggccgagagataattttctaatactgccgttgtcttttgatgctttcattaaatgatggagaaaatacaattagcatgtttgcctcatttgctccatggtgttcatttaggtccagagggccactcgagttgtcatggaaaccggcttgtcaggctggctctagctgaatccaacaggaaatctttattcccaaaagcaggttgtcagattcactctcagtcaaagtgcggtggaaatattttcccatattatttgcctgtggttcccaagcactgggagccccacgttcccaaggtgtgttctgtgcggggaggaggggcaggcacaggccttttcttaatgggccccctggggcttgatttggagcctggggctgtgtttattgaggaggaaaagcgctttgccttggggaggcaggttcaggtaactggtgggaagtgagctcctctgggggttttgggcagggccctggggctgctcctgtctccctttcctccattacttcctgcagtttgctcttctgctttatagtgaggatcttccacattgaagaagccacttttatttatttttttaagacagggcctcgctctgtcgcccaggctggagtgcagtggtgcaatctaggctcactgtaatctctgccttccgggctcaagcgatcctcctatctcagcctttgggaccacatgtgtgcaccgccatgcccagctaatttttttttttttttttttttttttgaggcagagttttgctctcgttgcccagcctagagtgcaatggcgccatctcggctcaccgcaacctctgcctcctgggttcaagctgttctcctgcctcagcctcccgagtagctgggattacaggcaccaccacgcccggctaatttttgtatttttagtagagacggggtttctccatgttggtcaggctggcctcaaactcctgacctcaggtgatccgcctgcctcggcctcccaaagtgctgggattacaggtgtgagccaccgtgcccagccaacccagctaattttttgtatttttggtagagacggggtttcgccatgttacccaggctggtctggaactcctgagctcaagtgatccacccacctcagcctcccagagtgctgggattacaggtgtgagccaccgtgcctgacaaagccactttttaaaggcatccttgcagatacttctctgaaatgactgggacatgggagtatggcaccaagttgctgtgtgaccctgggtaaacccctagacgtctctgggcctcagactccttctgtacaagtgaggggtgtacaccagggatctctaggctcctttagccccagcaggccacgagcctctgtttctcagcacggacagccttccctgtcctgcagccccactttgctctgtgggtgggctcagtgccccaaggagtcagcagcctatagcccgtctcttggcacctggaagcttctggtggagctttggatgggctggcagcacacccgagtgtctggtgtgaaggaaaggaagttcctggggtggcaaaaatggagcttgatgagctggctccgctgctctgtgctttgggctgtgggggccctggccgtcccccctgcccctcccctgggctgctctgcctgggcacagcctccacatcctcctgagcctctgcagcctgcacgtctgtatgggccaagtgtctttctgggcttccccgtttggcgggagttcttggcagtgcttagacaggtggatgggatctgcagaagacgttgcgtgtctgagcatcaggacgtcaagttccccagcaaggcacttttgattttgacgttcgatgtcagcagcgatcagttgctggagacttgagccagcaggtgaagcgggctcagcctcgtgtccccgggcagaacgaagggcgtctgcctgcagccaatcagtccttcccctctgtctgggaggctcgttgggagcctctgatgtgttttcataatcaagctccctttctgtcaaaacaccaggaagaggaggttgcctgcagttggtgccctccagggtgatccctgttgggtgttgtggctgaccagctccggaccatccaggcttaaaccacgtggtctgaagtcttctcagcagcccctggaaagggagaactgccccagagtgggtgcgttgggaggggctggggtcctgagctcaagccagttttgggggggcatgccttgtgatgggggtgggccccacgcagcctctctccatgggctctggggtctcttgttctgtttgtccacactcacatgatggcagcactccccagccaggatgctgaaaaggccttgggggcttgggggcttgggggttgggggccagagaggtggtgcacactgtggtgtgtttcaggtactgggaccgggcgctggagcagcacctgccacgtgcctggacgctcacattcccaccccgtctcccgggcgtcacttaatgtgattttcttctcttaaggtgccaaaaagctgaccaataaggccaccctgtggtatgtgcccctgtcgctgaagaatgtggacaaggtcctcgaggtgcctcctgttgtggtaaggtgccctttctacttctctcttgggggcagatggcagagatcaggtcacctcacctgatgttgggaggctcgttcagctaagggtctcaagggagcaacaggccagagctagggcacagggggccaggtccgccagcaggcagtgtcccctctgggctgggcagggcatccctggctccacaggagtttctgtcctgcctccgaggaaacacgggtggggaggagacatgtctgtgtgggatcttctaatgtatgtttaattcatgctgggaatgtgagcgcaagctggcccagaacccgtggacataaacatccctccaacctagggacctttttgtcacactccctaaccagagaaaagacggtgacaggatcgtgatagtgacatgtcctttcgggagccaggaccaccaggctgcgggggccgggccagctgttcccccgtggcccctgcaagctggttctgatctctgcttctgacgcagtggctgtggaaacagttgtcatatgagcttttgtctttctcccttcttgtcccctgctggggtctgtctccttctctgtgtttctctcatttctggcttcgctgtggttggaagcatctttctttctttctttctttttgttttttttgtttttttttgtttttttgagacggaatcttgctctgttgcccaggctggagtgcagtggcgcgatctcggctcactgcaagctccgcctcccacgttcacgccattctcctgcctcagcctcctgagtagctgggactacaggcgcccgccaccacacccagctaattattttatatatattttttagtagagacgggatttctccatgttagccaggatggtcttgatctcctgacctcatgatccacccacctcggcctcccaaagtgctgggattacaggtgtgaaccactgcgcccggcagaagcacctttcataataccagttcattatgttgtcagaggggtcctgccatgggcgggcctgtgggcgaagcctgtggaagccacacatacagactcctggaggggagacgttgggaataaagaaatttaattcgttgcctaaaagtactccctcgcctccttctcctgtgccccaagttcattggcaagtccaaggacagatgtgaccagctcctcccgcagcctgaccctgcggtccacaggccacagcccccaggaagagctcttcttagagggaaggaaccaggattctgagtctctgcagtgtgggccccggcagggagcttttcctccggctgagatatatatatagaatacatttttagaaataataaaactgagaaccagattgtcaggaattggtgcctgctctttttgcttccagacccaatagagacgctgggtgctcttgccgctgccggcagccttggttccctccccagcgtttgccgggtgcaggccacttcccgcctgtaggaggcctggctctccatcttcccgtggccccccggtcaccagggctgatggggcctcggtccctgctgccactgcccatgtgagactggggaggtgctccttgagacctgcttcctgccgtctcttctgtccccagctccgtgtctgaccaggcaccctgccagggtctcctcagagggcagtgaaggtctgggtggggtgtctccccaggtgggtgtggctggctgccgggtccagctgctgtttggcctaggttttgtttttttttaatcttggtgacaggggagccctgtccatatttaatgggaagggcaggctggtggctgcacctttggttttatgagagcaggatggcagcatgccagaatctggccagtgggcgggggctcagggtcggggtgtggagtccgaggtctcatattcccacctgacagtgtcccggggctgctgtgacaaagtgccactgactgggtagctctcaaacaatagaagttgattctgtcacagttctggaggccagaagtgcaaaggtatgggcaaggccctgcgccctccattggccccaggcgaggatccctcctggcgtctccagcgccgggtggctccaggcgtcccttggctgaggctgcgtcactgaagcttctgcctccatcttcgcacggcctgcttaccggagtacgggtcactgggctcagggcccgtcccattctgctgtgacctcattctaactgtttacaactacaaagacctggtttttggagcatttgcattttgaggtttcaggtggatatacattttgagggatgctgttcaacccactgcaccagccctcggttcaacaacctctcccgtctcttgttcttgtggggctgttctctccctgcttcttggctgagatggaagttgtggtcattttcagcagtgctaacttgggggtgattgaagacctaaggagcaggggtcagatgggggctcctggctgttctccgcagaattgcaagcacacccaccccacgttcattcttttctctaagcccttggcgttcagtgagccacatcacatgtaaatattgagacatagcatttaacggatttaattttcagatgctacccagttctgaaatctctcccaggccccatgcctggcttcagcatctgatggtgcatctcaggcgggtgataccgaggggcgggcctggacctgaacacagtcacttttgctgccttgtcgcttaggatcgatgcgccaagagctgttgggtttttggccagtggaggggacgggtagcttctgactcccctggctcccatcccctcgctgcagggacagggtgctttcagcgtggcccctgttagcctcgcctctccttgcccagtaattagctccctccctcccacatcctggaggagctcccagttgctttttcatttcctttgtagagtgggtttgatgagacataaataccaacttggccttgtcgaggagttgttgaaaccattccatggctccgaggcagccggagccgcagatgggagaggctgcacggttctcagctgcagctgttgttcagagctctttgcaccatcttccccccaacacacgctaggcccacgtagtataaacctcccactgatttggaatctaggtctcctgtttttcactggtgggcccggccagaggcctgcttaggaatcccagaaagtacagcttccttccctggctccgatgggcatttatgcccatctgctggtggcctggccacagggctgtcttatattgcatgagcatgctcccgctgacctttctacagacagccatccccgatttaggaaaatgtacgtccctgtatgtatagatatacagatatatattatatatacacatacaaatagagatgtcacatacgtatgcatgtagatatcttgaacacgcacacacacacacacaccacacacacacactggtttcctggatgtgtgcgtctccctggaggaacccagctgccggccatgcgcacagtcgtctagcgcaggatgtcttttctttgctccaccttcctccccagcctgcctgcagctttcccagtgagcagggaacctcggtgggcctgtgatgggcccgaggggccccaggatgaccagaggggcagccgcagccctggacaggctgagtggctgtcgggggtggatgctttggtttttttcaaatgtctgaatatgtgctctagcgaagaggttcacagcctgtctctcagatatttgggccacgctgtctgctgcttcagatcagttgggtttgatgagctctcgggggtgagagttaggtgccagccatcattaaaatgttccagcggttttgttcccagatggaaaggcagcattggggaggaggctgggcttctcctcatggcttgtgtccaggactgggccccatcatttccctgtgcgcctgccaagcccagacaaatgtactggataccatgaggatttattagaccgggggctggctcctttaaaaaaaaaaatccctttaaaaggcatctcttgaggatgctgaagttcacccaccaatgttcctaggtagatacacagcacagactctcttctcacagtcgttacttggccggtggaacattaggacgtggtttatttatggaggaaaaggttgaattatccactgcaacttaaaacactccccacagtttgcttcttttgaacaaacgcttcagctcccttctcagcctcttttgaagatgggttctcaactgaagatgatgggtagttacgccgaggaacggtgaatggtgctgagaccctgcacaattttggagctgagccatgagcaggaattatcgagatgtttaaaactggcttttgaaagaaggcctaacacagccgtctgaagtgaacttgcttaggtcagaggggcttcaacaggcggccgaggggcccagaggggccctgagttccgtggcttccccacaagctcagctggaatggttggttgagtgaatgtgagagcagaagtggaggctaatcagaacagccaggtggtagtcggcccctggccaggccaagggggagggagaaggtcgtgggggatggagcaggcagagggtctggaaccagcctgcggccagcacacaggccccgagggcccctccgagggtcccatccgagtgtggtgcatcccctccagtgtgcacagcagggcagtgagtgaaccgtctgttacgtccaagaaatgcagtatccccctgctgtgtcccgggactcaggagctttggcttttgtgctgagttgttggtgttttttatttatttatttatttttttagacggagtctcgctctgtcgcccaggctggagtgcagtggcgcaatctcggctcactgcaacctccatctcccggattcaagcgattcccttgcctcagcctcccgagtggctaagactacaggtgcccaccaccacccctggctaattttggtatttttagtagaggcggggtttcaccatgttggccaggggtttcaccatgttggccaggctagtctcgaactcctgacctcaagtgatccacccgcctcagcctcccaaattgctgggattacaggcacgagccaccatgcccggcctgtgctgagtcttatagtcacatttatttttaacttctggagtcaaaacccctgtgattcatttggagagccgtgggaggacagttccatcttttactgcccattctctaccaatatataacctgtttgattggccaagggtcagcagggacacacagggttcctgctctgtcatggactttggagagtgggtggggcctttttgaggatccctttattctgtaatgaatcctaggaagcaatgggacagtgcaaaatgattttaagtaacctaggatcagtatggttttaatagtgaaaaagcgggggccgggcacggtggctcacgcctgtaatcccagcactttgggaggctgaggcgggcagatcgcaaggtcaagagatcaagatgagcctggccaacatcgtgaaaccccatctctactaaaaatacaaaaattagccgggcatggtggcgggcacctgtcgtcccaggtaccggggaggctgaggcaggagaatcacttgaacccgggaggcagaggttgcagtgagctgagatcacgccactgcacttcagcctgggacagagcgagactccatctcaaaaacaaagaaaagaaaagtaaagaaaaattgggaacaagctaagtgcccacatagttacaaaaattacgttaaatagatacacggttgcttttaagctccacatacagcaccatagagctttttatatatttgtaggcattaaagcaattccaggaaggatctaaaccaaacacttgacccaggttgtctctctggggagtggagccacatgggatttcactgtttctgtattcttattacttatattaaaacacacatgaacagaagaaaaaatagtcccagttacacaaggctataagggcctgggatcatggccgcccagcgaggggaggaggccgtgtcctgcctgggcctgacctgtctttggtttctcgcagtattcccggcaggagcaggaggaggagggccggaagcggtatgaagcccagaagctggagcgcatggagaccaagtggaggaacggggacatcgtccagccagtcctcaacccaggtaagagccgcggacaccagcagcaggtgccactcctcaccggggacgcataggaggcaggagcaggccgggcctacgtgagcctcatgcttgaggttccccaggtgctgagcatgctctccgggaaccagtttctctggggtccccagggagggctgtcccccagccccgccctgagccatgtagacccctccagtcacacacctggaaggcgacctgcgtgactcagggagtcccagagggcactgtgcgtggggcctccattgccaggcaggtggtgtgcacctgttcacaaggaatttgtttttgttgtatcttttccttgtgttcgctcagtggcttgttcttttcttttttttttttttttgagttggagtcttgctatgtcacacaagctggagtgcactggcacaatcttggctcactgcagcctctgcctcctgggttcaagtgattctcctgcctcagcctcccgagtagctggtattacaattacaggcatgtgccaccatgcccggctaatttttgtatttttagtagagatggggtttcaccatattggccaggctggtctctaactcctgacctcaagtgatgagcctgccttggcctcccaaagtgctgagattacatgtgtgaaccaccacacctggccaagtggcttgttcttgatgggatttccaactcatccaaaaaagaaaaaaacggcagcagctgttcaagcgccacttcttcccggccccactgttcagacattgattggaggaggggctctgccagtaggcactgggctctgtggcatgcccagtttccctgtggtgttggtcccttctgccatccatcctcttgctctcatgtcagggtgctctggctttaacaaaatgttcactcaaaatctaaacgaaggcacgatgagatgttttgcctcaagcaaggactttctacccagagaactccccgcgttcctagaaacaattcagggcagggggccctggggagcatctgtccccctaggaaaagggtgagccctcgggggcaggcaacgagcattacccctctccctactgcacacatggtggtcatgttgtcgtagtggcaggagaactccctccaggacgcactgtgtgcttctctgcctccctgcgatggcctgggctcgtggcacattcgtgctctgtgctgggttccacagggtacctcatgcgggatggcagcctgaggagggtttgctgccccccaccatgccttgggagaccctggtcatggtgggtgtttgagtttcttactcagctttctctgttttgcctccaccctcagcagtggtggaggacctgcctcaagtaatccctttcccccttggatgtgcctgtgatgtgggctccactctggggtccacctgctcctagccctgccgagaggcgccctggcccctgctaacctggactcggggcattgttatggccgctcacctcccttgcttagtccacataagcaccaaaggggactggtgaaaacccagtgggcgcacagatgagagcatggctttctgggcttggctgctggcatgcagcaggagtgtgcttgttttctgggcgggtcaacttgaggcttgaacaggagtttgtgtgtatttggtctcacatgtgtgtctctgactcagtctgtgctccagcctcaacttgccaaaagcggactggttgtcaccttaggccagtgggactgggtaggtcggtttctttactgttggggaaaccactgtaggtttcctctcttttcatgtctgctttttaacaaacaccaaaaaaagaaagaaagaaaattaatgtgtcagtattaatagaaagaatggtgctgctttgatgaaaccccagtaaagagatatctttttttttttttaatttgaggcagaatctcgctctatcctcctggctggagtgcagtggcgcgatctcagctcactgcaagctctgcctcccgggttcacgccattctcctgcctcagcctccccagtagctgggactacaggcgcccgccaccatgccccacttattttttgtatttttagtagagatggggtttcaccgtattagccaggatggtctcgatctcctgacctcgtgatccgcccacctcggcctcccaaagagctgggattacagacgtgagccactgcgcccggctgagatatcttttaaaaataaaatttaaacagccagtttatcaacacagcaatacaccagacaggcctggaggcacgtgctggggcaggcagtgcccaggccgtgcttttgggagggcagcccagcagtcaggtcagacaccggctgtaaggaatgggatgggatgggagcaacgggaggtgtcttaggaaaggcaccaacacagcgctcagggccagacaatatgtccacattcaaatccctagagcctgtgaatgggaccttatatggaaaatgggtctttgcagatgtggttaaattaaggatcttgagatcatctgggttatgcaggtgggccccaaatccagtgatcagtgcccttgcaagagacaagaagaggctatgtctagcctaacacaaaggggtcctggaggagagggttggatggaacatgggggctgcctggacctacctttttgtgagcggtttctggagagagcttggggtaggtgccagaccccggggggtgtgggcagcactgctgggctgactctggctttgagaagcatggattagatcctagcttctgcctttaactgatcctcagggacactaaaattactcaaggttttcaatcagtttaaattcctttactcgtgggattctcttctgtttgccagcctccgattgactgtaaatctacacgtgatatttttcagaatgtgttattcactgtcagtcagagttggcctcctgaatctcgatttcctgattgtatgtgcttttatttttacttttttgttttataaaaatgtatcttcctcagatgattggattagagactcggcttttaaatatttcttaggaagtcccatgtccattctttcttgagcatttctgaacatctgcatctttgactccagtttcctggtagagccggtatctcagtggcatggcttcccggtaccctcgggagcccaggggtgggctcatctgagaccagcctggtctcctgtatggtggcttagcctgagttgggtttggcaggggcgtccgggtcaatggggaacagcagctctgggagaagagtgtgcgtatgtgcttggcactggggtctttctaacaggtgtgacacgtgctatcccatcccgtgggaggaccctccgtctctgccctggagaggccatcttggcctttgacttgcctgctcccagcccctgtccatcccacatcccagacctcatcctagagcaagagttcagactgttgcctagcaacctccacaggggtggcctcgtctttcaggtacctcagagtctgagagttccttaaaagtcctttgtccaatatatacagctataatttgtctatatatatatatatatatatatatatatatattttttttttttttttttttttgagacaagtctcactctgttgaccaggctggagtgcaatggtgcgatctcggctcactgcaacctccacctcctgggttcaagcgattctggtgcctcagcctcctgagtagctgggattacaggcatgtgccaccacacccagctaatttttgtattttttgtagagacagggtttcgccatgttggccaagctggtctcgaactcctgacctcaggcgatccgcccgcctcagcctcccaaagtgttgggattacaggcgtgagccaccatacctggccagaaggcagacctggtcagggactagacctcatctgttccctgcccaggacagctggcactcagaaagggtagctcattcctaactgacaagccccaagctgttgaacacgccagcccactgggccacgaaatgactgggactcatttcaggtgaagacaggtcctttctaggtctggccttaggcaagtaatgtttctcagtagccgaaaaagctggtgggatgaagggtggtcctgacccagaagttgatacctgaggtctcctaagtgtccgatttcattgctttgtttttcttttttttttgagacggcgttttgctcttgttgcccaggttggagtgcaacagcatgatctcagctcactgcaaacttcgcctccctggttcaagtgattctcctgccttagcctcccaagtagctgagattacaggcacccgccaccatgcctggctaatttttgtatttttaatagagaggggtttcaccatgttggccaggttggtctcgaactcctgacctcaggtgatccacctgcctcagcctcccaaagtgctaggattacaggcatgagccactgcgcccggccccagtgtcatttccgaggctttgatgtgcctctgggtcatggttgctaaattgtgtcaccacaaatcatatgttgaggtcctgaccctgagtccctcagaatgtcactgaatgtaaagaaagagtctttaaagaggtaattaagttaaaatgaggtcattagggtgggctggtgtctttacaagaagaggaggttaggacagacacacacagaggaacaaccctgtgaggacacgggggaaggcggcatctacaagcccagcagagaggcctcaggaagagccagctgctgataccttgacctgggacttccagcctccagggctgtgagacgaatttctgccgcttaaggcgccagcctttggtgggcactcttgttacagcggccccagcacacgggtacactccacacacagaatttcaaaccgcctcccctcccttctctcctggtcactgttagctgccatgtgagtttcctcattcctgccctgggcttgccctcatgccagggtgtgtgggagaagtagcatgtcatggagtcagaagcagagtagaggagctcctcccaaaaagccacattctgggggcctccccacccagcccaccctcctgaatatgcgtcaagaggtccttgcatctgggcccctctgggagctggcgtgcagggtcgcgatctcaaagccaaccaacagacccctccaagtgccaaggcttttgggaaggagcccctgggggccccgacatcctgcattgcagccagttcgcacgacctgtggcttggcccaagggaggggatgcctgctctcccacctgctgcttcagcgtgggcctgccagggtctaggggtgtccagaatcagcctgcaattgccgagggcaccttgggcctcaggggaatttagtacaccctgaaacccacaataccacgaggagtggggctctgagagaaggccagaaattggcggcatgaaaagattggaaaagcctattgtttattgacctgggaacggaaggagactgaaatcaaaagcccattaagactcagccttggctgggcccggtggcttacgcctgtcatcccagcactttgggaggctgaggtgggtggatcacgaggtcaggagattcagaccacggtgaaaccccgtctctactaaaaatacaaaaaattagccgggcgcagtggcgggcgcctgtagtcacagctactcaggaggctgaggcaggagaatggcgtgaacccgggacgcagagcttgcagtgagccgagatcacatcactgcactccatcctgggtgacagagcgagactccgtctcaaaaaagaaaaagactcagccttgtgtcaaaaatcagattaaagtgtggtttacacacccacatgtgtcttgagagagtgagaaagggagtggagtggagtgggatggaaaagtaaaaaaaatacaccaggcttgagcgtgacacttggaaagaacgttgggtgtggttcctgtcacatggaactgactggaggcagacagatcagatgcctactaagtttacgaggaaactgaatttgcctggactgaaaaaaagcttttgactgttcaaactttaaagtaacctccccaaacctagacaagcaggaggtgggccgtgggcccctatttcccagtgcccgcttggatgaggccatggtggataaccaacagggaagaaccttccaggaggctgagcaaaggaccatgtagttcctccccaagagtggaatcagagtctaactaaagacccttccccatggccatagctcagaccctggcgggagtcatctctgcttgggccaggggctcctgggtagctcctgtgttctttcctttcctgaatgagtgtgctcttctgttccctcttccgctgctgtataaagggtgcaagtgtaggtaactcatcttcttagttcattggctgcaggaacatgaagaattgcgtgtaaacacgatggagaagactgcatgcatgtgaccagctgctgcgctctgaggtcagcgcagaggccggatagggtttcaggtggtcgtccttgagggtgaggtgctccacgtgtgcaaagaatacaacagggatctggtgactggaggggtagaaccagacagagatgaccaagcctgtctccacacatagcagggccacactgccctgcctgccctgcagcgggtgtgaaaataccatgtctagagtgtgagcagagtgaaatgctgcttccaggcctgacccatcaaaacctcaggtgtgtgagcctcccccgactctgtccctttccaaggtaaccttcaaagctacccattaaaagtaatggagctacgggaccaaaggggcctgaatccccgcatctccaacatttggaggaaatctaccccactaggaaagcctgatttggactttacctagcaggaaatcaacctcactgtgtgacccactagggtttcagggtttatctgctgcagcagtgactatgatcttgactgacacagtgcctaatctgtgaacctgcagtttcaaaatgatgtgaggagcctgaaccaggcccccaggatagcagtgggcgaggtttacacagccataaacacaaaactctccttttcggatcccgtcctatgtgacaagctatttacagggcttcgtgtgtgctaggtgtttacatcatcttcataacccgatagttttgctttcaccatctctggttccagctgaggaaactgaggcaaagggaggttaagttcccatgaaggcagcagagctgggattcaaacccaggcagtccaactccagaacctcccttcctcccctatcctctcttgcttcccccatgccctcagcctccaaactactgcttacgggagcaggactatgggcctggccagagggccagagacatcaagtgggaggcgtttcagacccagggccaagcccctggcctgaccatgttcaccagccctcgcaccctcgtggatggctcagggcggatcttcctggggcttggccagagcactgcctgaccccagaaaggcggatcccaacccaggagccggggctaggtgacctgccaggaccccatctgctctggaagggctggaccaggcttggaagtgaacactgttttcaacgcaagcgccagggatgaggcaggcacttgaacttgtctgaggcagggctaattttgtcataaaccctaaaaatggacagccatgtggccacatagtccctacatggtcaaagctggacagctgacagctatgaatccgaagagctcatggtaattccattttcttttgtcagacagagaaaacaataaggataactgacttttcaaaaattatatattgggctgggcaaggtggttcacgcctgtaatcctaacactttgggaggctgaggcgggtggatcacttgaggtcaggagttcaagaccagcctggccaatatggtgaaaccctgtctctactaaaaacacaaaaattagccaggtgtgctggcagatgcctgtaatcccagctacttgggaggctgaggcacaagaattgcttggacccaggaggcggaggctacagtgagctgagattgtgccactgcacttcagcctgggcaatagagcgaggctttgtctcaagaaaaaaagaaaggtctaccttctagagactggacgttatatgtcatcggctttttttcttaagtgcggcctcttaaagatatttcaggagcagtgcagtgttgggtgactgaagctcctccaagatatttggggctcttgcaagagtgaggtgatagagcagtgaatggggttgggggctggccagagggaacagcttgctccctgtggagctgtacattctcaggctgtggagtaaattacagaaacactgtggcacttcttgtaaaattggaaatgcaagtcagatggttaactagagcctggtggagggtcacacgcagccccgggactcacagctttgaggtgtttcatggctacccctgggcagggccttgcagggcactgatggccccagagagtctcgtcatggcccactaacagaatgggtcatgaatccttgaaaacctctccttcaccaactgtagcctgtttggagaccatagttttccttagagaaatcatagctgaacccggctttggacgccttcgttgactgtgtagacctgagggtggtttcggcattgccagaccattcagctgtgggaatcagcctaccccataactaatctctctcttttgcaattccagagccgaacactgtcagctacagccagtccagcttgatccacctggtggggccttcagactgcaccctgcacggctttgtgcacggaggtaagaaggaagcgccctggccactccattcctgtcccttggctcattgttgcttctctggcagccgtgctgctgtctgacacacttgaggctcttgtgtttggtgaagtacaaacttccaagaagttgtacaataggccaggtgcagtggcacatgcctgtaatcccagcactttgggagatggaggcgggaggattgcctgagcttaggagttcaagaccagcctgggcgacatagggagacccctgtctctacaaaaaaataaataataagccgggcatggtggcctgcacctgtgatcccagctactgggaggctgaggtgggaggatcgcttgagcccaggaggtcgaagttgcagtgagccatgatcgtgccactgcacttcagcctgggcaacagaacgagaccctatctcaaaagaaaaggttgaacaataaatcacagaaatatgctggcaggctgggcgccataggtcacgcctgtaatcccagcactttgggaggccgaggtggctggatcacctgaggtcaggagttcaagaccggcctggccaacatggcaaaaccccatctttactagaaatacaaaaattagccaggtgtggtggcaggcgcctgtagtcccagctactcgggaggctgaggcaagagaatcacttgaacctgggaggcggaggttgcagtgagctgagatcgtgccactgcactccagcctgggcgacagagtgagactccgtctcaagaaaaaaaaaaaaaaaaaagaaagactctggcacccatttttcaaattggtgataaaaattaaacggatgactgcgtccctggggaggctcacatgcagccccgggatctgatagctgtgagatgtttaatgcctgctgagggtcagggcagggccttgcagggcaccgatggccccaaagactagcatcgtgactcaccggcagtgactcgttaataatgtttttcctctaatgtttgcatttattttttcccagtaagtacagatctcttctcaaacaacacaggccttaaagttcgtagcttggcttcccagagtttgggaaacagctggaacgcaagaggatttagctctaggttcacagatggacactttttactttaataatgtgtaattatttttcatgatttaaagaaaatgtagatagcatatcaaacctgtaatttcatggctactgtaattttgaagaagaccaaagtaagcttttaaaaacaagttggttgaagaaaaacgtcaaggagataagatcatagtgaagtggtatcagtgagagcagaagttgtgaaggtgctgtgtggttaatgaaggctgggtgcagctgttcttggtgtactgagctattcatctgtcccaggcataacaggcacttttgcacaatgctgtcatttctaactgcctggaacaccaagttctgttttcttctccactcagaaaactcctatttatccttcaaaacccagctcaaacgacaccactctgtgctggcttacatttatatttctaccagggacacctcaggagcagggattggatcatattctttgtgttggctccagcacccacagagagtcaaaggggcaccttgcagatacttactccatgagtgagaggcaccaatcactttcaggtttgggacattggctctgggcctatgagatggagtctcactctgttgcccaggctagagtgcagtggcatgatctgatcttgtctcactgtatcctccgcctcctgggttcaagagattctcccgcttcagcttcccaagtagctgggattacaggcacgtgccaccacactcggctaatttttgcattttaagtagagatggggttttactatgttggccaggctggtctcaaactcctgacctcaagtgatctgcccaccttggcctcccaaagtgctgggatcacaggcgtgagccaccgcgcccggccctgatgtgagatatgtttccaaagtttgtttctttttctttttcctacttcatgattgttttcgtcttcccactcagtggtggctgcactgctcgtaaatctgattaactatggtcttgccaagggaagctgtgctttataacagcacttccaggcccacgagcactatgacaatctgagtgtcttgctgcccgcagaacagctgttgcctcagaggcattccctgtttccccttccttactgcccccatgtctctgtcctccctcgaattccagggtgggctcagctccctcttccgagcctggccatcccaagcccaggcttctgccacttccgagtattgtgtttgagactcatacagctccattctgcctggaatttgtgaaactctgggctatgagttctgcttactttgtcgacatgttagacgttcttcactaaatggggcatttccgtcgtcgctgtctacgtgctgaaaagtccacacccttaagcccagtctttctttctttatgtgctgaaaggcatcagtgagatgccaggagtgggagaagtcactggagaagccccttggaagtccgcagcatgtcatgttcatttacggtgtctaagctgcttcactgatacaggcacatgttaagatgtgtattaggaataatggctttacaataatgcctattttagtagggattttctgcccacaatttgtaaaaaaatctaataattttaccaagcttaaccttctctcttttttttttttttttttttttttttagacagagtctcactctgtcgcccacccaggctggagtgtagtggcgtgatctcggctcactgcaagctctgcctcccgggttcacaccattctcctgcctcagcctcccaagtagctgggactacaggtgcccgccaccacgcccagataattttttgtatttttagtagagacgggttttcagcatgttagccaggatggtctcgatctcctgaccccgtgatctgcccgcctcggcctcccaaagtgctgggattacaggcatgagccaccgtgcccagccttaaccttctcttatagggcctggtaactcaccacgagtgaatgaataaaataaacaccacattgaaaacacgaactgtgattttatcgtattttcctgtaaagtactgttggcaagaatggcatctaaaatcatttgaatcaaaatcttcactaaactgtaattcactagatgccagttgcagaagaaaatggtgaagtggatgccaatttagcctttattctgtaattctagactgcgcaaagctgcgcccgagtcccgttttctgtgagttccacacactggctagccttggtcttgaggactttccacacaggtctgggtggtgataaactcatgaagggtgtcttggaaagggaggagctcttctgcctggaatcacagggagaacgcagtgctcccaccagacactagctcactgctgctttcctggttgcatggacagaacctcctgtctttagttaggggaatagtagagatctggggagtgagcccgagggtgtggagggtcattgtcccgtgcgggaggagggttgatgatggtgtgtgtgcagttgtgggttgaagggctcgtggagggtgtggaggaccgtcatcgtcccatgagggaggagggttggcggggtctctgccgttctgggttgaatggctcgtggagggtgtggaggaccgtcatcatcccatgcgggaggagggttggtggtgtgcgtgcagttctgggttgaagggcatgtgaagagggcaaactgggcttttggtttctgtcttcccttgagtcctgagtgagtcactccatggtcccccaccctcctgcatagagtgctcaggatcggcccagaaaagaccagttaccccctgttctcccctccactacccccacgtttgcttgtacagactgaaggggtgacctagcagatacctgtgggggtccagaccttgggagagggaagttcttgggggtcagccggtagccctgttcaaggcagaccttagaggagtcttgagcatgcattcttcacttctcaacttttggccatcttagttttttccttgtactttattttttatttttaaattaattattttatacttaagtattatgtggaaacaatccagagggcttgtgggtctctcttcctcccatcgctcctgcaggggtagctcctgtttctgattcaggactctgcttcctaagcatgaggctctgttgctgtcccttgatgcgtaagtttcagatgcatgagccccatcactgttcatcaggtggggtactgtgattactttccctcgaaacggtgttactacgaaagccaatggttgttctgtgccctccagcagctctgtaagatgctctcagtacagtctgcctgccacggaactgttccctgccatgttccctagaggggtccgccttcagtcctcctccacgttgctcattctgtgcctgctctaaactgctctcctgggacggcctttgcactcgcctgggttggatgccaggattcatggatcttcaatttttctctttgctggttttggtggaacatgtcctccagtggctccccaagaaaggcaatatattaactggaataaaggctcagctgccacccagacagcttggcttcaacaagagagaggactttttcttttttttttttgaactaacaatgcagctgtgagcgatccacagccgataggcagccccgtggtgctggggacccaggcttctgctgccctgtggctccgccagcctgggagtgccctcttggtgagccacatgttgcctatctcttcatcagcgtccagccccaaaggggtggagggcatattgaaaattgcagcctccccttttggccacaatgtcctcatgtggccacatctgtgggtgggtgagtgccgctggtcagacgtgtctgttagacattggagtgactgatgaaggaagagatagtctctgtcatggggcctagagggtcatcttcccaagctttgcgcgtctgaaaagacttgtggctgagcagggtgtggggaagtgttccttacagggcttggaagcgtttgttccatgtcttctggcttctgaggtttttgctgggaaattcagggactgtagattttccctccactttctggccgcaacctctgcctgtctgctggcctgatcttccctccccattccagccttcagcccttggcctatccttgatcttccagggactttttattactaacccatttatctggatagcaaatcacgtagtttgcagtttctgggtgtttcttccaagtgaagtgacatccttctccacccctgtcccccagacaccaccagcttagcagccgcaggcgattatgctgtgcactcacattgagagccatggttctggctcactggggtcaccccaggtgtttggtaggtaggaaggggcccaagaacttgcactgcccccttgctccttgcgatgctgaggctactggtctggagtccccactgggccgtgtcatgtctctctcaatctctgcgctctaggccacccttcccaggcagttttggcaggtgggctcacctcatgtaattaaaaagttttaatttcatctgtggacagctttttaaaaaattttttgggtacatagtaggtatatatatttatggggtacatgagatggtttgatacaggcacacaatatgaaattagtacatcggccaggtgcggtggctcacgcctgtagtcccagcactttgggaggccaaggtgggcagatcacttgaggtcaggagtttgagaccagcctggccaacatggtaaaaccctgtctctactaaaaatacaaaaattagttgggtatgatggcgggtgcctgtaatcccagctgcttgggaggcagaggcaggagaatcacttgtgcccaggagggaggggttacagtgagccaagatcatgccactccaatccagccagcctgggtgacagagcgagactctgcctcgaaataaagaaataaagaaagaaagggagagatagagagagggggagggagggagggagggaaagaaagaaagcacatcatggggaatgaggtatccatttcctcaagcatttatcttttgtgttacaaacaatccacttacactcttttagttattttgaaatgtacaattacgttattattgactgtggtcaccctgttgtgctgtcgaatagtagggcttattcattctttcaattttgtaataccccttaaccatctcccctggcccctgctaaccgcccatcctgtggttagctttggagcctttccctctatctcaggctccttccccggccaccagctctaccgagggagacgcagcctccttttgcttagagccagcccttcctctccatcctgccctcttctcacttctccgtcagatccggtctgtatgtctcctccacttgaggtgatgttggcgcctcccctgagaggttggatctgtgacctcgtctctgctgcctattaaggtcacttggggaactcttaaaaccacagacacccagaccccacccgacaggtgacccagaccctgggagtcggggtgaggggtgtccaggagctgtagtgtcccaagctccccagggaattctcggggacaggctggggcagcactgccgcggtaaacgtcctaccctgggaaagagaaacggctgtgagaaaggggcgctcctggactcgtgtgtccatgagtgtgtttcccttcttctcagcaagtttcccagttctgaaatccttcttgtcatcttcctgggtacccttaagtgagcagcctagtacccattttgagctattttgagaagccggaagaagaacctcattcctacagttagttactgtgatcctccctgaattataccacaagagaccccaatagctggggacggagggagttgagataccttgaggggcagattgaaccttgcggacagcggcagctccagccctgccctggaccggttttgttgggggaactgacccggctggcacccccaacaccgcacctttgtggtacatcagcctgtctctctcatttcagcctagatgtggccctcatggggccctcgtccatgggatgatccgggttgttctggttgcttctccggttcctgtatcagggtctttagagcgtgaggggaatggagggagggcatgggttgttctctggcttagaaaagaacctcaacgtttactgatcacatcggctctgagtaaaaactaactctgctctgaaacagaagtcaaggtgggtatcctcatcgggagagcttgctcagctcccatggtactgggaagcacaggatggagcatgtggcagggaagaggggccacaatagagtttcctaaactcatctgagccttagaaaccatctttgtgcttgttaaaagtgcagattccggctgaacgtggtggctcacacctgtaatcccagcactttgggaggccaaggcaggtggataacttgaggtcaggagttcaagaccagcctggccatcatgatgaaatctcgtctctactaaaaatacaaaaattagccaggtgtagtggcaggtacctgtaatcccagctacttgggaggctgaggcaggataatcacttgaacctgggaggtggaggttacagtgagccaagatcataccactgcactccatccagcctgggtgacagaacaagactctgtctcaaaaagcaacaacaacaacaacaaaacaaacaaacagattccccagcccttctcctggaggttttgctgcagcagggctgggctggggcccagaaacctgtatttttagcaacaagtgccctgggtggctctgatgattcaggggcctcagaaacccacagctagagtgtaggtttgtctcaatggatccagcaaccgtgtccctatgtccagcaatctcccacccatgtccctggacctctccagagcattggacaccactgacctggccaccctgaggtcccctcacaggatttcaggccattatgctttccaaggccttcatcctcccacgctggtgggcgccagggtggctggggaatgggcctgggtgtctgaatgttgatcgcaccccgagtggttctgcgcacatcagggggaggaccctggggctctctggaggctctgcctcctcctctttcacctgcccctgagtgtgggtgtgcccctgaggtctgccctcaccctcttcccaccttttctcccgtgagctcacctgaccccacggcctcagctcccgcctccaagtggcaactgacagattttctaatatccagctcagttgttactcccaagctctggcagcctgtggcagcttcaccttggacctgctcttcctctggattccccacttgctgtccttgtcctaacttctgaaggtgacgtgtgaacggtgccctgaggctgtgacctgtggcagccctcacctaacctaaactctctgggcctttctctcctccccaccagtgagataatgcagggattacaaacagacgagataacacagggaaggcagcacatgggaggcatttaagaaagatcagttactttcataacttttattacatttactttattagttttattattacagacatagagaatgttctgctccatggggaactcaagcttttttctcatatccaggggagcgtttacaaaataggatcatgcacttgaccacaaagagcgttttaattataagttccctaaagtgagacccattaagcctaagcctccttaacgagaacatagcccctggaaatggaacactcctgcaaataactgccggccaaagaaaaagtaacgtctggacttatgattatgtagaagataatgaaaactgaatacttcctatcaaaatcggggagatagctaaagatgttttcggagtaaaagtgacaaactttgagcttattacttaaaaggaaaaataaaaaatacctaagtgttggaactggaaaaaaaaaataacaaaatccacccacaggaaggaggcggaaagactcagggcaggagcaggccgactttatgtctctgtctgggtctctgggtccctcctctccccatatcttggagctgtcctcccagccccctactgcaatcccccaaatccaagtctttaccaacacagaacctgtaaagtttgggccatcagagcttgttccgctgtcccgtccaagtccaagcaccctctagttgcagcctactgggcactgccctggcacctggtttgcagaatgtgggtgtgaggtcatgactgagccccttaactgggatgactcggcctctgctgccgaggctggagaccacgtctgttttgcctgctctgccagccccaagtcacagtgtgcacacctgggtcaagggagtaaatgaaagccgacagggcgaacatgactgttgatcggccttggcggtgagtgctgtcatggcagaaaatagtggccaggacgtagtggttttctattctgtgctatcttcagtctacaaataagtttatcagtaaagagccactgactgcgccagctatgacagtctaggagggtctggggagatgtactggctgtgctgggagccctctgtccggtcgctgttccctccgcccagtcgcttttccctccgcccagtcgcttttccttccatccagtcactgttcccttcacgtggttgcagttctctccacctggtcatggttctctctgcctggttgcggttccctctgcctgtggctgttccctctgcctggtcgtggttccctctgcctgttgctgttccttctgcctgttgctgttccttctgcctgttgtggttccctctgcccggttgtagttccctctgcccagttgtagttccctctggttgctgttccctccgcctgtggctgttccttctgcctgttgtggttccctctgcccggttgtagttccctctgcctggttgtggttccctctgcctgttgcagttctctccacctggtcgtggttccctctgcctgttgctgttccttctgcctgttgtggttccctctgcccggttgtagttctctctggtcgctgttccccctgcctgtggctgttccttctgcctgttgtggttccctctgcccggttgtagttccctctggtcactgttccctctgcctgtggctgttccttctgcctgttgcggttccctctgcctggttgtagttccctctgcctggtcgtggttccctctgcctgttgctgttccttctgcctgttgtggttccctctgcccggttgtagttccctctggtcgctgttccccctgcctgtggctgttccttctgcctgttgtggttccctctgcctggttgtagttccctttggtcactgttccctctgcctgtggctgttccttctgcctgttgcggttccctctgcctggttgtagttccctctgcctggttgtggttccctctgcctggttgcagtttcctccacctgttgctgttccttctgcctgttgtggttccctctgcctgtttgtggttccctctgcccagttgtagttccctctgtctggttgtggttccctctgcctgtttgtggttccctctgcccagttgtagttccctctgcccggtcacagttccctccacctgtggctgttccttctgcctgctgcggttccctctgcctggttgcagttccctccgcctgttgcagttcccccgcctggtcgtggttccctccgcctgttgtggttccctctgtctgttgctgtcccctcctcctgttactgttccctctgcctggttgctcttccctccgcctgttgctgttccctctgccagggtcttggttctttctctctacctgggttacccagacaactgtaaggctgcctgtgtttttctccaggtctctgaagaaaaggaaagagacctctcatgagcactctgtataaattagactgcctcagcttactttttattccaaggcaccatcactcctgacacactttcctgtgacctctgtctgtctgttcactcctgcattcccacttagcgcagggcctggcatggagtcagcactcagtagctgaatgactggactgggaaaaatgaaggtcctgcgtgggaaggactgcggactgtgctggtgccgcgcagtcagccccacccagaggattgtgccaggctgcacgtgcgctgcacgtgagaaacacgtaatgaccgctctctaactcgagaaccagtgaccaggcacctcctgtgtgccgagccccgccgtgctccaccagggacactgtgaagaagacacagccctgctggctggttgggagtcaaaccttctgcgacaaacatccatgcaggtgtctagctgctggggagccaaacaacgctgctgggggtcttgaggccaggggacagcacagcttagcctgagactataggaggaggcagaggaaagggaaggcagagaaaacatgggaggggacgcaagtgaggcctccaccaagacgctcttgttcacttggtcttcttggggcagttgtgaaaaaacaatcttttgcacctgcaggaggagttgactttcactgaaaaatgcaaaagagggcacagttactcttttccaattccgtgaccttgtttggccggagcccccactgctacgtgggacacaacacaccagaccctcagtgttggggcaaggaaggaaaaaggtggacgaagagctgttccctactcttgaggaacttctggtctagggggatcaagaggtgaacaaacaaatgctttgggacgccgctttcttcctcgtgaagctgagtggcacaggctgcagttaaattccttctagtactcgccttctaggatcttggtgtttgaaaacatcgttctccaggttcttctgttctgaagaacagcttcacgtccatcctgatgcttcagcgggggagcgggacgtggggactggtgaacttgaaccttgaaccccgagatggtgtcaaccctgaaagcctgggcgtggggttcatatcactccagtccaagcatcctataggcacctgtcccaggaactcactttgtcctgcccacactgggtcctcctctcagccgggtccctggtggccagcacgtcatccctctcaaatcatggggcactgacccctttccagaaatatggagtatttggttgaggtcttgccatgaaccgtaagaacgtcctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgggggtcagccgccccgtctgggagggaggtgggggggtcagccccccgcccggccagccgccccttccgggaggtgaggggcgcctctgcccggccgcccctactgggaagtgaggagcccctctgcccggacagccgccccgtccgggagggaggtgggggggtcagccccccgcccggcccgccgccccgtccgggaaggatgtgggggggacagccccccgcccggccagccgcctcatccgggaggtgaggggcgcctctgcccggccgcccctactgggaagagaggagcccctctgcccggccagccgccccatccgggagggatgtgggggggtcagccccccgcccggccagccgccccatctgggagggaggcgggggggtcagcgccccgcccggccagccgccccgtccgggaggtgaggggcgcctctgcccggccgcccctactgggaagtgaggagcccctctgcccggccaccaccctgtctgggaggtgtacccaacagctcattgagaacgggccatgatgacaatggcagttttgtggaatagaaaggggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaattatcaattaaaaaaaaaaaaaaaaaaagaacgtacttttctacctgtgtacgggtcggatgggggtgtttttcttttcttttctttcttttttttttttttttggtgccacattgtccagcctgtgcttctctctttagctgtggtcgccaggggcatgcgtggcagatacccactgacaacatttccctgttccaagtgatgaacacaaacccttcaaaaggagcgtcccctggactcttggaaggaaactgacaccccaccaaaatttctgggccttccaggaagcgaccttgctttggtagcctccaggctgaggccgcagcctctcactggcctgtccttcttaggggtgggcctgggggctcgtgtgtagctgcagcctcctcttgctggggcctccatggcagttgggatgcaaaatccatctaccctttctctgcttccttattttgaaagtgaagcatggatactcaaacatcaggaagcagtcaagacctccccccttccctgcttcagactctatagaatgtaaggaatcaatgggcgtgggcagctcttggcccttctccctgggtctatgatgctcccagacgtccgggaaccacttagtgaatattcctctgtccatggtcccagccacagaacctgggagggagaggccagggctgtctcgcaggttctcactcaactggatcttttcagaactcttgtaattactaacgggtggggtatttaaaacaagatgaagttactatcattttcttaatataggaggccggcgcccacgctccgtcagttgggattaaatatagaaatgggggcatctcagattgccgcccacagaacagacagcggcacacgggctccgagctgtgaactgccgccttgggtttgcaggcaagcctgacccagtcacgagcaaggccttgggagaagaaaatgaagccttatttttaagccagttgacagatcaatacttaaaaacaaaaaaacacaaaacaaaaacctataagcagttaaatgttacaattaaaaatacctttggtacctaacgtgtatacattagtggccaagaaagtcttttttttttccccgtaattcttgaaataaatgcagctccaaggacggcgggtcctacaattttgttgtcatcttttaaattacagatcttgggagatgaggactgcctgcggtggactgtaatgtgccaaagttattttccaacgttggcagcacccgttgtgcctgcggtgggggaaattgatgaggcttttcagtaggaacctggaaagaagcatcttggaaaaaacttaggcactcgatattttaaatacagcggaagaaagtgaaagggagacagtggcttccagcgtcagaagcggggtggctccctctggcaaggcaggggcccaggtggacagtggtggcaagaaaggcagttgtgaggaaggcactatgtttttctgggttgttttcttaaaatttagttttctcagttaacacattgattgtagtgtcttgtgtgtgctgtcatagacacaggcattgtgtggtagcagtctttacacgcaggacacgatgggcacgtggctttctaatgatctcacttctgcagggaccatctgacctcattgctctctctcggtggcaggtaaccagcaggcttggcacgaggccctacaacaggatgcccagggttgtgtctcgccggtaggagagggcttgtgatcaacagtggttgattaaaatctcagtttttatgagatcactttccttccctctaagtagccagcagagttcagctgacacacagaccatggtttttctatgtttttctcaagcccactggatcgacactaaaaagtgcatttgtgaaaacacagactggggtgggtggaggctgaggcactggtttttcgccaggtccgtcttctcgggtgggtttctgctcccgcctctgatcctgctgcctcaacacctgcagggactgggagccttcgctgtcgcaaggccaaacgcttggtttttggaccgttctaagtgtttccccgagaaaggttatctcctgagtcgtaaagttggccttgagttggcccaggatcctactatgacttctctgggaggtgcagatgacctgaagtggacaaagatccttccagatgagatcctttgggagctcagagccctcctgcctgctgccctggccagtgtccatgaggccagcccaggtcttgaaagacctccttgtctgccagagtcaggatgctacaccgtcctgatttcccaccgctcgtgagtcactgttccgggtccttagaataaaactccaggtgtggggtataatctgataatagacacacatggtgggattacgacagcccccctggcctgggccccagaatagcactgactccatccaccagtcttggccttttccatcgttagtataaagttgttgtttcatagcaggtctgccgctgatctaaactctgcgtggtttcccaggccggtgcgtgtgtgctggctgctggggctggaggaggctgtccctgtaaatgtcaccgtccagctcacacagcaagatcattttgagtgtgggcttggttttttggccggtcatcaagctcacctggctttggggtttctgggaccggatgagcttttcctgccctcatctgtgactaattcttgacgcaaattgttgcctgaaggagccacatactttgtggctggggcagcttgcttgggctggttgtgacctgttagtcaacctgcattcattcattgattaattcattcattcagcaaccatttcctgagcaccagatgccagctctgtgttgggtcagggacacagggacaacgaggcaggtcctcacccagtgcaggcgtccatgtcacatcatgcagtgtggtctgggggtgccgtgtggagcctgcaggagcatgggggtggtgaagagggtattcgcacaccaggcactcaatagccgctcacatcttcccctcggggttgactgtcacgtgctttggatcctgagcggttttcagtaacatgaggtcccttgtggagtctcataccaacaaggtagccttttggataaatggggcaaaccccggtttgaaggagctgattacaactccttccatttattctctcattctgcttttcaggatggaagaacaaggggttaattgtaggcacttcctaagttctgaacattaaatccaacacgaacccttcctttccctcctccttcccccacagctaaaccaccctgagttgatgacaccagctggtggccagcactggacactctgggtctgtgactttgaacgctccttcctgcaatcatcttgggaagaattccactctggactcgatgtcacaggacaggatggggaggcaacatggcattgcctctggtggcccaaggtcaggtccggtcccatcctacccctagtggtgtgactttggaagcgtgactctccatgtgtctggttcctgacttgtagaatggagacagggaggctgctgcctcatcgggtgttgtccagtgagacccggtgttggtcattctgtgtttgtggagagggaccggccgcgcatcaggatagggtgctgtccggtgagattccgtgtttgtggagaggggaggggccggccacacatcaggatagggtgctgtctggtgagattccgtgtttgtggagaggggaggggctggctgcgcatcaggatcgggtggggtccggtgagattctgtgtttgtggagagaggccggccacgcgtcaggatcgggtggggtccggtgagattccgtgtttgtggagagggccggccgcgcatcaggatcgggtggggtccggtgagattctgtgtttgtggagagggccggccttgtgcatcacaggatcgggtggggtccggtgagattccgtgtttgtggagaggggaggggccagctgtgagtcatggactcaggctgcctcagtgaacagacaaagttcacggctcatggcactgactttgcagccgagttcctctatgtgacatgctgggccatgcctggcaccagcttccccggcaatgccagccgctgccctcagcatccagctcacggcccccagcagcatcaggaccctgtgtccatgtgctgtcctggctcctgatgctaggctttggtgtcccttccttaaaactcctgcttgtccctggctcatttgttcctaggaggaccctgactagctgctggatggcgacgtatctccccctgaggaaggccacatatagtgcacatttggtgataaacttctcacatactccagttaacaatgtgtctccccagcacacacggtcctgctggaatcctgctggctcatcgtcattcctgtgctcagctgttgtcacttcatcaccaggttgccattttctgaatataaatggtcagcgtttcatggcaaatgcagctggtcctggcccccattggaggctgacagagcttctgttggctgcccagggcagtatttagagttggtctgtgggaaatgccgtggaattccgtggcacacctgtgctggctgtgtgtgtgagtgggaccactagtccagctgttgtggtcacaagtcagtttctttatgaggcagatcaacctagaagaactcagtctgtgggctgcagctctgccgctactaagccccttaaacacacgcacacacgtgccctacacacacacacacacacacacacacttgcgctctctctctctctctctctgaagccatgacctagtacctagtcaggaggtggccgggtgggcctctctgccctctgtgtgtggcgtccggtaaggggaggccgactgtcctctgtgccctctgtgtgtggtgcctggtaaggggaggccgactgtcctctatgccctctgtgtgtggtgcctggtaaggggaggccaactgtcctctggatccctcctttgcccacctgagccaagtgtgtggggttctcagccagcatgttacctggtgttctgagttatttcatttttctttccttttctgttcagcctccaaacctcagatctgtccccaaagccctaaattaaattagtgttcagctcaacagatgtccaccaaatccccacatcccatgatagcagctgccattgctggcagccacatggtcatcccatttgctcctcagtcaccttgcctgtgggcgccgtcacctcctctgcctgacagacactgagcccacggctcagggagggcaacctgcctgcccaaggtcacccagccggcagtggcggaggtgatggggactcactcccagccaggctatggcagtgactctcacactctagacggggacagagggactcaagcccctccaggcatgggcgatggggcagggggattcgcaccaggcctcattccagactctgctcctgaaccacactgtggtaggggcccactcacaggtgggtgtggttaattcagaagctgaggctgccccctccaaggaagccctcgatattgacacacggatgatcctattctgttttgtgttttcacttccttgccgtcctgggctagggacctggcccaaccgtcctctaccctgtgagggctgggcttgctgggcctttatggaggccccttgccatgggagagagaccaggagagcctggtggtggcttagccaacctgcaccttctatttccaataacaacataaaaccaccttgcagaactgtgagagccaagccacctgaagcccagaggtgccctgccctgcctggcacccggagcggcatcttatttgcctgggggagaaaatccgctgcctaggattctttcccttgccaaacagctattttcccggtatttcacctgcactctttcttcagaatcggacctccatgtgacttagggcctccgttgttcatttgaaaatggggatgctgattgaaaaatggagatgcacctgggcgcagtagctcacacctgtaatcccagcactttgggagaccaaggcaggtggatcacttgaagtcaggagtttgagaccagcctggtcaacatggtgaaaccccgactccactaacaatacaaaaattagctgggcatggtgacgggctcctgtaatcccagctacttaggaggctgacacaggagaatcgcttgaacccgggaggcagaggttgcagtgagccaaggttgcaccactgcactccagcctgggtgacagagagagactctttctcaaaaagaaaaagaaagacggggatgctgatgcccccagcacaggttgagccgaacagatgccccaggtgtttgaaaggacaggcgaaagtgcagcgagcgtgaacctggcccctcctcccctcacctgtcctacctcatttagcagcatcttcttatagcttctgtgggaaaagtcatggtaataaaaacataatgctttaatcaataacacccatgtctctgttttagctttttattctgggaatgctcagatatacacaaaagcagagtgtagagcatcccaagcccctgggtattcgtctcccagcaccagcaatgggcaacacctgcccgttcctgcctcacctctttcccactgcggtatttcgaagcagatcccagatattgtatctaaaagataacttcctaccttgaacacccacaatagcgctatcacatcctcccaaacacacttataagtccttagtatcgtcgaatacccaatcactgttcacatctcgccaggtgctcatctttttctctagttggtagagtccagatgcccacaagatgcgtgcctctcattaggtggatgtgtttcttgaagaatggggtccccatggggggcgctaggtaggagctgagcagcagggggccctggctggcctctgctcggggcccccactaattctgctctttccagcttcacctgctggatgctgtgggcatttgattcccaccctaaacgtgactgtacaagtctggttttcgcttgtgggatggagtctggttttctgcctctctctgggtttattaggaatcattctgtgtccttggctgggtgcagtggctcacacctgtaatcccagcactttgggaggccgaggcaggcagataacctgaggtcaggagtttgggaccagcctggacaacatggcaaaaccctgtctctactaaaaatacaaaaattagttgggtgtggtggtacacatctgtaatcccagctactaggaggcggaggcaggagaatagcttgaacctgggaggcagaggttgcagggagctgagattgtgccactgcactccaatcttggtgacagagcgagactccgcgtcaaaaaaaaaaatcattctgtgtcctagggtgaatgtacataactttctaaaatttctaataggtattaagttggttaatatcactttgctgcttttgtaagtcaaatattgttgactattggcaatttcatgtagttcaacctaagtaaaggtacattttaaatttttaagtgaaataagagtcaggagcggtggcctactttactcctgtaatccccacactttgggaggctgaagcaggaggatcacttgagctcaggagtttgataccagcctgggcaatatagcaagaccccatctctgcaagaaaataaaaaataaattaaaaagttatggccaggtgcggtggctcatgcctgtaatcccagcattttgggaggctgaagtgggcggatcatgaggtcaggagttcaagaccagtctggacaacatagtgaaaccccgtctctactaaaaatacaaaaaattagctgggcatagtggcacgtgcctgtagttccagctactcgggaggctgaggcaggagaattgcttgaacctgggaggcagaggttgcggtgagcggagatcgcgccagtgcactccagcctgggcgacagtgcgagactccgtctcaaaaaaaaaaaaaattaaaaattgaaataattgtaatatatgtgttgtaccagggatgagaactgggggtgggggaccagcatgtgcacagtggtggtccatcaaataagagagactgagtaaaagcggacatctgcagcccgagtattctccagtattctttcagtgagtctttgtttgtttgtttgatataacagctgtactgacgatgatccacataccacacatttcacctatttaaagtgtactggcctggctcagtagcacgactgtaatcccagcactttgggaggtgaggtgggcagatcgtttcagtccaggagttcgaggccagcctgggcaacatagcaagaccccatctacaacaatattagccaggtgtggtaacatgtgcctgtcatcccagctactttggaggctgaagtaggaggatcacctgagcctggggaggttgaggctgcgatgagctgagatcacatcactgtactccagcctgggtgacaaagtgagaccctgtctcaaaaacaaaaataaagtgtacaagttgttgattttttttttttgtatttgcacagagttgtgcaactactattgccgtcaatttgagaccattgtcattactcctacaaagagaccctgtacccattagtggtcattcccatatccccctaatcccttatccctagggaacccctaatctaccctctgtccccatggacttgcctcttctgggtttttcctgtcaatggcagcatacagtgtgtggtctttggtgtctggctccttttgcttgcatagcgttttcaagcttcattcctagtgcagcgtctattgttccgttgtatggacaggccacattttttttctccattcatcatgtatggacctttgagttgtttccactttttggctgctatgcgtacatgctgctgtgaaagctctgtacaagtttctgttgaacatgtatttcttctgggtatctgcctaggagtggaattgctaggttatacggtccctctgtgtttatcctcttgcgaaacttcaaactgtttccaaagtacctgcacctttggctcccactggcagtggaggagggttccagtttcccccacatcctcgccagcacgtgctgttctgtgacttcaggattgcagccatcccagttgatattgtaacaaaacttgcccagcagggtgagatatctgtagaggacaggaaaagggctgttttgttagtggcttggcatatcagccatggtcgtttttttcaaaatctcctgaggaagccccatgtagcgcgtgagccacagcacgtgcggccgagcaccctgcacccctgctggctgcggcccttgctggtggctagtgggaggggagggctcgagttgtaacttgtttccagggtgtgaaataatctcctctgcctccgtgtctcatctgccgcatgtccctttctccgcaggtgtgaccatgaagctcatggatgaggtcgccgggatcgtggctgcacgccactgcaagaccaacatcgtcacagcttccgtggacgccattaattttcatgacaagatcagaaaaggtaaccactcttctggcaaagacgagggaggcagtggccctcggctgcttgggtccctgcaccagtttgttttctgttcacacccagggtcatgtgggccttggtgtgtgcccatctgccacagggaacaggaagctgaggtttctttctttgtccttgctgtttattgacttgatgtttcaatctggtaaaatccttgactcagatatgacggggccattatcctcctaaagacctgcctaaactcaccctctgaaaacgctccacagacagagctctgggaaggtcctgtgcctgcagctgccacgaccctggacaccaaacctcatggcagcacatttcattttgggagcggaattaatgattcatgatttaggcagtggcagggtcagtacagaaaagcccgcaggagcccctcctcggccagccctgcccacgccacccagggcagcactggcattgggtggtttttctccaccacaaaaatccaaccccagccacctggcccctgcctggaaatggtgtcagctgtccctggggtatgtgtgccagcttgacaggccaggcctctgcagtttgtatgagcagaggtcaccatgcttgtcttatgtgactgctctctgcagaagtacagtgaagtgcacctgacacgtggtgatttttgtcagtgtgacgtctgctgagatgaggccgtgcaccccctgcagcagcactgcctcacagaccgagggtggtgtcagcatcgtcagggcctggtgctgattctgaggacaccacctcattaaagcggcttgttggaggagctgttggctgagaccagccccttgtcgtgggaagcgagagtggaagaagtgcaagcttggctctccttgccacagctcctgcccaccagagcctgagcaggggcagactcccaggccccgggtagcccagccttggtgctgtctccggcagctgctactgcagaacacacctggcaatgggagaccctggactagggcagaagcacctaagattggaatggtggagggctgcctccctccctggaattactgagagaaggctaggctcacacatgctggattttggatgctttgtggtaaggagaaggaaggtctctggcgttgctttcttccactttgcagaatccttttcttttttccacaacacgatcttattctgtcacccaggccggagtacagtggtgcaatccctgctcactgtagccttgcacttccgtgctcaagtgatcctctcacctcagcctcccaggtagccaggactacagacatgcaccaccacaaccagctaatttttgtattttgtattttttgtagagacagcggctcactcagaatcttttcttgaccaatagatgtttgccacaaacatagaccacaatgtcattttagaatctgcccaaaacaagtgggtcctctgtgttttagctcgtcccccacaggcctgtgtggtgcgtgactctgcaggagaatctgtggcatcatattccatgctattttttctaggactcctgcctgggtaaatcacgattagggtgaccttgtgaaagacggatgcacagcccatagtgggaaacgtgcattccataggacttgccgtgctcagttgtccctgagtgtccttggagaaccatcaggaaagaaatagactttctggctgagcgctgtggctcacgcctgtaatgccagcactttgggaggccgaggcgggcggatcatgaggtcaggagagcgagatcatcctggttaacatggtgaaaacctgtctctactaaaaatacaaaaaattagccaggcgtggtggcgggtgcctgtagtcccagctactcgggaggctgaggtaggagaatggcgtgaacctgggaggtggagcttgcagtgagccgagatcgcgccactgcactccaggctgggcgacagagtgagactccgtctcaaaaaaaaaaaaaaaaaagaaaaagaaatagactttccagcgaagcacaaaacacaaaaattagccaggctggtggcaggcacctgtaaacccagctacttgggaggatgaggcatgagaatcgcttgaagccaggaggtggaggttgcagcgagccaagattataccaccacactccagcctgggcaacagagcaagaatctgtcgcaaaaaaaaaaaaacacaaaaaaacaaaaaaaaaacaaagtccccacccttaactccttgtacaaccagaattaacttttaagggagagtgctaggaggtgtgttgtggttcttggtcaataggaatcattaattttgagggaaaaccaggaactgcagtctgggtcgaatgctttttccaggaattaacttagcaacctagaagacatctggggcaactcggacgaggagctgctttgccaaaggctttccacaaggctaacggggggacttaattttcagaagccacaatttctggcaggacattcacttggattggcttccttcacgcagtgagggcaggttgggtgggctcgcctgattcccgctgtcccaagccacacccagggcctgacagtgggccgcccaggcccccacctcgtctcggctgtggccggggcctcctgggtaaaacactgggccccttaccagaaacagaaagactgttgttttcttagatgacatcttgttttgtgtatagaggaatttggaccaaactgaaatagcagccatggagtctggcctgtttctatgccagtatcctccagggcccactagactctgtcacatccaggggccgttgaatgctgtcacactcgtgtgttgttttccagaggattgtcacacctgccaggtcctttgcagggaggcgagggctgtgctggccgagtggggccagggttgtcagagcagggtcatcatgcttgctcctaggatactgcaccttagatcagctcgctgcctcccacgcttgccccttggtagggaaacagagcgaggctgtgcggggaggcacggcccctgctggctctgggttctgggtgacactgggtgggtgtgtgagaaaccgcggggggctggcctcacagttccagcgtgactttctcatggactctgctggggccgctgtacaccctcgagccccacacctgcctctcacttcgaccataccatgaaggaggtctcgagggccagaccctgctgccctgccgggtgggggcacacattattgtggactatcccagtcggtgtcaagagcccagggagctactggcaggcacagaaacctcacctcgggttgcacgtggtgcctggcagagctttgtactgtagagaatgggcattgctttctggtgggctcagaacaacagacatctgttcgcccccagttctagaggccagaattctgaaatcaaggcgtcagcagggccaaggtccctctgaagtcaggggaggatccgtccctgccccttccagcttctgggagcagcagctgttccttgacgtttcttggcttgtggctgcgtcactctggtctgtctctgtggtcacaaggcctcttcctctgtgtgtctctcctcttctgtctcttataaggacacttgtcataggatttaggacacacctggagaatccggggtgatctcatctcaagaccttttgcttaattatacctgctaagacctttattccaataaggccccactctgaagttgtgagtagatgtatcatttgggaacccactagaaatgctttgtctccttaaagctcaactcatgtagatactagctcacttccacttttataaaatcatgaacttgataaaatcccctctgggattcaccagccccaagctgcctctgtctctgtggatgtgggacctgcccttgtgagagccagcagtgaaattgacgtcagcctggagaaggggccactctaaggaatgcagggagagtgaccccagcagtcccccaggggccccccacttttgagaagagcagtcatacagctggcaaggggctagctccggaccctgacttcagagagcagcctcactagagccaaatgagagtctctacagttagcaggcctaggggctactgatgaaggaccagggcctttcctctaaatggcagggagtcagggtcagtgtcagaagtgagaacggatgtgacgtctcctccataagccccagaaggcagcggttttgtaataacaagaaatagtcgcatagaccgagggttgcagttctttgtgttggggtgttgtattagtattaaccttaagtcaagtataaatttaatccacataaggattacttttaaaatcatacgtttatggaaaaggtgcctgcaggtagactgggcacatccaggcggttggagcctgagggcacagcagggccatggcagccggtcacagcccgtgcccctcatgtgagcagccctgagaggccactggtccccctgggaggaaaccccctacctcccacaggctgatctgccacagtggggaaaagcccaggagttgagacccgttgccagtcatgtggcctccatgagtttcctggggctgctgtaacatttccatacacagtagcttaaaatagcctgcactcactctcctgtaattttggaggtcagaagtctaaggcaggtctgcaggctgcatcctaccaggagctggagggaagaatccatgtctcgcctttcccagcgtctgaggccacccacattcctcggctcatggtcccggccatcctccagcctctcctaacagcatcccattccccccctcgtgctgacactcctgcctccctctcacaggacccctgtgattctatcaggcccacccgggtaccccagaacaatcttcccatctccagggctgtcacttagtcaatgtctgcagagtcccctttgccacgtgaggtcacaggttcagtggatttgggtgtgggcatcttttgggagcacattattctgtcttagcaggtggaagggggttttctgatgtgcccatttcagcatattttattagaaaaatagctgggcctgggcacgatggctcaagcctgtagttttggctacttaggatgctaaagtaggaggattgcttaagccaggggttcgagaccagcctgggcaacacagtgagacccctgtttctttaaaaacaaaacaaaacaaaacacacacaaaaaaagcaggctggtcacagtggctcacgcttgtaattccaacactttgtgaggctgaggcaggaagatcacttgagccctggagtttgagaccagcctgggcaacatggtgaggccccatctctacaaaaatttaaaaattatctgggctactcaggaagctaagggaggaggatcacatgagcccaggaggcagaggctgcagtgtgagccgtgattgtgccgccgcactcagcctgggtgacagagtgagaccttgtctcaatttaaaaaacaaaaacaggctgggcgtggtggctcactcctgtaatcccagcactttgggaggccgaggcagtctgatcacctgaggtcaggagttcgagaccagcctggccaacatggtgaaaccccgtctctactaaaaatacaaaaattagccgggcgtgggggcaggcgcctgtaatcccagctactcggggggctgaggtaggagaatcgcttgaacctgagaggcagatgttgcagtgagccgagatcgtgtcactgcactccagccggggcgacagagcgagactccgtctcaaaaaaaaataaaataaaataaccagaaaacagtgggaatgcggaatggagacgccagacctgtggggtggcttctccagatttaaggcaggaagtgctttgctttctctccttcagcctcccgtaaaactgcctccttgggagagtgaccttttatgcgatattgaccaagtgccaggccctgtggctgtggcttgccctcgcttgggtggggtgtctgtcaggaagttacacggacagctttgcttcatccagacattggcccaggggttcagaagataactttgagtttcagccacgaagggtgtgtgcctaggaggaacttacgaacttggggcacttgtcgtggctgggagaggcctcacccgcggccatggaggccactgccaccctgccgtgggcccagctctgttggctgcaaatttggcatttatgaaccagactcttccaggatgccccacacttgcctagaccacagagggccacctctgttaccctcacccctcaccagcccaacccagtgccacctccattgtcacagccttttgacgctagggacctgctattcctctgctcacagcctccgtggctccccgtgacatgccacattcagcttgagcccctccagctggcacttcaggtctgctaggacaggctgccacttgtcatagctgtccccttacacctttgcgccaactagcccggccaagcacctacggggtccttagcaggtgtgtggcaagttaaactctcaccaggcagttggggtgaaggaaggaccgcttcatctgtgcgactggatctcatgggaaatgggaagtgcccacccaccaaaggcgcgtggagttcccaggccagcaacggagttggtgctggggacgcgagggccacgacaggctggagcccgcacccaggggaccagcacaggggaaggcacgtggagcccggtagcacccacagagtgggagagcctccgccccccaggcaagcagtggagcccctaatgggagctgtggggtcacttgctgtgtggatttttttttttcagttgagacattaaaatgtccagaggtagctggtgtgaaaaagttatatcgttgccttcagtgtaatagttttggaagcacttggtgagaaaacctaaagttgacgttttcttggggagaaacgatctccactattagggtgaaaaataaggagtcttctagaaaaggccttggggtgtgttatgtaagaaatactaagtcagttcactgtttccaggcttttcttacgaaagttaacagccacagctctttttggagcataaatgctgagcttttcctaaactctgaaacacttggcaacctctcagtcttgctaacagctattttttttttattttgttttcttttccaaatccctggcatactgctgaaatctggctgctgccgcccctggagagacgcccgtctgctgggggagtcaggctggggtacctgccagcgctcacgggctgtgccactccaggcaggctcaacaactacttcaaaacagaaagcggctgtaattcacaattcagcccactacaggcaccgatacgtttaactgtacctaatatgacacacttgatgccaggcattgtgccacctgcttcataccatttacttctcacacagcccagtgagacagggactgtcgctatctctgtttgtttttcccatttggaagctgcaattccgaggggttaaggaagctgttcacagccatggagctggttccaggtgggactgggagggcaggcccagcagctggtctctgggaccagagctctgagcccatgctttggtgtccccagcgacctggcctaaaccccacctggcatccgccccgtcagggcctcgagtgtgagtgatgaagcttgaccctcattgattacatgcggctacagccacctttgaggcctgccctggactgcggagtgactgcacctggtccccgtgcacttgtgccggaactcctggctctcaggcagcttgaaaatgcatcgttaagctgggcgcggtggctcatgcctgttatcccagcactttgggaggccgaggcaggcagatcacgaggtcaggagatcgagaccatcctggctaacatgctgaaaccccatctctactaaaaatacaaaaaattagcttcttgttactttgtggtatgattccttttaccccctgcaagcctctccagcggtgcccctggggcacactcaggccccaccccaaattactgtcctgggcctgtcatgtgacataatgaatgcgggcagttgacatcagtatagcctcagagcaaggatagaaccacatgggttgactgtgtctcctttaaaaatgtggaggaagttacccccaaaatgcccaggtggcctgtggagcccctgatgaaggagagccactgtgagtgggtcgtggctgggtctgctgctcccctgcattctctgaagctgggtgcatggggaaagcatttgcagatgaggaaactgaggcacagtgcagtctcctggcttgtccctgctcagtggccaagcctggatttaaatccaggcccatctgactccaaagccatggaactcagggctcctcccgcatggcttcgtagcctccggagactggccttgacaggtatttgctccagggcctcgaagagccctgcctttcctgatgagacactttgtcatgaatatctggcttcatcagggccctggctgctgtacctgctacagaggctcagagaggaccaggcgctccccttctggccgccttccccagaactaaacaagcatccacacctctcctaggtgggcactgatccgcccgctcagtgggagatgctgttcttggttaatccatttttcacctcaagctggtcccacccatcttttaaataaaccccagccaccttgactgcaggtgcatttggacgggtgatgtggtggagccatcccaaggcagcacctccgctcgtgggctgattgtcaggaccaagaggtctttttgaccccacagagccctccgagtcttggctgccttgttatggcaggtactggcactgcttggggttgtgtttgctttggtttctgagacaggtgcgtggaagtggatttgaggctctctccccttcctcggatgggccccgcaatgtcccaactttgcctagtgccaggttcgccacaggatacagacagacactactggtatacaaggcaggtgcggaccccccttcctgcccttctcatgcctggcgggagggctgaatcaaggcagactttgtgggaaggaggcctgagctcccctcattgctgggagaccctgaagcatcctgacctccgtgtgacacgccaggtctgcaggcagtgcttgtcgggccctgcctctgcctttcctgtcaggttcagggctcccgagagccacctggacacgctgtcttcagctctctgatgcatgaccagcctcacccgcctccacatttggtggagggacctgtgggcatggtcatgatttggccggcagcctggatggtccaggctctgacccagtgggaggaatgacagcacatggctgcgccatggaggaattagcaggaagggcggaatcagtctgtgctgccccgtgggcaggtgacggccagcacgtgactgcccccaggctctccacccttttgcagggaggaagggaggtggacaggtgtggggctccagggcaggctgcttccaggagtggcactgaagttgagactggaaggaagtaccggccagcagggcttggaaggggctgctggccatgctcctgggcactcctgattctgggctgctcagcatccacttcaggaggatgcaaacctggggctctaatggggctctggccagcttgagtctgtggtgacctggtgtccacatgtgacccacaccccagccctcgtgggtccccagaggggtccagcctgtcaactggatacctgctttgggccccctgggcccagccctgccctcgtgggacttccaggctagatggggacagacagacaacagtgaaatagacaagccaacaagtgtgccaatgcaaatggggtcgttggctctgcaggagtggaggacagttctagagggggtgtggtggagggggctgagccgccctgggcagctctctggagaagggatgcttgagccgaggttcagaagatgaaccagatagctgtaagaggagggcttttctagggagagaccacgggggccaggagcttcagggagctcacagaaggccactctggtggggtgtggaaagcagggggcaggctaggggcccttgtagaggctgaggccagtcgctcatcaccccaaccccacctggatggacctccgtccccagggaggcctcgatgctgcaggggggcctctatgtgacctggaggaggcggagaggatttggtgtgcgcctcagccgccatcctggggttgacaaagtgcctgtagctggaatgctggaattctttttttttttttttttttttttgagatggagtttcgctcttgttgcccaggctggagtgcaatggcatgatctcagctcactgcaacctgcgcctcccgggttcaggcgattctgttgcctcagcctcccaagtagctgggattacaggcatgtgccaccatgcccggctaattttgtatttttaatagagacagggtttcaccatgttggtcaggctggtctcaaattcctgacctcaagtgatgagcccgcctcggcctcccagagtgctgggattacaggtatgagccactgcgcccggtctgtagctggaattcttcaggaagggctagagcaggaacagagccctgggggtgggagctggtccccccgaggtcccctgggacagtcccttcccagaggctgcctgtgagaccttggtgtcatgtgtgggatgtgccttctgagcccagggtctaggagatgggataccctaaaccagggcccctggaaactgggctctctcttggtgactgggacttgtgattcgtctgtcaaccctaggtttcaaattaagtcccagccagtgaccacatcagatttccagtttttttctttttttctgagacagggtcttgctctgtcacccaggctagagtgcagtggtgcgatctcagctgactgcaacctcgacctcctgggctcaaacgatgctcccgcctgagcctcccgagtagctgggaccacaggcgtgtgccactatatccagttaggtttccagttttaaagtatttcactttgtcctgctagccaaccttatagcctgtgtcttgtttagaataatgatgttgctctctgaagggtgaaaattctcagattttggttgtaattgaaaattttcctgacatttatgaagtgttaattgtattatggaccacaagaggctctcccagacagcattctcttctttttgttgttacgtctaatgcttttataatcaacctacttagttgtttaaagtcattgttgattgctgttaggagtttcttcagatttctaacacagcaattaagccatgagcagccaggatctggccgtggcagcagtggccaaggtgggccttcatgggcaacaccaagagcatgtttttggagcctgggcggagtggctcacacctaattataatcccagcaatttgggaggccgaggcagttggatcacttgaggccaggagttctagaccagcctggtcaacaagacaaaacctcatctctacaaaagatacaaaaatcagccgtgcatggtggtgcacgcctgtaatcccagctatttaagtgacaggtgtgacagtcgcttaaacctgggagacagaggttgcagtgagccatgatggcaccactgccctccagcctgggcaatagagcgagactccatctcaaaaacaaaaacacgttttctgttgctcctcaaaactaagagccagtgttcaaagacccctggaacctgccctcctccaggcaccacgctcatgggtggcccccgtgtgtgacaccgtggccacagggaagttcttgttggtttctgctcatggaaagggcttgttcctgctttttggcctgtgactcccaagtgttatacacaattgttggtgagggatgtgggctgggcattgtgaggaaggaggcagagatgctgggagaccctcaggtctgacctgttgaaacttctagctccttagctggggcctgacccatggcctgccctcctcccggggtgcgtcttgtgactgcgggcgctttgcatgggactctgtaccttacagctcacgtaatgcctgctggcgctgaccacacagctccttcctcctctcccagcactggcacgaagtgctccctgtaagtatgaagttgaatgtagcatggatcgttctgatactttttaacatggaataaccgctcttgcctctggcctgctaaccgccctccaacagccaccacctggccgctttctcactctgggtctctaaacctgccttgtgaggctggtctcggtgcagctaggacactgggggttccagaggccacattaaaaagtccccgaagccagatatatttcctggggagcaagtcccagcagccagagtcgggcagggatatccttgagcctggcccagaatagaggccacgctgggccgcctgggagggcattctgaccgcagggcagcacttgccccggaagtccccgggggtttctgcagcctggtggccagtgacatcgatggtgacaccttcccggggccccaggtcagctcttggcttgagtccttccatcccgtagctatcccccaggcagggtgtctcatgcctgcctatagggaagagctgagctccctgagattaagggattatgttgaggccaggtaggaggatggagcccaggccggggagggtggtgggggcagaagagcagctctgggtcaggaagcttctgccaggatggactgtcgtgccctggggagcgtggggcgtacagagaggttggttagggttgagggggagagagggacatgggaacaatgtatgggaactggtgactttggactttgtcatgattcacagagaaatggggctggtgctttgagcatggaggactctggccaaggggtgtggcatccagcagcccagaggaggaagctttggtcccgtgggcgagaccagtggggccagaagggaggcttggcatgcagtcacataagattcaatcccaccaaggggcacgggcagctgccctgtgtcactggagcccctgagggtgggaatggctgtggaaggtgatacaaggttctgtcttggtgcttggagcagtgtagtggggcagctgtggctccggtgggcaccagcaaggccaatgaatggacagtgcagtttgcagatttggccctgacctaaggaagggcagagccagccgacacccacagctcctggaaggcagtctgcggcctcccccgtgggggcacagtggctctgaagcctttcagcaggtgctgccactcccggccaggagagagcccgcctgggcgggggcttgaactcatggccaccaaaatccttcagtgctgaattttagcgtagataaacctgctcactagaaagataaacattcatgggcaactaacgacacattctaatattctgttatttgaacatctggtagtcagccaagccactgcttcccctaaccaagtgtctgcctgctgaccacagaaacgccagtgtcccccgcccagccgtggggtggaggccgccctgacccccgccctcccttctccacaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtggtgagtgcgcatccttggaacggcggcccctccctgccaggcagccctagggtccctgtgtttgggcctccagggggaatctgtgcctgcatgagtcctgtcctgtcagtaggggtcagagtagggctgggcctggccactgccgtgaccggtgacctcgggctgcggggctgatccggtgaggccttgagaaggaacgcttcataaccagcgggtaggcctttgggctgtactcccagggcccgtggggtggggctgggcagacaggacaagagagacagacccctttaagagcgccttagcatggctgctgcctgggcgtccaggtcgcctctgagtgtggcgccttggtgttccctggcattgtgtaagaatgctggagggggatgaggaccgtgccctgggtcccccatcctctgctgaagggcctgctgggaagctggaggggtgggctccctccaggtggtcctggcctgcaggtcctgcctgatgagaccaagccaggctggtgggctctgggctgagggtcccagccccttggcctttctcctcctcatgcagggcaggtggggtgggcgtgtgcaggccacacgcactcgttcacaggggctgctgcccccaggtgtccacatcccctgagctctgccacgtttgagagctggtggttctccgcctggcatggactctgtagggtcacagacatcgacagggttcgcgcggcccaaagaggcagcttccctgtctctgtcataagaacagaggttccccatcctggctgaccccaggggctctgcagcctttggggtggtcctgatttctctttgaaccagctcttgtgtctgtcactgaggggagcaagaggaaagcagagctgtaggagcttcctgcccctccggggagcgaggatgcgggaacagagcagctgggagcaggcgggtgcccgcaggcctcttgggagctggcgttctcatggaagtggccaggcaggcaccacggccctgcgaggctgacccctgattccagaggttctcgaggcccctgcccccgcggcgtctgctccccacgcagatccgcaagcatttgctgctcagcctcccggagaggagcgtgcactgaaatctctggggcgaacatgcactgaaaacccattcctctcagagcctggagcacggcctgtcgcttccccacatggctgaggagggccgccgagtcgccccagctgctttgtttcccagtcgaggctgaggcccctccaagcccctctcccagccctgccccttcctggagtggaggagctcatgcctcaccagggcccgtggtggtagcgccaggtgtggtgtgtgagctgtcaggcccagcgagtaccctccgctgccaactccaggccagctcttcgctggagttgggtgccggcctctcccaggtcgggtgggctgagtagaggagctgatggtgaacctggacttgatggatgaggaggactcggccaggctgaaaggaaggaaagtgagtggtgggtgcccccagcacggcactaacacaatgcctgtgacccacccttgcatgactctcgtgaccaggcccctctttgacttggggcttacgaggcatgctccccttctggtgcgaggactgctccatgccttcagccccacagcctcttctgtggcaaagtaccctaggctgccaccctcctgccccatcagggctggctctgctgcctgctccttcctccctcatctgcccccacccctccccatttacttgtaagcctacccgccttgccctggcccaccgtgccacccatcggcccttggcaggatggtgtcctccctccacgtcgcctgggctggtccgcagtcgttcctcagcccctgaccctgctatgaggctccagcctcctctgtccttgaccttcagccctgtgtctggttctcctttcaccttggacacgccttctccaaacttgcctgcttttctcggccatgaagtatgggctccactcccacctgggcccgctctggtctctccccatggacccgacgcccctcccatgacgcttttcagcgtggctgctgtctgtcctgatgctgaatcccccacctgacccaggcacatttccgaagctctctccttccccgccccctacctcttcctgcctcctggacaaactttcccagttctgtcttccctctgcgggcagcatggacagacgcaaggacacgccctgtctgctgtccgctccctgtctgtagcacagctgaccaggccctcagtgaagcctgcgctccctggatgggggaccctgtagtgtctgtagggatactccagcctccccggccaccacacggtccccgaacccttggctttgacatgtcctaacctgtggcccttctctcctggggtggtcagatccatggtctgtgcctcgagcatcgcctgtgtgttgtattgactcccaaattgacttggccagtgctgcccctcaacagggttcccaaaagcatcacaaatacagtttgtcctgaatggaactcattatcacacccgcaaaaaaatccctctccgcctctgtgctgctctggaagtctgggaacccagctggctcctccctactccccccatgcccacgcccacccagtgccgctccactcctctcccgaacagctcttactgccccgtccccatggggcccctgctcagtcctcagctgctccttcctctgttcctggtgctctcaatgtgacccttccctgcagcccaggaaactggtcatcaaaatccgagttgctccctctcccaccgaaatgcacggtggctcctccatgccctgggtgtgggtgcagcaagctcactcctgcccggcgcctgtgcacctgctgctcccatctggaccaccctccccagagcctcctggagctacagcacttctcagacgttttttccttagaagggcacccacaaccgctctagagaagcgtcgcctccgccaccccagaccccctcccaaccaccccccgccactgcagacgctgcgtggactgtcaggctcacatatccaggagcaggcgcctggctgcccgggtcagccagagctctaaacttactagctgtgtggccttaggcacgcactttctatgtgcctcggtttcctcatctgtacggtggtgatggacacggtgcccaccatgtggggtgggtgaagatggggggccttcatcatctgctgctgttcacctgctctccctggggcctcacaccctctcagagggaggagtaaacaaacagtgaagatagaggaagttgaatggtgtccagggtcacgaagaagacagcagggaatgaggggatcggagtgtgccgggggacaggtacaattttaaatatgttccttcccaaggaaagcctcagcggaggcctggagtcagggaggaagggcaggagctgtcttgtggggaccattcaggtgaagggaacggcgagggccaaaggcgcagagccactgtctgtaacgggggagcttggggacagtgacacacccgaggccacccggctaggacggggcagggctggggagagagggctggtgggagtctatggggctcacgcatatgggcgtaaagtagaggaggatctgggtgacctgtgctttgaacaggcttcagtgcaggttgatggggtgccctggggcatctcccaatagcagcccttcaaagctgatagtggggggcatcctcccaggttggcagcggctgcaggcgtggttggtgtttgcccaccaatgacggttccctctcccggctgcccccagctgggctgtgcacactggttgtggggtcaggaccactgcacctaccccagcactcagctggttcagggagaccagtgcagtgaccacgaggggccagcgatccatgggctctcagggaggggacctctgtgcctcacgttccccactccctatagagtccaacctgagggggtccacccttgtgtggatagcagcctgcggtcacggaggcttttggggccgcgcctgtgaccttcccagagccagctggggagcagtcctggggccgccccttccagaactccataccctgggggggggtggtcagagtgcaggaggagggccagccctgggggaaggggctgcagaggggcagggaagggcgccagcttgaatggagggaatggcagcccatcccctgggtgtggccgcgtcatgttgatctacgctgttatttctcactcattaaagatggtctttgattcttcactgaggtgtcctggggcccatggatgtcaatgttgatgttgatagaaatagccactggcggggcaggctgcccggagagggattttcagctctcacttggggactgcccacatgagcacgagttctgggctgggagcacgtgtgtgctccgtgcggtgaacctgcatgtgcgttccgtccctccagatgtgccctggcggcccctcctcctactcccagtcgcctccctcatccccacgtcagctttcttcagcctcctgtctatttttagctcccttccccagggcctggctgacacggatgcagcctctctgcttggagttgcgtctccatgaatattttatgctgggggctgccgcacccgctccgggcagctgccagcacttcccggtctcggtctcgtattagaagaggccaactcagcgcgtagaggcaggcctccccgtggcagtgccctctgaccttgggccgaagggggctggagaagtggcttgtggggagggacagcaggacgcaggcggcagcagacagatgtgggaaggcttttcagcctgcaggagggtcagagccgtgtgtctgctgaagcggaggacgtccctggcacctcaggtgggggctgtacttgcctctgattcttgcaggcgtgggcattgtagcctctacaggcccagggagttggggctgagaacttgtgggtcccagcctgggcctgaggaggaggtgtagacagggcggggtgaggggctcgctgaggcccctgaccagggagaagcctgtagcctgttccatggctgtcagggctgagtgagcgccgtgaccccactgcttcctgggcacactggggaggggatgtgtccccagattagccgaggctccaactgtgcaaccacattatgcagggcagggtctttgcaaagcaggcttccaaactggagggagcccatcccagagggtctctctggtgctcatgaacacacatctcccgaggtggccagcccaggactccgagcttcagtctttagccaccgaaatgttttctggatggaagtgggaggcagtaatgaaggcaggtgcggccatctttttttttttttttttttttttttgagacggagcctcactctgtcgcccaacctggagtgcaatggctggatctcggctcactgcaaccgctgcctcccgggttcaaacgattctcctgcctcagcctcccgagtagctgggattacaggcgcatgccaccattccttattaatttttgtatttttagtagaaatggggtttcaccatgttggccaggctggtctcgtgatccacctgcctcggcctcccaaagtgctaggattacaggcgtgagctaccgcgcctggcctagctgtggccatctttaccttgcctttcagagctgcctcatgcatagccaggggagttccaagaactcagggaaaacgcaccctgttgagctttgtccgctctgacgtgccccgacctagaagaggccctgagacccttgggctccttcaggttgagggagccctaccaggccgggggccattctcagcaggtttgttttctggttaggaagccagggcagctggatgcagaggctgctgcctgtctcctgggtgggcaagggactggaggggcaggggaggcttcctcttgggtggtgcctgggtacaggtcattgaagccggaggcttcagggaacgccaacccctctgcgagctggtgtgtctgctcacagatgcttcccatccccagacaggaggcgggcaccaggcagggagtcactcgccaggggtcgcacggccagcaggcccatctgtgacttcactgactgggaaagggggccgctcactgctgtcatcgatgccactgtgctttctcccagccaggccctactgtggggtcctgggaggagccctgcctgagaacccttctgtgcaagaacctaaaccctgggagtcccaacgcgctgcccacctgcactgcgccgcccacccacaccgcgctcagcccagggcctttgcttcagccccagatgatctcaggaccagtgctgggcaggtgactgaacctccacaggccactgtggagtgtgggggttggggcacattttagtggaaagttttccactccagtttgattcttttgcctctgctggggccttatgtgaggcgtggcctcagcacagacccacacaactttcagaaggctctggaacatggtgcccacctcgcttctgctgctgccctatgacctccttctcctggcctcagctggttcacctgcatgagtgcaggggccgggtaagccccgcgccagccgagaggacagcgtggcatgggctggagcgtccggaaggagggcactgtttgacctgctgttcagctggaggggcgggatgggccccagggcttaagtcagctgaaaggccctctgcagccttctggaagttgtctgccatgcagtgctgagggccacagctttgtgacgcactgatgtgggggctgcagacagagcaggctggagatgcctcttggctgtggctgtcttgagccgtcgccaggctgttaccccaagttccctctccgtgccttctcagtgatgctgtaattggaaggtccctcgcccctttgcacttaggaggaagcatggggcaagctttccatgatggtgcctgctgctccccacccccaggacctgcctgacccccaggcacggtgtgcagaggggcctggggtcctcgcatgggccccgttcctctcgaagaagcctcaggagcagaggtggccattcctgaccgtgtccaggccggaccaggacaagaagagaggtccggtcccaggatgtaggacagagaaagaggtccccacgtggggcctttgtcacggggcagggccctagggtctctgctgcctcgacatcctagacaccccgttgccacaggctcctgctggcagggaggggccgcacctactcccagagaatttcactagcaaaagagtgggcggaagcactgtgtggtggccgcgcgcagcctctgcactcgccctgggatgggcaccgctgcgcccgtgtgcgggctcttacactggcttcctttgtttgtttggccaagattggacttttggaataattttttaattgttgactaatttaggaaattcagctgttactggagtgcagaaggttgacggtgtgttcctggaagggcttggtgaaccgcctgccgcgtttggccattagtgagggaagccctgcccccctcctgcccccaccttgctgccagcccacaggcgtgagtcatggactggaatattcatgaggctcagaatccagtgtcgtgctctctgttccttttgcctgcatttagcgggagtcagtcttgtgatgggaaaatacctgcatcctgaagctgcccctgtcgcctcattggttagcgcttaggaacatccggtggccagtgagtcccatgtgcctagaacccgagcatgggtgctgagaaggaggttggcgcagatgagagcatgtagccctcccctccagcctggctctcgccttccctctgcctgagcccagactctttctccagccacctttcatgtttctgctctgcatatatctctgaaagatccactgtgtccagacagccacacactggcccttctgagcggcactggtaggtagctcttctgatgccactgtggcctaaccggctgcggggggttaaaaacccacctgggcacagtgagctgctcatgttctccccctggaggtttacagaaggctctgctcagagccaggcctggggggcatacaacagagtgtgggatggagccttggggcctctctgtccccactgctgtcagatttgtgacacggacagagtgagcactgccaggaggggggctgtaccaggagaggcccgtgggtgggatttccagaggattcagtgaaccgagggagcatcccggctagacccagggtgctgcggaaggtgagcgagagatctgtcagggaggcctggaaaggttgttgggcccatgtgaggtcctggccatgggacttggagtttttcagcagggcgagttcatgcctggagtatcctggggctggaggccgcccacttggctcggcgctctcagcaaggggtgtggagtgtcctggcaaaggctctttgcggccagacacacatcttgagccctgcaagcaaaggtgcaggaagaaacaggccctgtgccccacacggtggtagaaaggatgcagagccctccccacctgtgtgtgcaggatcagaagcaagtccccagcatggccacagagctggcccatctccagggggatggccaagcctaggtgtgctggacactctcatctcatctttgtcactgttgcaggctcctgttcagaccctccatggtctgagccccctggaattgattggggacagatgatgccagtgttcattgagcagaagtactggttttgaattgttaacataaagaccatccctatttagaattaagcctttttgatcttcatttgtttgatcattcattcattcattcattcatccatccagcaaacacctcctgtgcccctgctatgtccaggcatggtgctggcctccagcaggacaggaagggctccacagggcatagcacagagtgggcacacgcacagcagaggtgtgccatgagcacgcggcttctggcccaggcctagcccacagtgggcactcagcaggtgacagctatgatcattattggtgttgtagggtggggaccgccatgtccacactccggcacaagagctgtgagccgagcgtcccgggaccacggcactccgtgcctgcaggaggggctcctgagaggccaccacccaggcccaagtcccaatgccttttctcccctttgtggtgacgatctccctgcctccgccagcagcctcccgttggcctttacgcctcctttcttggccccacttgggggcagttctttcggagtctgagccggtgctgctgggtgaggggagcccctggtgagggtgtttatgactctccacaatgatctcattatttgagacttccggctgctttctgctggaggctggtgcagtcctgggtgggtgtggaggaggaggtaattaacccaggcctgcagctgctgggagaggccacagcggatggcggagaggccacagcggatggcggacaggctccgctaaggcaaggtcctcaggtggagcaagaccctgggggcacaggtgcttgtgaggctggtggtcctggtgctaagctcatcattgctggcttctccatgcacaaggcccctcgcccggccgtgctgagtgtcctcaataatgagatgttttcattgcttttgtgattatcccaagacccctcttgtctcctgttataacagggagagggcatgctacgtggcttcctaattaagaaggtctgtgtccctcaggcttacaggaagttgttatatcaccactggaaaccctttttacgccattcattaattacaaaaaggacaagctattgattttaccgagggtggaacttagtcactcgtcctccataccatgttccaaatgtgtgttctccaagcacagaaaatgcaaagtggaaaacatttggtttgcagcacttggctctgaaagccacaggcttcccctccagtggaagagagcccagaagacagcagtggcaggaagcactaagtggagggaggaaaaagatgcagaccccaggcccaggcagccactaggctgcaggggagccaggggcttggtgctgagtgccaggcggtgctccctgagcaccagggagggagcgtactgtcaacctgctaccttgggaccctccccacccctgcgtccccatgtgtgggtgtgacatcctaaagggcccgctgcgttaaggtgaccccgggccatctggccctcctttggggcagccacacaccagcaggacagtccttggagcagttcccaggctgcacttggcctcaggtatttctgaggacagcaggaccaccacacagacacacacacatgcaccagggaccgcagacacatgtgcacacacacgtaggagctcacgtgcaccggcaccataggaagcactttgccatgtcactttgttgagttcctgtttccaggtgaacaaacctggccctgggccacacagctgggcccgtgggactcagagtcctgctcctggccatgctgccccatcccttccatcaggcaggtgcccgggatacatgggggtcatgtgccctgagctgccctttgccacctcatcctttctctctggcatattcttggggagccccagaggctcggaggagcctgcctgaggccacaggtgggtgcccggcagctggcaccactggccagtgccccagaggctccagtccttcccccaccagcagcctcggggacttgagagagacatctgtcttcccgcagagcgttctttcgtcctccacccacccccaaccctccattaaaaacagcaacagccaacagcgtatgcatttatttactttgctgggtggagggagatggctgcgaggaggcagcagccgggccgtgggtggggccttgtgctggagacatctgtcttgctctgtcagcttctcacccagcgggacagggtggcccctttgtcacttgggtaggagaactatttagcaaagccatgacctggggaggctggctgcccaccagcagtgagcccgtaacctaccatgggacagacaccgccccgcggccctttgttccacctccccctgggtggtgagcctgggtcctcaggcacctgggacatccctgcccttgactgccatcttcataaaccttcaccctggaagggcgcccctgggcactcagggaggaaggccgcccgcaccttgggagggcagcgcttatgggcgggcactccacgcagtgacgttgaggctcctgggctggtctggactctgtctcagagcctggaacatccagcagatactaccatcccgggagacgggaagagcagtggggccctcacaggctctcaggctcccacacatccatccatcatcagacagcatttgctttgtctgagggcagagcctggctgatgagtttgctgcaaatattaaagagcagggccacatcagagccgccttggggcccgttgctgggcaccagattctccctcagcctggagccgaccctgagaatgacctgcacctgggctcgtgcccgcctcaggctgtgtattaactgacctcgagagaagcagtcacagccctcggcctgtggcattgggaatgctcgatggcctggtggccgctggggtgggagcagctgtagtggtttgggataatatggctgagggcagggcagggcccccgcctgggggaggccaagctcagcaagtgctcctaggctgtgccgagggccggggtgaggtgaggggaggcagggaagcccctgaccctggttcatcgtggacacgctgcaggtccatcgccttcctcacttcccatggacgagtcccacccctaaaagtccctcggcataggacgacctggagggcagcccccatgcccaggtttaaatggaggctctccccttacccgctgtgtcactttgggcaagttactcagcctgtctgtgcttcacttcctcattggtaaaagtggacaatcatttctgtgctgcttggtggggttgttgggaagaccctgatgtgcacagcctgccgcgccctaagcatgggttgcgcagggaatatccccttatcgctgtagtccctgccccacgtgcacagcccatgtgggggcaaaggggtgggagggctctcgtctgcagtgccttctgcagacccagagttgggtggtcctcccacgccctcggcggctggagggctgtggtcacatctctggtaaagatgccgagagctgtaggaagttactcctattccactcccaggtggtcatggaggccagatcgttaggggactcgagggctccgctccactgctgcgtgtggctggcagaggtgaggaccgggctgtatgaagccctggaggttttctcgctcttgggcggagatctccctgccgttcgggccgtgccgcgtgcgtggggcctggggcccatcacacacctatgaactggaccagaaggagcatggtcctgagttagctcttagcgcctcttggcggggagtggggaaaatcgcgcctgtgcacagcccagacggctccctcagctctgcccgcagcccaccgcttgtaaagccaagtccccgtctctttggggcctggagatcattggtgcctagggaagaaaggaggggctggttttcctagatctaggtctagttagttttttgcttttctagctttttaattatagaaaaggtcaaatatacgcaaaagtaaagagaagaaagaattcctgtgtagttattagctcagggccagtcttatgcgttgacagccctgactactcccccaccacagagagctctcaactgtggaggttttctcttttaacagctttactgagatgtaattacatgccgttctgttcacccacttccaggatacgattcagcaggttttcttctattcacagaggtggacatcccccgccacagtctatttcaaaaccttttatctcaccaaaaagaagcaccaccccttagccaccactggtcccccagccccaggcaaccgccaatccactttctgcctctgtgtatatgtctctcctggacatctcgtgtaaatgggtgataggcagaccctgtgaccggcttctttcactgtgttgtttttaatgcctggttgaacatgggctgcagggagaaatttggtccccgcaactctgctgtgaggtggacattggcccattttacaaaagaggagtcgatgtgagtcagtggtgaatcaggattcacacccggctccagggttgaagatgctgggctggtttccaggcggaatgaagagaccatcccaggaagggcacacagcatggttgggtcccaaggtgggcaagcctctgcctgaagcagcccatcccagaggcggggcagagcttggttccttatgaaagggatccctggccagctcagtttgagaaaggcgaaagttaaacagatttgagacgtttcagaaccttcatcccagtgtgcattgtttattgtaagaggccatttagtgcatagatccccaaacctgcctggtacagaccatcagagaggcatcatctcccagtggagttggggagggagcccagaggatctgcagacacagacaggcaggcaggcaggcaggcaggcatctcctgacctggcagcccttcctcagcccctctccagggccctggccttggacgggccattcccaccagccccccaggacacccatggtaacagctcctaagctggtggcgttggctccgcagagccatttgccacctctcttggcccctcctggtcctctggtacctgagagcatgtggctggggactcaggcacttggggaccaagtttctcgccagtctcccacatctgcacattcccaggaagttgcctctcctcaggccggacctggctcctgtgggctgggtgggggcttcagctgtgtcccttctcactccagctgcctttcctgggccaggctcgctctctcctgctttcaaggattctttttctttccaagctccttgccgtctttcctctctgtggagggcagatactccaccagctagagggaggacccgagccgaggggccaggctttcagactgggaggcgcctgagtgcgatccagcctgcccgtccccagctctcctgctcccaacccgatgtctcccagggctgccacagccactccaaagccagcagaacccagtaccaaccccaccaggtcctgttgccttgtcgcccagctctgggaccccatgcccaccctacagctcttgctctgcctgctacagggtcttcaaggtaggcaggaagccaggctgtgggcggccgctcctctgctgagcctcggccttgccgctgcaggcagacaagaagctgcagcttccctccacatcaccaagcaattccacaggggaaggggaggacaaggcccctatatcccatcctggtggctttgaccttgcattcttggccacttcagatgtgccccatttggggcagcggcagatggaaagggggcagggccctgctacacagatgtggtccgcgggccacagcgttgtgtcacctgggatcctgttagaagtgagtctcagctcccagacccactggatcagaatctgcatttacaagactggcagatgactcagatgcacttaaaagttcaagaagccctgatctagcacattctgcctcagtgtgcacagaggtcttcagctgtgcccagcaggatgtagccatgtatgtcttcaggggagcttgtcatctgcaggggctgcgctctgtgccctccaagcccaggaagctcaggggtcttgcccactgagaagtgctgctggaactgagaaagaacatttcattttccctggactgtttcaggtcaaattgcatagcctcaaattttatttttaaaagtcagccagagatcaaaccgtagcagcgggagggacttcttcaataaagtgtcttggaaaagcagttttcctgtgtacaccgaagactcttcaaagggggaccaggaccgctgcaaggagcgccacctatttctttaaatacccgaagattccattggctccaggccggcgaggttttgacagtttacacctggtgacatttagagactgattttggagagagctgaggggaggaggcatttggtataacttgacattacatcctctggctgactgcgctctctcttgccaatataccatttgtctatgaaacacttaggcccaaaaatagctgtacagtttggtgtcattgtggatgaaatgaagggcaactgccccatctctttggctttcagacaccctcaaaatgttgcgatgaaatgtcccagaggaattagcacagctcattaaacctgaattcccagccagggtggggccagtcagaacatggcgttgggacagatgggacatcagaagtgaccacctaatactccaggggtggcacctgcccaggggccacaagacagagtgaaagggggtgccgttcataatcgcagcccgtcgacaggcatgaaccaggaccgtcctgggcagaaccccgtcttgggccaaatcccacctgttcagttggctctgcccccagaccaatgagatggggtccctggggtccaaggtgccgcctcctgagtgtacggtccagagcgtggtgacagggctccctcccaacaaagcaggcctattgctcccagtacggggcggggccttctcaaggccataggcagcacagcatctgcccacttctcgctggggcaatggccgtgtgcagctggctttccccacttctctccggggcggtgaccgtgtgcagctggctttccccacgtctctctggggcagtgaccgtgtgcagctggctttccccacttctctgcggggtggtgactgtgtgcagctttcctgggagtgcagcgaatgcagggtccctcttcctttccacttccgttcagctcccatgtttcattatcaagtgcattttccaccgaagtccagtagcaaacaggccctgggcttggaggtcacctgctgtgaaaggtggtgagaggatgtcacagggctcggcacttcactgactgcttctgacccgccatgcccttagtgtctcctctatggagctctgccacctgtggctcctgcggcccctcaaagcatcttggctgaacatacccagcccagtcaataggcccatcagcgaggtgggacatgagccccatgcctgggctacccggcagtcccaggaggccagcggggccgaggcgtggtactcagcatgcaccaggggtggggcagatcccacgggtggggggcagggccccaggccaggtcacaaggccacggcactggttctgcagtgaccctaacctgcctgtctctgtgtgtggtccacagcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggaccc

SEQ ID NO: 418 - DNA, 24914 bp, Homo sapiens
gttgcgcaggcgcatccgatcgactcggtaggtggggatctcttggagacggcgacccaggcatctggggagccacagaagtcgtactcccttaaaccgtgagtttccgacggtttgttccatggcgcgggattgtgagggattaggaacgaattctggatcgtgacttcggttttctcgccgtgcagttccttttcccgccccccttcggatccctccgacctgcggcgggaaagtcgcgcgcctgcgcactaagcatctggttcggtctctggcccgagggaagccggtccttcccggctgagctcgcggccagcgctggccggcggattcccattcattcacccttctcctcctccgcccagtactcgtggccagggtcgtatcagttctccgtcaacttgcttggggccttggacgagcctcctggcgcttcctgtcagtggcgaaaaggttttctccctcagttcttttcctgacttcaaaccgcccccggcgctcggcccctcccccacgcggtcccgctggctgtgccggactggcagcctcgccgtttcccactgcgcctgctgctgcgcgggtgcccaagccgggaaattctccctgcagccccctgccggtgtttctgataggtgaaaataaagcacatggaattccttagacaaggccacagtatgccctactgtggaggtttggacacatcgtgcgtttgaaaatgtttgcccctttggggggcagtagcatgtttttagtgcgtggtttagcgagtgatctaaatttctctagtgttctaattttcacagctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtacgtgtttaaatccaaagatgtacagttataaagatttttcaggcaacaattctgtgttttcaattcctctcaaaaaataagattgaatcttataaagtgaattgtatgtttctataggacagtgttaaaacagagcttcgtatgatctaaatgtaggactgaattgcgatttggaagactgtaatacaacctgttttacggttgaagttgctatggtctcagtattggtaattaagaatgcagaaatttgatgatgcccaaattaaatttctcttttgtatctgtgttcttatctctactcaccacattgccttaagcttaaatgtagaaattgacactggagatcatcacttaagtattcaaaagcagaactcacagacaaaaaaatatgaaatgtttgtagcaataataaagcaccatatctcagtgtacagcatgaaatgttctttgaccgtaaaccagaccttagggtgaataagacagggtcaagcagtgcctgctcttgtacactcgcatgtgtaccttcatttctgctctggcacaggacctgggacatagtaggtatttgttaataataaatatttgttaaatagaggaattctagttgactgtatttttttttttctgaaagggtagccagatcatctttcccatctttgtcttaagtgaattctgtgcttgtctaaaagatacttattttgaccttttgtccatatattctttataaccccaccctagaaaaatatgacatcacatactttctgctttgatggaagtcagttatcccacttacctaaacttgaaactttaatcttcagctgatgctttttatttgttccccatatcgtcacctagctttatttctttttagtaagtatggcattgtgtcttctttccattcccatttccaccacattaattaatttccttacactttgttcctgatttacaacagtttctcacctatgctgcctgcttgcacttttccattcttcagttcatcttgtatgttggtgctagaataatcttaaaatgccactttcatccagtttcatggatactgttcctcttcctttccatttttccagcagttagctgtttttttagttcatctttcccttactagtcactggacacataacacagtaacacagtcattgtagtattctttttctattgcttaggactctgcattttgtctccactgtaaaccccttggcggcagtatctcctctggtttctaaagtatgttgtgacttcagcagagtatctgaatggatgactctgaattggttctagcatcatgtttaggagaatgccactattctaatattctgaaaatctgctgggaagtaatgaatggggtgaattttattacggatttcaaaagttttgtagcgtttatgtaacagaacattggacattataatatgataaattataaaacgtgctaaaactttactcttatggttcttttttaaatatgatcttaataacagctaaagttatataaacataacttcaatagggagcaaagctgatgaggtccaggcacataacagtctagtaatctaattgggaaagtaaatcaaattagatcatgagacaggtatatgcctgcacctcatcaactttactccttattgaagttatatttttgattggatgttttatatatcttagcattcccagagcttaacagtgtccagcacatagtaggtgcttgaaaatatttgaatgaatgatttaatgtaaggatataaagtaaaatacttagtgtaatggatgaatagcatgtctctttattttgagatatttgtcagatttttataacatttttctgataaacatgattattgaaatttttgaagtaaagaaagccaaaataaagtcttttcccattattgaaatattgccactgttgacattttgttatattcctttagcctttctaggcatacataggtacattttttagaaactaaattgggatcttgttttgtttttgtttttgaaaagagaaccagaatatgggatcttatttctgatctccattttttttaatatatatcttgaatattgctcatgtagtaaatattctacaactggatttaaggtccattgcatattatattataatatattcaatcaccttttactattgaccctatagattgtttctattttttcctattaagaaaaatgctgtaatgcacaaactatctggcataatattggtcaaatgtttattctttcactgttttggcaagcttttttttttttttttgagacatggtctctctgtcacaccactgtcactggagtgcagtggtgcaattacagctcactgcagccttaactcctgcactcaagcaatcctaccccctcagcctcctgagtagcttggattacaggcatgtgccgctacactcagctaattttaaatattttttttagaaacaggatcttgctatgttgcccaggctggtctcaaactcctggcctcaagtgatcccctcctatcttggcctcccaatgcactgggattacaggtgtgagccaccatgcctggccagtaagcttttatttttttttaagtatctactatatgccaagttttaataagtgagaaagatctgttcagtgaaagaatgatgtataaactctatattgaaagtctcctccatactggtgaactctactggaaggaaggcttgcttcattctgtttgctacaatgacacccttagccatgcttctaaaatgggctatgggtaccatctttgtttgcctgggacagatctagcttacggctattgtcacaatgtaattattattcctgctgccttttcactcaagagtgtcccagtttgggcttatattatgtattatcccctagttccaggaggtataaaccagagagtacatgaagccccagaataaccatgactatatgcctagagtgtcagttttaatccatgacaagatattgaaaacgtttcatttatgtgatgaatatttattgtctgttatatacatgtacttttttaggtgctagggataaatcaaaccataaaacagaaattaacactgtggtagttagacaatagacagagagtaaacaaaagaagtaaatactgtgctcaaaagtgattaatgttactaagaaaatgtaaaagggaaggggagataggaagtattggggaaggagattgtaattttagtgagtatggttgctcatagccttctgtaacatttgagctaagacttcaaggtggtgaaggagtgacctgtgcagatatttggggaagagcattccaaacagaggaaacggcaagtacaaagaccctgaaacggcaagtacaaagaccctgagatgggagtgtgcctagcattcaagaatagcaaggaggtcattgtggctagaatggggaaggtaattggaatgaagtcaaagagagatgtaaagaggctttctaatggagtgagatgtgaaaccattagaggttttgagcacaatagtgacaaggtgacttagctttatcagaatactctgtttaaactctgtttgctatgttgcaagccgactggctactatgttacagatagactccaggctggcaaggagtgtagttaaggagactattggtatattaaaaccaacttggatatattatgcagcagaaaacaaaagtgacttaaaatgtcaaaatagaagcctagaccttcatgtataaaatagaggcatttaaataatttttagcatattatagattttcgggatcctcctccagtcctcaaagtctgtttcatttgtctgtctttagtactgttttccagcttttgacatgaatgcacttttctgctttctgctgtcatttcccacttcagaatttgaggatattgcattcactttggttgccaggaagttttactgttgtttaaaattgttgaagttgttctgaagtgacaggaaaccttaataaacattttgatttttgtaaagaggagtagatgcataataagtgagtagtggtgtggaagtacccttaatgtttctcctccctttcacatctgttctccacttgtcatttttctgcttaaaaacttcctatagctttcatgtgcattctctcttgtcttcctcagccacattctatttctattattgttattattgttattattattgagacagggtctccctcttccatcacccaggctggagtacagtggcacgatcatagtttagtaacctcaaactcctgggctcaaggtatccttctgcctcagtctctgtagctgagactacaggcccgtgttacaaagcccagctaatttttgtttgtttgtttgttttttagcttttttaagagatagggtctcaaacacctggcctcaagcagtcttcttgccttggtctcctaaagtgctgggattacaggcctgagccaccgccccaggccacattgtatttcattgtctctcagccctccccctaccctaatcatccaagccttttttttttcttgttcctgtctttacagacgtagttaatttttcctaaaatgttttcttccactttcactacttggtgaatgcttcagaacaaaacttagctgtcaactgaaggcttcctatcaccttcagaaatcctccccaacctagtagtatatacattcttttattacaggtgtcaccttgtattaagaatgataacatgtttcctttactagaccaagctcttagtggctgcatcaaatttattggttttttttacatacccattgctgagcattttttaagacagcgtttatttaaatgaattagttctagccaggtgcggcggctcacacctgtaatcccagcactttgggaggccaaggtgggcagatcacttgaggtcaggagttcaagaccagcctggccattgtggtgaaaccccgtctctactaaaaacacaaaaattagctgggcgtggtgttgcgtgcctgtaattccagctgcccatgaggctgaggcatgagaatctcttgaacgcaggaggcagaggttgcagtgagtggagattacatcactgcactccaacctgggcaacagagtgagactccatctcaaaaaagaaagaaaattagaaaatatatataatcagcaacacctctgtgaaattgggcaaatgatttaacctccctgaattgagtttccttatctgaaaaatcaggataatcattcctgctctgccaagttcacagtactgttaggaagacctcaaaagatactgcatgtgccggtgctttgaaaatgtcttaaacttatgctatatagggctagtagagcctagatactgtaataaaatctgaagacttatctagttctcttctgtatccagtagtttactgggttttgtattattgcctccccttgttttaactatgtacatttttataaagaactgatacttatttaaaagtagcaatttatctgcagtcaaggatagaggatactactggcaattgggacaaatttttaaaaatacttttttacatgcttgagagctttagtaggccttctctctgaaaatatagtgtgaatatttaatacataaaattttaccaagcctttaagattttgtatctttacgggaaatagttttcaagaacatcgcaatgtgtccttgtcatgccatctagtgatcacagcacaaattgtttagttattttaaaaatttggtgctttttcatgttgtaatctctacagtaacaatgtatctcttagtatataattccagtatagtagaaatttggtgtatttaattctgggactgtcatttttgtctgttcaagaggtgtgtgtgagttatagcaacttgatgggttttaatcttatcacaatgttattaaaacttatgtataattaattactcatattttataatttatttcattgagctttttaaattttaagaaactgtaaaatatactgtcattgattaaaactctaaatttttgtttccttgaaaggtgttaaaaaagatattgagaagctttatgaagctgtaccacagcttagtaatgtgtttaagattgaggacaaaattggagaaggtaatctggggatatgcttttactatttttacgaggtcttttttccattctattttccttttttagtcttggttttcattactatttcttattgaaaaatataccactttttagactattaagaccatagttttattactaattatggtaacagcttttctttttcaaccttaaagaaagaataaataataaatatttactgtaaaatgaagtcctgttttaatgtattatgccattgaaacagtttttacaatctatcttagaattgtttcattaacatttttaaaaaccagatattgaaaaatttaataaattgttttacaggcactttcagctctgtttatttggccacagcacagttacaagtaggacctgaagagaaaattgctctaaaacacttgattccaacaagtcatcctataagaattgcagctgaacttcagtgcctaacagtggctgggtaggcaatttaaacatattttaattgaacttgtatataatttataagattttaaagtagatatttagcagggatgaggggattatatgtgaattaaatacatttttcagtcaagtgtttgcaatttgctagcactttccttctaaccttgcaatagttagttaaatttatagtaattcttttagattggatttcccttgaggctcgacctgatttcctgtcttttatcactgctttttgtaaccttcctgccaaatcataaaccttggctttcatggtttacattattttgtaaatgtagggaactcacatttcacatttccccagctattgacgacctcatctaatattttatttagaataacagaatcatctggtatggtttctctctgctaggtcatttctgtcaacatatggacatgatttagaatcttaccctcctaaactgccctccttcttccacctgctccatcatttctttgttcccccttacagccagacttctcaaaaattatctgcatacattgttttcattccacacctctctttcactaaatacctattgcggctgttcttctctatgctaaactggaaactatagagtcaatcattactctaggcatcatttaacacaattgacgtgaacccttgtcttgacttctgtcctgccacaccctccttgttttcttcttccctcatttggcctttcattttcagtgtctttgctagctcttccacttctatctgacccctaaatattggagttcctcgtgcttgctcttaggtttctctgtattcttagtgtcctccatttccacatgatctaaagtaatgattcccaaaagtatatagttaatctcagaccttttatcttaactacaggtttgtgtatatccacctgcctatttaacatttccacttggtgcctgataaatatctcaaacctaaaagacaaacctaaaccttaacataccaaaaaaaaaaaaaaaaacaccacaacaaatgttcttatccacccgtctctgcaaatggcccatctacacacttgtttgggccagaaacctagaaatcatcctcattttctctatttctctcctaaaccacattaatcactaagtcctagccattttggctctaaagtatatctagaagttcatccatgtctttctgtcttctctgccactacctcagatgaagcctagactacgactgtagcctgcttcttccttctccccttaattctgtctttacacagcagccagaatgatctttaaaatataaaatatatatgtatataacttaaattgggtcattagttccaccacttaaaatctttcagtggtttccctatgtactttgaaaaaaaaattcaaccttctcatgcctatcttcccacctccctcactgtgctccatttctttagtttatcaaatttgtctcaagagctttcttacctcagggccactgcccagactgtttccccattcaggaagacctctcccagtcattgcttgctgacccttcatcttctgatctgagcaagagtgaaactggacgcagtagttcatgcttgtaatcccagcactttgggaggattgcttgaggccaggagtttgagacctgcctgggcaacctagcaagaacccatctttacaaaaaacttaaaaattatccaggcaaggtggcacacatctgtagtcccagctacttgggaggctgaggtaggaggatcgcttgagcccaggagtttgaggctgtaatgacctgcgatcactccattgcactccatccagcctggtcaacaaaacaagaccctgcctctgagaaaaaaaaaaaagagtgacattgcttgaaagatgtcttctctgaattaaattagattctcctatttttttttattgtcatagcatctttagatttctttcaaagcccttatcgtattctgtcattataagttaccttgttattatctgtattgtccactagatagtaaactccatgaggacagaaattctgtaaattttattcactattgcatcactaatgtctataatccctaacagcaaataacagtgccaactaaatactgaatgaatgaataagcctgtttgtttcagccttctgtgtattatagaagacaagaaaatgagatggcctctataaagaatgcttgcatacattcttgtaccctaaatatgatcatttctttttctatatttttaactgtctccctctaccactttttctttttctgtgcttaaaaaagtacatgctaaaaatgccttcatctgatcttacaatgcagtcaggcaaattgtcttcaggctcagcttccattgtgttatattttccttccttctgttttgtttcttcctttccacttaaattgctgtcttaaaaattaccagttaattattctttgcctaactaaaagccttccctcagttgttattctctttgacttccatgctaataactcttccttcaaaattcctttcttatttggctctctaacttggcttcttccaagctcagttttcttttctcgctattaattttcatgtctgtaggtatcacttctctgcaggtactctcactgacttctcacttgtcttctcacttaaggcttagtcccttgtctagataactctatcaaaatgatgaggtctggttttagatgcttcttttactggcttctctactcattttttggtatctctattgttttcttactcaggctcaaaatcatagaaatcacctttgtcctattttcctcttttatgaagcagtgtaacatagtgattaagaacatatatctggagcaaaatgcctgggttcaaatcctggctcattgatctattagtttagtgaccttgatttatttattactgttaccatcttatctgctaagtcttattaatcttttcccttttttctcattctgctgcttccccagtcacaactataattacctcgtttgaattattatagtaacttcaaaactggtgccatttttgttttaaaagaaaactttaacacgagaacacaagtcacttgtgtttatattatgtgatgatgatttaagtcagttttctagcaatatgtatgcattgctaaaattgcggtttttaaaattaggcataaagtttcagtccctctgacctttcttctaaaagttccttgtgcatttttccactagggggcaagataatgtcatgggagttaaatactgctttaggaagaatgatcatgtagttattgctatgccatatctggagcatgagtcgtttttggtaggttttaatatttcttgaatttttattagctaaatatttaattgcaaacaatatttgtaactcatttcatttgtaactttgttttaggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtaagtatgaagagttactagaaaatatttatcctatttcttttaaaaaacaattttattgtctatatttaaggtattgaacatgatgttatatatagtacaaaagttactattgtgaagcaaatatttatctcagttacccatcttatttttgtttttacggcaagagcagctaaaatttactcatttagtatgaatctcatatacagtacagttttattacctgtaatcttcagagtgtgcattaggtctagatttatttatcctacatatctgctactttgtatcctctgacttatatctcttagatataatataacatactgcaatagccatgcacagattatttctgtttcagtttctttgtgattggaaagggaaatttggtgatgaagaagataaaattgtattagtggaataatgtacattattagatgtactatggttcagtggaaatagcatgaactaacagacttagagtctaataatttttgaccttagacatgtctcttatctctggacttcatttttcttttctagtaagtgaggggattggaccacatgatagccaatttcctgttttaacacaaaagttttatttttatgtatactttttaatgctgattataattatagagaaattataagctaaaaataacataaatacctctatataatggatcatattaaacataataatattataacttcttttttgagcttttatatgcctgactttttaattttctttaattggatcagattttaaaaccatgattttaatttttttaagctttcttaactagaaattatctgctatgatgccatctctgccaccatcagagaacaacggactgtgtttatgttatgtattcctcttctgccttattaacacagaccactggaaaaagaaaatttgattgtgggacaactcttaattttcaatcctggttagctgttaaattcttactttgtctggaaaacttatttttttttcttttttccagaatgttataaattcctaattgatcccaaaaagaattacagtttttatgaggatggtttgagagtattacaatgttactaagctttaattgctacagataagtaaaaatgcttaattttgtctcttaggtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggttctatctcttttatttcttaagtaccgacactgttttagaaatatactccttcaaccaacagagggagatagaatactaggatagtacttataatttaaaaaacttttttttgcatttgttatatgtattcatttgattaaattttcactaagatttgtactgaatcattttggttactattttaaaactaaaatttactttgtcagtttataacatctgtcattaactattatgaaatcatattttatgacaaaaatggaaaatattaaattttccctgcatgttaaaaagttcagattaattatcctttttaaaagaaagcattagttataggggaggaattctgaagtgtctatctccattttagctgcacagcaaaatgtaacatccatgcaggtggtttttgaatttttttttagttatatatatttgtggactatgataacattgtatgggtgttgagttctgtctagactattttctcctttcacagaagtggtttggtgcctgagaatgacttggatgcagctgtttttgtttcatctcacttaactctttcaaaactatggcagagtacagctggcagaaagtgttacagatataatccttattttccttgtttttgttggtattgtaggagggatctgtaggcctttctgtccagcgctctgtttttggagaaagaaatttcaatatacacagctccatttcacatgagagccctgcagtgaaagtaagtaatgtagcttaatagcataatggtcagtcagtcatacactgaagagaatttaggtaataactagattaacatttattatcagaaatttttttaaactagagtttggctttggcagaaggtattactgctttaagcatttagtcaaaacttgttttctccagtttttttctgaacttttctggtggaattttttctcatttttggttagctattactgtctttctctagaggaacatttagaacattaagggctttctgtcattgctagagtgtgagctccatacagttagctaactattctgacacatagttgatagtgtaaagatgtttgtaaagttaacaaaatcatcatcaatgtagatgatttcagattgacttatgatatcttgtgacagctagacagcatgagcaacaaattaaaactgtgattttagccaacgtacttgtgcagtttacagttctgaaatggagttagacactagaacataactgttttatacttctgtaatatatcaggaaaagttctaataaagtataactcaaatattggccaagctaggactaattagtaaattttaatataaggtgactttacagaaaaacccaagaagaccttaaacattttaatagacaacagtttatttacagtccaatagccattcagcagtttttaaagttatgcttccgctattgctttttgccatactagcattttaggacatcatgtttaatatcatgaaaatagaaaaatgagacttttcttttacagctcatgaagcagtcaaagactgtggatgtactgtctagaaagttagcaacaaaaaagaaggctatttctacaaaagttatgaatagtgctgtgatgaggaaaactgccagttcttgcccagctagcctgacctgtgactgctatgcaacagataaagtttgtagtatttgcctttcaaggtaatgtgttttgatggtgttataaaatcaccagcatgctgccattagaaattgcattgacttgggtggataattttgtgagtgcaagggatcagttcagatcagtgaactgcaatgggccttgatgcagagcagtagtatgttgaagagcaaatgataacagttttcatatattatttatttaatatggatatactctggaaaacacatttgctcttatatgcaaataagtgggacggggtggcttttagaagcttagaatcacacattttgattgctgatgtagtcttttctgttttctctttttattcccgcttatgtggagtaaccagaaccaaatagtagagctcctcttttactcccacctccaactctttgactcataaatttcttcctttccttcaaggcttggctttcataaagcctttcttgattaactcaaatatataagtgtatctgtgatcaattactccaaacaaatgaatttttatacctgtgaattgctattgggttctattttttctattatggctcttattatccactactgctttttattcttggaggttattttaaacctttctggagtaagtccggggaactagtagagggggtaaaaaacagaagaagaaaaatctaggatttttatcacactagattatcatttactttatagtaacacttattatataggtatcaaggcaaaatttactgtgaactaaattgatgaatgttattttttagacttacatagttcaactttaacataactagagaaatcttatttcatcataaggcgtcagcaggttgcccctagggcaggtacaccaggattcagagcaccagaggtcttgacaaagtgccccaatcaaactacaggtatgttgtactggaaatacagaacctagttaaaatggattgttccagacgtattttattttatgatctttgtctatttataactaatatttgagttcttctgcttttaattatgtaagcagttcttgcagtgtggcattcctatttttgagctaatgctattctttatgaaagtttttaatcctaatgttgcctctctttttttgtttaaacagtttattccatagattacattttgcgtatttatttacaagatgatcttaccatcttgtaaataaatacgcaaaatgtaatctgtggaattttgctgacatcacctttgtgggggaaaaaattatgtttaatagtttttgccagccaaagacttaaagcattttatttgcttgcttaatacctcaaaagtttcctgtgatgtagatatatttgtgtttgattaaaattacttttgttattatataaacaatataatagcagttagaaggttttgaaaaagaaaaatgtcttccgtaatctaaaaacttaccatggagctggaatccaggaaacatcttgaatgaatagatgaatcctgctattcacttggattatgggctttgaagaaatgtattcattcattgaatgtctgttcttgcttgctaatgataacaaataaataaatgagaccatctgttcacactctagtcaggacaccatcaaataattataaaataacctgttgagtatggtaataaaacttattcagggtatttaaggagtatctaactatcctaacccaaagagattatgaaaggcaattcatgaaagaaatgacctcttagaatgtaaattgggctgagaagttagcatagaggcatgagccaaggaactcaagaaacagcatacaggaaactaaaaaagtttcattttggccagacgcggtggctcatgcctgtaatcccagcactttcggaggctgagatgggcggatcacctgagatcaggagtttgaaaccagcctgaccaacatggtgaaaccccatctctactaaaaatacaaaaatcagctgggtgtggtggtgcgcacctgtaatcccagctactcaggaggctgaggcaagagaatcacttgaacgcaggaggcggaagttgcagtgagccaagatcgcaccattgccctccaacctgggcgacagcaagacttcatctcaaaaaaaaaagtccaattttgctagaatattaagatgcaagttgaggaatggtgagagataaacctggaatgaggtagacaaggtcagaccacagttgttacagtttggactatatactgtagatattggaaagttaagtgaaaaaagtgacaatggtatatcctagatggatcattctggcaggcgtgcaaacagattagcttttggagagtggtggcatgaatttgtccgggtgagaggatgaaaatgtgaatgagggtattggtaataggaatgaaaagaaaagtgaagggttagaaaggcagagcttggtggataattggatgtagaattagggtgtggtatggtgagggaaaaaggcattcaggatgtttaccagattcctagcttgggagacttggatgtgtaccagtaaccaaggtggagagtaaaggagaagtaactggtttataggggaaggtaaggttagtttggggtataattggtttgaggtatttgtgggacatccaaatagagatttccagcagaatcaaagttaagtctgatgctcagcgaaggagctgggctagaaatacagatgaatgtcatcattatataaatgacagttgaagccatgaagtggatggaccaatcagggagagtatacagagggagaagttaaaactctgaggaatatccgtcagcacttaaggcttggagaaaacattgaaggagcaggcagaggtaccaaaggagctaagaaaggcaagtagggccgggcacagtggctcatgcctataataccagcactttgggaggccaaggcaggcagatcactaggtcaggagttcgagatcagcctggccaatatggcgaaatcccgtctctactaaaaagtacaaaaaattagcagggcatggtggcacacacctgtagttccagctactggggaggctgaggcaggagaattgaacccgggaggcagaggttacagtgagccaagatcgcaccattgcactccagcctgagcaacagagtgagactcagtctcaaaaaaaaaaaaaaaaaaaaaaaggtgatacagtagcccaaggaacagagagcagataacctggtgatactaggaagtcaacaattaagagagatgtcaactttaagaaaaaaaaaaaagagctttttaacatcaagttgagctagtcgtaatctttaactaccagaattcagaagattaaagtttctatagtgggaatgtaaattagtacaaccactatggaaaacaatttggacgttcctcaaaaaactaaaaatagagctactacatgatccaacaatcccactgctgggtatatacccaaaagaaaggaaatcaatgtaccgaagaggtatctgcactcccatgtttgttgaagcactattcataatagccaaaatttgaaagcgacctaagtgtccgtcaacagatgaatggataaagaaaatgtggtacttacacacaatggaagtactattcagccacgaaaaagaagatcttgtcatttgcaacaacatggatggaactggagatcattatgtcaggtgaaataagccaggcaccgaaagacaagagttgcatgttctcactaatttgtgggatctaaaaattaaaacaattgaacccatagagagcagaaagatggttaccagaggctgagaagggtggtgggagggtgtgggggatgtggggacagctgatgggtacaaaaaatagttataaagaatgaattatccagcactttgggaggccaaggcaggtggattgcttgagctcaggcactcgagaccagcttgggcaacatggtagaaccctatttctaccaaaaatacaaaaaagtagctggatgtggtagtgtgcatctgtggtcccagctactcaggaggctgaggtgggaggatcacttgagcctgggaggcggaggttgcagtgagccgagatcacactaccacactctagcctgggtaacagagccagaccccatctcgaaaaaaaaaaaaaaagaatgaattaagacctagtatttgatagcacagcagggggattatagtcagtaatttaattgtgcagtttaaaataactaaaagagtactttgaggggctgaggcaggcagatcacttgagcccaggagcttgagaccagcctggccaatgtggcaaaacctcgtctctactaaaaatacaaaaaaaaaaaaaaaaaaaaaaaaaagagctgggcatggtgacatgcctgtaatcccagctactcaagaggctgaagcatgagaattgcttgaacctgggaggcagagattgcagtgagctgagactgtgccactgcactctagtctgggccacagagggagaccttgtctcaaaaagaaaaaaagaaaagaatataattggattgttcgtaacacaaaggataaatgcttgagggaatggataccctgttttccaggatgtgattattacacactgcatgcctgtatcaaaacatcttatataccccatcaatatatacacctactgtgtactcagaaaaattaaagtcttcacagtcacaaaaaaataaaaaagtaattttttaaaagtttctatagcagtagttggtgctagtgtcagctgaagaagagcttctaatgttcattacttttcactaaaatgaaagcactttgaccagtatggtatgtaattctcaaggatcattcagattttttcccacatagctatttttggattccttttgatcctataaaatgtgcgtttacttagtgtttcctagtgattaaatatccttttaaatttaccaacacgttgctcaagaaagaaaacatattttgcagtgaggattctcagtcctggttgtacattaaaatcacctgaggaacttttttaaaacattgatgcctgagccctacttcagaactgttcaatcaaaatctttgggtctgggcatctgaaatttttaaggctcccaaggtgattctaatgcataataaatgttgaggactattgatttagatgataaaattatagatttgaaatttatttttaaaatttgtcttctgttgcagcaattgacatgtggtctgcaggtgtcatatttctttctttgcttagtggacgatatccattttataaagcaagtgatgatttaactgctttggcccaaattatgacaattaggggatccagagaaactatccaagctgctaaaacttttggtaagcagttttgtattatagaaccaaacaaaatgcctttgattatctcctacaaatcacttaataaattattgtgaaattttctttacaaataaacattcagtcttgataaagttctctaatattaagtagaaaattcttcagttgcttgaaaataaatttatcacctctctatacatataatcatttaatcttattaagcacaaagtaatacactgttgcagtatttaaagtttacctttataattttataagaataaggagtaaaatcttaactccttttagttatggtttgacttttattacataaatttaccttttattaaaggcatgttttactttgtaatatgttttacttttttattgtcttttaaacatcagatgcactatgtcttggtacttagagtgtccttgccttaaatgatcttaggctatactaacaagtaaacagttaattattaatacagtgtaataaggactagggaagagaatggaaatgtgtgttgtcaggttgtgtaggtttacggtagcagagaagcagaatgcatagaaggccttaactgatgggatattattgtaagcatatattggacttggatgtcatctccttagccacgcaagttcttcaagactgggatgtgcagtgtacttcatagggcacataagaattatctcagccttgctctggccaacaatctgaactcaagtgcccatttaatgtttattttccacgctcagttatagttaatactttccaaggaataagtgggattgactcagcttactaccatacaatacagaacacctcaggagacaaagtttcagccagcctacctcaagagtagctgggctgtcttgtgctcaaccccaggatcagtgggtcttaaccagagttgcatgtcagaattatctgagaatctttaagaaatacatatgcctgcccactcagcctattcttggaaaatatgattcagaaaaacaagatacttaggaaggctccagccttgttagtttgaaaaagcaagtgattctgactaagaaactatgggtgtttaagaaccactgcaaaaattactgcccttgcttatgcactagtgctatagtctaatctacaagaaaaacttagtggtggttgtgaagaaagcctcatcttaatagaggcttgccaaaatatgtttctacagtaaagtcagtccacgatttgtaactatcttgtacttattgtaagaaaattttatttgaagataataggatgaaataatacaagggaaaaaaagtgaccatgagtggaaagcaagattgatatcttagaaatggcattcttacataataatataacaagtatgtttattctcaactgagaaaactttcatctactattgaataacttcgtgagaggtttatgaacatgaagtttatcagccaataccaacatattttattgaagagcttgaatctcccccattgtaatccaagttataatcagggccaacaatggaaatacaacatctgacccaaaaatactctagatcaagtgccatgatagcaagcaagagcttttagagatttatcattgtaatacttctcatattaaaaaaaaaatagggccagccgtggtgactcacacctgtaatcccagcactttgagaggcttaggtgggcagatcatgaggtcaggagaccgagaccatcctggccaacgtggtgaaaccccatctctattaaaaacacaaaaattagttgggcatggtagcatgcacttgtagtcccagctactcgggaggctgaggcaggagaaccagctgaacctgggagatggaggttgcagtgagccaagattgcaccactgcactccagcctgacgacagagcaagactctgtctcaaaaaaacaaataataaaaataatgccataggacttgtctcagttgtattagtatgacatctgtagttattttagtcttgatcttactataactttggactgagtataaaagcctcaaaatttcaacaaacacaactgtgttcccctttgtaacctaaagaaatgacttggctgagattagcagtgagagcacctttacttctcttatctgtcctcaacccttaaacctggctccattgtgggttgtcattaagtactcagtgaattgtgttgaataaattaaaaagaaaagtcttgagctgaaacaaattcctgacacatagtagtctgtaataaaatatgttgactgatagtgttacttgaagttatttttcctgaatattgtaaatgaaccctctttttggtcatataaaaaaaagcatattgtataacttggggacatgctataacatatactattagttattttatgacttcagaacaagctaataaaggaataaaactatatgaatattcccccctggctataattttctagagagaataggaatgatagaatcagtttaaaagtaaaaaagcattggcatattgtactctcaaagaatttggtcttcagtaattgtttgtttcctccctttccctcccccatttttttccctggcttagtacaccagtccagtagttagttcagaatatgtaaaggtaactttttatcatccacagtcagattaatgactttgttgacaatctacattctcagaaaggcatctaaatgttgtggtacttgttgtttcgtacatttagtatatttctgtttaataaggaaatgtaaggcaaaaataatacatgattgccatttgtgtgattaacttttttttgcacatctgataataaacccatcaggaagttatttcaaatacatttatatttttaaaaacagatctagtttgtttatttgttcattcagaaacatttattggggctttatgtgtgccaagtactattgcgagtctctgctttcacagagcttaaattctagtgagggagagaacataaataaatactatgagaaatgagtggtactgagataaaaggaaaaggggagggaagaggcttatttaggataggttggtcaagaacagcatctctaaggatgtatgtgtcatttgaacagttgttgaaaagaataatgcctttttgtctagtccaacagacattaactgactacctaatctgtaccaggcataggctgggtttggggggttcaaagataaataagacagttcctgccttcaaagagctcagtctactaggtgggacagacatatataggatagcaaaagtaatagtagaactctcaagatacagtagaaactgaaattgatcagttctctctgagggtgtcaagcctcagaggtgattcttgatctgagtggtgatgtcagtgagagtgtcctgggcacacaaggggtgcagggcatcctaggcaaagacaggagtcatgtagtcaaagacatagaagcatggaaaggaagtagagtgggggcgtgggagctgcagctagttaaagattatagaagggtaagatgaagcttgagaaattggcagagtcaagtgagtgcctggcatagcttagtaagtcactgctttgtacttactatctcccactttatctcccactatgcaattcaaatacaacttaaatatagcatgtggtgctctatctcatactgtgtgtgtgtgtgtgtgtgtgtgtgtgtgtccatgtctataaagcatatgtttgaactttcatgtttctcatgagagaggcttctgatatattcaaataataaaatgtttttttctgtttttgttttttcttcttttgcttttagggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttttatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaaataatacatacactggttgataaagggaagctgcaggaccaaggtgaagattgatagtccaaatgcttttcttttttgagttgtatattttttcacaccatcttagatataattaggtagctgctgaaaggaaaagtgaatacagaattgacggtattattggagatttttcctctgcgtagagccatccagatctctgtatcctgttttgactaagtcttaggtgggttgggaagacagataatgaagtaggcaaagagaaaaggacccaagatagaggtttatattcagaaatggtatatatcaatgacagcatatcaaacttcctatgggaaaaagtctggtgggtggtcagctgacagatttcccatttagtagtcatagaatacagaaatagtttagggacatgtattcattttgttattttgagcattgataggtcagtatatctacctaatctgtttggtaagtataggatatataaaccattaccattgatctgtcttatgccataatcttaaaaaaaatttgaatgctcttgaatttgtatattcaataaagttatccttttatatttttta

SEQ ID NO: 419 - DNA, 4626 bp, Homo sapiens
ttccattggctgtcgggctcaggggctctcttttcagcctggggcgcgcagcgcctcggatgcggattggccgaaggcggggctgggaggcgggttaaagagcgcgttgctggctgggccacgcgtgcttgagaaggttcaatggcgtggcagggactagcggccgagttcctgcaggtgccggcggtgacgcgggcttacaccgcagcctgtgtcctcaccaccgccgcggtggtaagcggccgggcggaccggacgtcgccttggttacagcctctggcgggaggggtgagggtcgccatggttacggcgtggctcccgggcagctcttgactggcccctggttccacagcagctggagctcctcagcccctttcaactctacttcaacccgcaccttgtgttccggaagttccaggtgaggccgccccgcgccgcgcacctgtgggcccgacccacccaccccgcacctgaccgcccgtcccccgtaggtctggaggctcgtcaccaacttcctcttcttcgggcccctgggattcagcttcttcttcaacatgctcttcgtgtatcctgcgccctgcggacacgggctgggtggagggcaggccggccgggctgggagagaggccgggacggggaaactgaggccccgcctggtggcacttcctataccgacgccgtaggttccgctactgccgcatgctggaagagggctccttccgcggccgcacggccgacttcgtcttcatgtttctcttcgggggcgtccttatgaccgtatccttcccgcaggctctggaacctcgggctagggcgcctcggcgtccagcctgtgttggtcctggggccaacacagccatgccagagagggacacagtcgctgtctccagcttagtatgtgttgagggcccactctgtgctcagctgcaggggtcagggctagatcttcagtgctgtatgcaaaatacaaagccatgcacaaaagagccaggtgggttgtcagggccactagctgagccctgaatgcgagtagccgggagaaactggggcagggacaggcagtggttgggccctgggatgaggctgtaggtgtgcagggcagatttcgtgggacctgaagcccgtggagtgtgtcgcctttattggactggctcatcttgatgagggaatagcacataggggagatgaggggaagaattccagggtcttgggaagtcagaggggccctgggcttgggctgaggcctgcaccggagcaccttgactctggcccagctgctgggactcctgggcagcctgttcttcctgggccaggccctcatggccatgctggtgtacgtgtggagccgccgcagccctcgggtgagggtcaacttcttcggcctgctcactttccaggcaccgttcctgccttgggcgctcatgggcttctcgctgctgctgggcaactccatcctcgtggacctgctgggtgagcctcccggtacatctagtccgccccaggctggccactcccctcaggacacgctgcttatgccctggggcccctctcccatccttgctggagttctcctcacacctggctccatccccatcttcctgccctcccagctgctgtgctcttacagcccctcaagccagccggcccacataatttgcatcgtcaggacggatctactgatgcttgcacggtcctgatgggagtgaggatgggagggtcagggttcctgccccatggctcccactcctccactattctcaggccctcccctccctgggtcctgcctgcttctgggccttttaagcttgtccttcacggccaacccggggctggcactctgtgcaaggctttggggcactcatgctgtggggcctgcagggccaccaggctgtggatgggggcctggggcaggctctgctggtctaggactctgggctgtggagggtgaccccacagtccgtggctgtctcacagggattgcggtgggccatatctactacttcctggaggacgtcttccccaaccagcctggaggcaagaggctcctgcagacccctggcttcctgtgagtgttgagagccctccctccctctccccaccctcagaaggatccccaccgatggggacctgtgctggcctgtgctcaacacgggcccctccccacagaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgcagtctcttggcccacagcactggcttccccatctcacctggccacatccttctatgcctgccccgtcctcactcagtgtggcctctcagcccaactgcaggtggtaggataggggtgcccacagagggcaaagaaactgcccatggttgcctggcagagctttgagctcacaggttgccaggcagagcttttgagctcacaggtgacaggctcagggttctcatcctggccccaccagggccttgggcaagtcctgcccaccataggcctctgctacctgccagtcagcggggaagttcaccagatttcggctgctggggccaggacaggcgtctcctaggttgtgccaaaccagcctacagatgttcctgccagtggtgccttcaggctgatgccaatctagcctctcctgtctctcatcagccaccctgacaggtgggcgtatgcctcatttttcatctggtgatgccaaagccccatggattcaggtgcagaagagggccaggactaggtcttctgccctttctatgacctcagagcctaagttttcaccttagcagagttctgagactgggtgaggcagggacttctggaaggttctgttcctgccctttttagctgaggacgtgtgtgagccttatccgacccctgtggctcatttttctcttctgacctggcagctttccttgttgttctaagcctgtccatgttgtggtttatttctggatgctcagtggcacggggcctcctccaaagacaggttgtcattttcatggtaacaacactgttctctgttgagtctgccctccgtgttgtagccagaccttgtggagatggctttgcggcggtgtgagctggcggtcaggagtgagggcccagccttcccggcacctcccagccaggtggccctgcccgacctgtggggtgaggcagccaaggttccttccatccccccagttgtggagacacagggctgcctcaccctttcattgccgaggttcctacctcatggacagaacaaacacctcagcaatgaaacctgttcatgtctaagagcagctgggctgggaatcttcccctttgttcaaggccttccagtaaggcccagctgtccccttgctgtgcatggggctctggggagttccactctttgatggagggcagaggccctgagtgcaaactccctgggaagagtcccatgctaacatgtgctcaaaggagccctcctctcacatctcagcgaccaagaaccccaatccctaatcagagctctgcctctgccccacatggggccctaccccacttccagggagcacagcagcctctgaccctagccctgccctggcagcatgggacctgccaacagctgagggtggcagcagtctgtgctgggatctgtgcccggatctgtgcccattctcttcagtaaggctggagctgcgagccagtttgctgccctcccagatcctgtgtccattctgaagaatggggacacctccctattacagatgagaacagaggggacatgaactccttggaggcagggctgggaagggaccctgggctgtgtctcctccctgtaccgtgtcaactccaagagctggcaccaggccgggagggctattcccatattcctcacagctggcttgtaaggcaggagctggcccaggccacagcacctgctggggtgggaaagggccccagctgacctggctatgggtgccactggagctagaacagccctcctgcacccaggctggcgacagcccagcagtgcccacacaggactgggccctccgcaggggacttcagagcagcaaggccccagctggcagtagcctgaccatctggacacagcagagccagggcggcccagggacggcaggagagctcgcggcaccttcctgaggccaagcaaggggagcagggttagggctgttcctgaaaggcagagagcctcttgccctgagcctcacagctactcttctcagctctctgggtctggaaggagaacaggctgaggggagctgagaggagctgaggtgctacccggagccccattcacccccacctgcccacttgggaatctgaggcagaggagggtgaggcctgtgtgccaaccttgttcacataccaccttcgtccccccaggccccggccccactcctggctctcattatttttatgttaaaactttgaagaaattgaacatgacctgttgaagaaattgaa

SEQ ID NO: 420 - DNA, 20429 bp, Homo sapiens
gctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggtgaggaaaggccccctcttcctcccctgccacacgttatcttagtcctgaaaaggctcctgccaagatctgggggtgtgggatttgtgggggtcatttgaccttatagaaccatgccaggtttgggtagagtgtttttaagggcccttattttgagatggtatgcctgagacctgctttccattccctcagggaagtttttttgacgctaagtgtgccctactgtctctcctcctggggccggattcctcaggccagagccaccggacctcaccattcttcccccagggctccctttgtgtttccggcaccaggcgtggggccccctctgggggcgggagactgggctcctccagcgacttccccgcttgaatggctgccgagggaggtactggaacaagtgcatctgggactccctacactcttgaggcaccagattccccaacacagaacactggccatcctgatcagtagactccagctgtgcctctcacaccaccctgggatcatgggacacagagctggtcacccagagctgctgcttaacaccaaaagctttgatctgctctgacctggtagctctagagcctaatgggacccacgagcccctttatgttttcaggacagaaaggaatggggacaggatctctatgtaggttcactttctagttagcctgttggggaactgaggacttgtctgggagcagagggtgattttgtttttctcctaaaaggccggttttaacctggattgtaggaccttgtgtgtgtgaacacagggatggagaactccctcagagggccccgaccaggaaccagtcttaccggtcaggcagcccctgcccacctgctcaggcgggcatctggcttaccagcccagctggggacttaaggctccactgctggcctctggggactgaattccatccgggtggcattcattggctgcccgtggcgggagaggctgggggaggggattgctgagtttctaaggggctttagtctggacaatgaatcacatatcccctcctggaaaggctgcagtgaggcagctctgtttcattctactgccaccgcctctggtcctagaaaacactgagtttctggtggggagaattgagggagtggggaggcaaaatcagagacaaatgcccatttctcttcccccctccagagaaaaccagggcagagaggcctgggcctgtggagccagaactgggtggtgactttgtctttgtcatgctggggttggggagagggagtcctttccagcagtgagtgtgtgtgtgtgtgtacacacgtatgcatatgtgcctgtgtggtggggtctggccaagtttctaaagtccctcttggttctctcttttccaggcctgatcacttgaacggacatatcaagcaggtgcacacttctgagcggcctcacaagtgtcaggtaggggctgggtcagggcagagatgggctgaaggagatgatgctgttctcacggtcgcagccttgagccagccgctgcgtgtgccgggggcccggctgaccgcccaccgctttgcacacctcccctctgttcctccaccctccctctgctctcctcctttgttcttcccccaggcccccttcccccacagctgacgttcctccttcctggttgcttggtcctggttcccaccctgtctttgccttcactctgttgcttggctttcctctcctggtgtttgccggctccttggatggtgggccgtatcacacagatgttgtgttgggagacccggcactgcgctgggcctgactgttggtttccagcagtttgtagggactgcaggtttttttaaaagggctcctggtggtccagccaaccactcttccccttttctgacctcagttagagctcctcctgggtcccctcagcttagggcacaaggcagtgggggaggtaggaggtagggagtgggtggtcccctctcccacactggcatctgtttaacccatcctaagccagggtttctggaggactggagagcaaagtgggctcttcttcttttagctctttgcaaagtagcaggtaggaaacgctggaccagatagattctcacccttggtttacctgcttgaacaatatctgggggccctgctggtacccaaaagattgagtttcctctcctggccactgagccttcctgtgtggatagcgaacacacctctgtcttctccttggttatctcccctctcccatgccaagttcccatcaagtgagggcgagccatgattgtggggtgtgcactgcagtctctgataggataacctgcttctccttatcctgttggtggcaaggggagagggttcagggagaccagcagggagggatgaatgtgccgtaagtagggcagagcccctgggggtcaggcgtggacggtgttcacaggtgctgggctaggcagtctccctggaggatgacccagggtgggcctgctgggatctgtctttgccttgctgccttctctctctctgtctctgattctctcatcacagagcacattctgactcaggtagtgtgctgattagcccgggcagagtaggaggagcccagagggcagtgggggcaagcccggtggcctgggggggtaacctgcactctctgccctttttccaggtgtgggttgggagcagcagcggcctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggaccaccccagagggcagcagggcctttacccagtggcctgttggctagcctgggcctccctggagagggttgacagtggaagggaacaggaggggcatttggcctgagacccctgcttttgggagaggctagcagggtggttcctgcccagcatgcccagctcctccctgggtgactcggagtctttcccatgtcagagcccccaaatgggggtagcaaggagcacctttctggaaccccctatagcatccaagtttctttctgggctctcttgccttttcccccctttcacagatggcacccctgggcatctgtccttgcctaggtgattttggaggttggtgccttcctgggaactagccaccagcttatctgcttcccttcccctggcatcacttcccataggcctggggtttctagactggggcctggccacccctttccccactccacgagtgagtcggcctccagagaagactggcacaattccaactagagtcaacccatgctgccctctgcccttcccactcagatctagatcctgctttcatttctggctagtgaagtagacttttgtgtttttgaggtttattagcaggtctgctcaggaaccaaactaatgagtagctttatattgggccaccccaatatatggctttgggggctgaaaaagcagatgtagaccccctccctcggatccttattggtgtgccctttagcactccgcagactctgcggggtgaacaggagtgatgataaaatttttcattctaacatttgaggctttgtgtgttttgtccttggtctgtgtcataacactgacatcactgtcccttggtgtacaaatgcgctcctgccctgcccctcccaacatacactctcacagacctgctggcccctcctccagccctacagccacaactcccctaacggacccagcaggtgaagacatgctggctctcttgctctgggctggccagccaggtgtgcctggacttggttaaacagcaggggcacctgttggcatagtgtggggatgctgaaaacataagaggtgaagagacggctctctgggagttcattccttgagttccccactggctaggcacagtccgtatcgctcatcccctcctgatgccagagagaatgaaagaggccagttacagagactagtgccatagcttaagtagaaaggccatctgaatgtaggggcaggaagcctcaggcttgacagtggcatgtctctttgggacttggcctgagtgtccttaactggcccagatgccccaggtactgctggatttatgagcttagtgggctgggacatttcccccacatggagttcaacctgaagctgagaggctggagcagctcagacctccctagcttccacgggctccacttcttgggggctggttagagaaggaatgcgttgagatgggcatatgctcgagaagaagggggccaaagagcccagggagctgaaccttcatgcattgcccttagagttttccagggctgtgggagaaagctgcttgagactacccctgaggctgcctgagttcaagggctactaagggtgggggtgtgcactagtgcccttggtaccacttgggccccattcccaagctgctcaatccttaggaagaaaagctttaggaagtctgggaagggagcaggactggggctcagtgttgagtggtgatgacctgcactcagggtgcctgggccaggacctggcaggcatggcccttaattacagcaggctgtctaactaagcacagggctgtgggccgggcagctcttccgagtgccacaggcagtcaaagcattctgcctctggctcactctcttcccatcagcgtccctctgtcttctccctgtctctaggacaaagaatgctcttctcctgacaccccagcatggaagttctggatgttccctttgagatctgtctccctccgccccttctctcctgggttgtgtgaccaggctctttcatgttctgtgttgtctgaacttctgctgtgcctagactttggactttcacaggctccccagaaaacctggggactgcagcagcagagggtcaatcctggcacagagaagccaacaatcacttcagcttggctttgaacacagggaaagcgtttgtcatgtttgtgttttttcccccagcagcagatttacattcctaattctgtttgctcaggcgaaagttagctttcattccttgagagataatcaatggaggacagggtgggggaagccagcccagtctgggattttaattttgcttagctaatccccaaatggataagccacttgtgggtaactgaagtttggctatccatcatctttaggtagcaaagcatgacaggcaaagcctttagaggacagatcccaaaagaaggttggcaagagaaacaaggcatctctttcctatccctcttgtggctccctctcccagagactgtggaagacaaaatcctgaatatgctttcagcccccgagtagctgggactacaggcgcccaccaccatgcccagctaatttttttgtatttttagtagagacggggtttcaccatattggccaggctggtctcaaacttctgacattgtgatccacccgcctcggcctcccaaagtgttgggattacaggtgtgagccactgcgcctggcctcagccctgttttcttacacctgatccatgttggttcctttgagttctgaggcttagaacacaccctctctcaccattggaggggtggtctttgggtcgctgcctggcaaagctagctcttgtccccaaataaatcaacaggtgtacctctctttcccgggggtgtttatgcagcccctgctctggtttagagactgctgggctgtgtagaggttaggagtttttttctcctactgtggcctgtcactgggtcatgaggtccctggctgacgtggggcccacatgtggccatgagagcaagcatccatggtgctttctgacttcctacatgctggaatttccttgcacaaatctgttcacctttcccttttgggagtcctggctgccaagtactgtacactgtgttataaagtatgagcacctttcactcagcagaagctccctctcctgaatctggagatggtaagagcacaggctctgggactggttcttagtccagctgtctcatatcctctcacggcctccactggcccagctgtaaactgggagagatcagaatcccccagggtgtccaggaggattggtaaagtactggcctgggtgtggtgggggtgggtgtgctagactttctttagtagctgagtcttgtgttttaagcaagttcaccttctgaaggtttcctcatttatgatatgaatacactgaatatataaaacagataaaagcagtatgtcattgctacaaattcagttcaaatgtataatgtttacttaaaaagacaatgacagaagagctaggtaggctgtgctaacgtacacagatatttgggactggggtagtaaacagtggtgtcttctaccttgacagcattgcatgcgtttgtttcttgctatggctgtacagtaaggagacagttagatgtctgtatgtgttgacagtgttcagccacttaccttgagctctcaggttctcaggatgtgcttctgttaaagagagatggcagaggcagttccgttctagcacaaggtaatggggtggtcttcagtgggttaccatttgatctgtgacacaaaggtgaatgttgctttctcttacagttctaaaacagtaaacacacacacacacaaaagaaatgagtcaaaattgactagaacccatgaaacacctccctggaaccaaaatagcttgaaagccaacggattcagctcttctcagggctttcccaatattctatgacccccacagctggaatgcctttgtaagctccagctgaggaagggatgttgtgaggagactgatcactggtactaagtcaggtgctcaggtacaggaagtgcctgccaacctgagtcctccttccagggtgctggttctgaccttcagctcctgactcatccaaccccgggggcctggctgtgagttggtgctcagctcacaccacagctttccaaagccacgctgtcttggagggtgatcacacagcttgcctcggagggctgctgtcaggatgggttgcatgagataagtgcctctaaaaggctgagcaccgtgcctgcctggcacacaatgaatgcttaatcaatacagggtagtatcatcatccttgctgtcaccagcacttccccagcttaacgtttcacaaatgctttttttttttgagacggagtcttgctctgttgcccaggctggagtgcagtggtgtgatctcggctcactgcaagctctgcctcccgggtttatgccattctcccgcctcagcctcccgagtagctgggactacaggcacctgccaccatgcctggttaatttttttgtgtttttagtagagaccgagtttcaccgtgttagccaggatggtcttgatctcctgacttcgtgatccgcccgcctcagcctcccaaagtgctgggattacaggtgtgagccaccgcgcccggatttttttttttttttttttttttgagaggaagtcttgacttgttgcccaggctggagtgcagtgacacgatcttggctcactgcaacctctacctcccaggttcaagtgattctcctgcctcagcctcccaagtagctgggattacgggagtctgccaccacacccggctaattttttatatttttaatagagatggggtttcaccatgttggccaggctggtcttgaactcctgacctcaggtgatccacccatctcggcctcccaaagcgctgggattacaagcatgagccaccgcacccggcccacagacacttttgaagcctctggcccttgctgtctgctaattctcatgtcgtcagaattgccactatcatttaatgggctgctttttcaattcaaactcgtgaaaatattacgaataattatctctgcactttgtcctgcctttcctttccatttccctggccaagactaatgtcacttttgaataaaatgaacaaatataattctttgtataaaactaggggaaacccagggatacagaacaggaaggctggtttatatgccaataactcatctgtaaattcatgtaaatgtaattctgtgcattatagctaatgcacctaaagtcaattcttaatgtctaaggatgagcaaatgtgtaactcttcattgtgtagaggggtatagagcttagcttgccatgtcctgggtacatttccagtagtcatttagttagtaccagtgattcccactcaagtgtcccgtaaggaggtaccatgggaaataagagcagcctcttggcattctgggtagggagcctgagccaaactctaaagctgtctttataaagggaggtcatgtgatggccagaaattgcctttgcttcatggtgcacttggtggggagtcaggtgtggggtgctgggtttcacatcatcccattttcttttctgccttcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtaatctgcccactgtttcctcacttccagaggatgggcctgagcgtgtatgggaggcctaggggtgtctcaatcaccctgcctcagactccactctttgcacagccaccccctacttcccactgaatgataaacaccttcatcacccaactagctatttgctacctcttccttcccaagaagcttggggtgcttagaatgggaagtcccaggagaccagcaggtcaaaacagaaggagagaggttcttcccaagcttgggcccataactctcacctgctactcagatggcaggatggatgcattttgcagacaccactgaaccactgaggttggtgggggagttagtaggtcccaaagtgagagaaaaagaggttggtccggcttgagagcttttgctggttgattcactggcatatgaaattcagcagccagggaaggaggttgagtctggagataaacaaggagcagacactttgtagcacaagtagtcagaagagagcccaaactcaggtagattgtggccttgagagaggaaagtggaaggtgctctgagcagggcagcatgcttgaggacaaggtgggcctaagtagtgtctaactctgtggcagtggtgttgtgttgggtgaagtcaagcctgtccccaaggttctgccgggtctagttggctgttggaagtgctagatgtttgtgttttgcaagcacagcatcagtggaggcttgcactgtgtctgtgctaaaggaggttggagcagctatctgtgaacgtgaggatgcttctgcatggtgtgctttgctttggccagtggggagcactgggatgtccttatctcctggggcattcttgcttgtcccaatgcttccgaaagcctgcttagtgggtgcagcactgaaccaggagtcaagagacccagggtttagtcccagcctctcactaggtggcctcgagttctcccattccctctctaagcttgagtttcttcatctctcaaatggggttaagaatagccccctttcccacctcacagggctgttatgaggatcccaggagacaaggtaggtgaaaggagccgcacacttgggagactctatccttgcactttgtaacaatgttgggaaagacatgcttgttgacactctgggttggaccaggcacaacactcctgcaggccttggcggaatcgttgggtgcctgtgctgtgttcatgtgccgaggtccacggtggaaggagattgctgagtagctgggtgttcttggtgtcctggaactgggtccctccttgcagcttcatacctggggtttgtaccaccaggacacctgctgtgaaagcagggaagtagtagtgaaggtctcttaagctgtctgttctgttttctgacatgtcattagagcccattgctgacaggagcttcctccaggttgcaagcggtgggcttgcgcatgcagggagagttatcaggctgtggctgactgtcttgactggggcttccccagccctagaaataatgtcgtttcttgtcttgcttcatcctaacctggcttcctgacagctcccccggataactcaaaacctgctgtaacaagctgttagcaggcattttgtcaagttttcaatatggaagttcccagtctgagaactggggtcagagaccagaggttgaaaactgctgagtggagaagggtgctcatgataaaactcagaaagcccagaccagatggtggagtagggcagaaactggacaggagacccagggctacagcccttgaagcccagctcaggaggagagaaaaactgagagcagcagggacagtgggaaagttggcccagtaaggaagcagctgatgtggcaaagccaacaactattgtacatcaggatttattttccaagggctagtaaagagaacttgggcaacagccataagctacatgaccggaatggagaatccagaagagtaaaccagagtctactttttctcagaaaagccaagactgggtctggatcacaggccaaacatctctgggttccagagccagagcgggaagtccctttcctgcaagaagactaaagaaggtgctggtccaacccatgctgggtactcagaaagaagagaaaacaattgcagtttttatcagaagagaaggagcaggattctactcctggactcattccttgggcagaaataggaagagacaaaaaaaaaaaaaaaaaaaaaggaagaggataaagttctttctgagcaccaaaaacattgagacattggaatcaaaatgcagagagctctgtgtcctcctttgccctgctgccaccaagcctgtacctacaggaggggttgcacgaataaacgaatgttcttatctctgcatgtgttcaaacaaaggctgaatgtcagaacagttaagattgaatcaggtgaacttccaggtgccctcagatccttcaatcccaacaattcttaaatagttgacttaagtatctacctatagatctgtctttttcaatttttgccacaaaaatgactcctggctgtgaagaatggcaaagaggaaaggcagcctgactcctgcagcctcacacgtgagtcagatgcaagttgaagagacagatgactctggctttgtcatacagacatatcaggatgtgtatgatactatttgtacaggaagatcatttgcagtggagggagtattatggctagaaaagcttgttcccacatttttgagttgaggaaatcagttgagttgaacagtggaaaagggagaaggccctggctgatcaccatgattttcttcctttaaagtttctgtagcaggatctttgtatatatgcctatgtgctggtatggtgaagaggaacagattatcaggaatccgcctttgacagagacatttgaatgcaaacatcattgcttgaaaggtagaggaagccttctccccagtcagaggtaagcacacaagtggatggatgcagggaacctgctgttcccctggactcacatcaagctatgtaggcccactccaacacagtgcagttgggaatggccccttcagggtttggacaaggagaaagcagtccccaacccctgcattgatgtggaacctgccaaaggatgatttgcttctggagtgccaagtgcaggcacaccaggcaagaaaatgcaactgaggagcagtggccttttgctaataagaccatcgtctctggagtgaaagggccggtggcttgttggttgtagtggcagtcatatgtgtgctcagcatctccattgcgtggatggctggatcaagctgcctctttggatcttggttaatcagtggtgaatgggtgggtaagtttagaattccggctaaatatgtctggcttcaaagacgtattctgctcagaagctcagcttctgtttcatcctaacacttggctgctgagttgctctgtgtttaaattctaggctttaagtggcagctgtggatccactcctaccaccccgccatgtggttttgctatagatagtacagtctgcagctggggtaaagtcaagaggactcagccacgtgtttctaagactgtttttcaggaaaactcagcaagacagtttcgctgttgttgcccagactggagtgcaatggcgcgatctcagctcatcacaacctccacctccttggttcaagcgattctccttcctcagcctccctagttagctgggattacaggcatgcaccaccacgcccggctaattttgtatttttagtagagacagggtttctccatgttggtcaggctggtccggaactcccaacctcaggtgatctgcctgcctcggcctcccaaagtgcatgagccactgcgcccagccaaactcagcaagtttttattgagcatctgctgtgttctcttggtatagctctcccagtaaggagtaaacataataattcctggtgctctcccgctcctttctgtccccttttgattgcagtggacctgctctggttcatcacagggagagagcttcatgctattttagagaccccacaagggattaaaaaactaaggaaaggccgggcacggtggctcacgcctgtaatcccagcactttgggaggccgaggcgggtggatcgcgaagtcaggagatccgagaccatcctggctaacatggtgaaaccccgtctctactaaaaatacaaaaaaaattagccaggtatggtggcgggcgcctgtagtcccagctaccagggaggctgaggcaggagaatggcatgaaccctggaggcggagcttgcagtgagccgagatggtgccactgcactccagcctgagcgagagtgagactctgtctcaaaaaaaaaaaaaaaggaaaaaattaccttctaaagtggtatcatcatattatcagaaagttctaatatcttgtactgattggtgggagccaatgtctcctggttctgctttgttttaggggactctacagtaccaccccaaggggcagggctaacagcctctttcccattagccttgtctcctcactcctgactacagcctccctcttagggatgtctacatgggaccctcttacaccaatctatacccatgatcagcctcaggcagaccactgcggtcatagcacaggacaacttgctctaccaggcagggcaggacaccagcacctggtctagacagatctttgaagtagctgtattgggaaaggaaggaaaattggcccaatcccacatttcccttcagaaccactaactgctgctgtcagaggagaacttgttaaataaagttcccacaggccagccctgtttttccagcagcttccattctaacataccattatggtcgaaaaatacatgagtgtaaatggtaataatgaaacctattgtaaaagtccactggatatttctagggctcagggctaagacacaggaaccaattaacccatttatgctggaggttacaaacttttttgtgaaaaatcagactttaatgatgatcttgagcagtaggatacaaataattcctaaaaggttagcgtcccaataatggaacatgaggcataagtgggttaaagcatctgcccagtagctaagggccaagttctggtggcacatgatcctggggttggagtccaggctctgccactcagtagctgtacgtgtgaccaggttacttaacctcaccaagcctcttttttttttgagacggagtctcgctctgttgcccaggctggagcgcagtggcatgatctcagcttacaggtgcctgctaccacgcccagctaattttttatatttttagtagagacggggtttcactgtgttagccaggatggtctcgatctcctgacctcgtgatctgcccacctcagcctccctaacctcacaaagcctcttatttctttatctgtaaaatgggtataatagtaatctgtagcacaaagggtgttgggcaaattctatagaatagtgcatgcggtgtgctgggccctggtgtgccatcagcacttcctaaaggtgaacctttattacagttccagcagcattcaaaataccatgccaattcagacttttttaaaacaaatctcatgcagacattacacagtactcttcagcctctgaccctttaccctttagcagtggatctcactgttatcctgtgactgtgtaattttgaaagtgaatggaaacacctgatgatgagtcaaccagatctgaagtggattaaagggacactgtcagggtgctggcaccctaagtgggccttatactaaaaagcttcagttcctgctaaaagcaccttctgatccttgactacagtggggtttgatggcatacctccttcctgtgaaacccaagtcaaaatccttttatcggcctgcctgattctgtatccttggacgcatggctgctgtggaagttggcccaagatgtgttcttcccagcctgagatatctcgtggatcagactgaccgaagcatctgggaggtgggctggaacagtcccaagaaggccggattgtcctcccccaaaataaagacagagatcatccgtgtttcttctcctgtacgcgaacctggtggatgctccaaaatcgaaccaaaacactaccatgaataagagatgactgcactcctctgacacaacttcctatttttgtctttgttcttcaaaaggtctaaacagttactaaatcctgttatgctgaaggtggggaagttagaaaaatagaacatctcctgacaggtagaagacgggatccttggaggcgttcctttgggatttcattttacctccatctcgtttgttgtccagtttccttttacgaggattaagcaggcatcctgctggctagaatcctgtggcttccctggagcctcaaattcttgtctaaccacatttctagtcatggttcctgcaggagacatccactcaaaccacctgttactgaggcaccaagcaaccctagaggcagttggcctctggccctagcaggagcaggatctcaggccatcccaccaggcagccagcctcagcccctcaccgcagccttgcagagtgggctctgcagagaagccgatttgtggacagtgccaccctccatcctgagtcacatggctcatgtggttgcagccatttttgagccaggagggggccccttctaggtgcagctgacctgggaatgctagccagagcggccagaggagaggagttgggggaaggagagaggtatctcttgctggccgcgggatctcatctccttttgtcttgtttaggtttctcctctgcctcctacttaaaggtccatgttaaaacccaccacggtgttccccttccccaggtctccaggcaccaggagcccatcctgaatgggggagcagcgttccactgcgccaggacctatggcaacaaaggcaagcgaccccttgctctgcactttgcttctctgcgcagactgtgttgtgggggcgctgggctgggcgtggggaggcgggaaggctgccggctttctggctgccttgaggagactcagagatctgagtggcagtggcctccaggacaaaagtcacagtgggtatctcactccagggcagtgagtgaggctttagggcactgccgagatccagcctccgcctcctcttccccagccctcctcctttcctcctggccagcccccactgtctggagccctgcagggatgccccgggccctgggcagaagaagagccctgcatgatgagtcactatgggcctgtcactgcctgctgccctttaggatggtgtggagctgcggctgaatgctttctcctcttttgacccagtgggccggtgggagccaatgtctggcttctctcacagtaggagtggttggttactgtgagtggccctttctggagagcctctggctatggttgtgagatgcatggcaataatgagctatctgactcctctgacttgggagttggtttgcagaaagctccccaggcccaccttcacttgttgattcaggttgttttgtggtatgtcacgttgtcgttgccttggggatgaggccaggggcttggcagatggtagaaacagcagagatggcatgctccatgctcccatcacagacctcccttcccggcatggctctctggacccaggcaggaagctgctgattggtggaggactccagtgtgggccgggcaaggcagagcagccagggttgtctcttggcccagcttgtctggggcctagggtggggacacccagccgactgagtagtacagagttgctttcaatctctgtgcttgggctgcttggccctgaaaaggttttggcagaaggaaggcggtaaggacagggctatgtttgcagcattaggaaaaggattggcttctgtctgagccattgatggggtctacccaggttgaggacctaatggctctggttctgcctgtcttgctagggtgcagctagtctggtgcaggaggcgaggctactattacactggctcggcatcatcagaataccaattttaccctcagaggcacccaaaagagcgcctaggagttgggggtctttgagttgttctgggcagctgtagcagagttgccctctctgtatcccttccttgaagcaggctgagatgacggtgagcagtacatgtgcagctgcatgaagagtccacagcaagggaggctggcagccctagggccctgccgtttcacccctgtaggcactccaggctcccagactgaccagctgaccctccgtgggttctgccagggcagtggctggccaatggctgccctccacaggtctgtgagctggcccctcatgacccctccaggagggggcatctccagagcctggcctcatcgctctcctatattttgttttttcgtagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactcta

SEQ ID NO: 421 - DNA, 18965 bp, Homo sapiens
gcagacacgaagcctcccgggtggcttacagacgctgccagcatcgccgccgccaggtgagtgcccccgaccctgctgccgcccgctgctccgcccagctcgagcccggcggttagcgcccaggccgcggcccgggtgccgagcggctggaagtgtggggagccgtgcccaggttttaccgctccagcaagtcgctggcggggcgacgtctcgggactccggctccgaaacgtaccctctctgtccggggctccaggtccccgacgggcgatcgtgccaggcgcggcccctgcgggcctcagtctccgcgcctgtgcaatggggtggtccctctgcgtctcgccgcgacggctggacgccccatcgccgccgcacagtcctccagtgcggcttccgggcacccggctccgaactctggggtcgtgcggacccggccagaccgtagcgcggcaacgccagcccacggccgcggccgcacagccccggtgcccttaaaagagggaagatggcgtcgtgcccggtgccgccgggaccggctcccggaggcgctgcgcacctgaggaagggccgaggaaaggcttcgtaacgggacgcccagaaagtccggaacaggaacgtgcacacggagcggcgcgcagccgcccgccctcgcttgcccacgcgccctgcacaggtgcgccccagactgggcggggactagagcccggctggggcatgcgaccttgtttggtaaattggaggtgcgcccctgcgggtgacccgcgagggggccccccgcctgcggggcgcggtcacgacaaggcttgtggggttcggagctggtcgtcgtctgggctctggcctcctaaatgcgatcgctttcaagcccttcattgtcaattttgctagaatgagccactcgtggggtaggacgtggttgttgatgttactgttgtagctcttactattgtaacatttttgttgctgttttaacgcagtgtttactgtggtctgggagcccgagcttcccagggagcattggtgtcagcctcatgtccccgcattaggaggagcgcagtctggtgggcactagcgccgggaagttcttaacatctgtctgcccctgggagcaggaggcctcatcttccaggtggagaaacagagatttcagtcccaggaggcacagaaatgccagggttgtctagctagaagccaagggccctttatggaacccaagccaaaacctctttccactctccagccctgtggcctcggaagggccactccatctctctgaacctcagtttgttctgttcactctgcaaaatgtatccctgaggtttctggccaggtgaaagcccctctcaagttagtagcctccctggagttaagactcaccccgatttctacttaatttgggcacgcctttggaataagttctcaggaatggcacagtttgggtgttttttgtttctttttgtttttttttgaaacagagcttcgctcttgttgcccaggctggagtgcaatggcgccgtctcggctaactgcaacctcggcctcctgggttcaaacggttctcctgcctcagcctcctagtagctgggattacaggcgcctaccacgaggcccagctaattttttgtatttttagtagagatggggtttcaccatgttggccaagctagtctcgaactcctgacctcaggcgatccacccgcctcagcctcccaaagtgctgggattacaggtgtgacccaccccgcccggcttgagtgtttaaatactcctgcctcagcctcccaaggtgctgggattacagacgtgagcccctatgcctggccctttttttttttttaattgtcttaaggatgttaagactaagattctcacacatttgactcgtgcctgtaatcctagcactttgggaggctgaggcaggaggattgcttgagctcaggagactagactgggctagaccagactgggtaacatggtaaaaccctgtctctaccaaaaatacaaaaaattaaccgggcatggtggcatgtgcctctggtcctagctacgcaggaggctgagttcagaggcctacctgagcttggaggggttgaggctgcagtgaaccctgatcatgccactgcactctagcctgggagacagagtgagaccctgtctcaaaaaaaggagcattaggctgggcatggtggctcacatttgtaatcctagcactttgggaggccgagggagatggatcacctgaggtcaggagttgtgagacgagcctggccaacatggcaaaaccagtctcttttaaaaatgcaaaaattagccggtcgtggtggcgtgtgtctgtaatcccagctacttgggaggctgaggcaggagaactgcttgaatctgggaggcagaggttgcactgagcggagatcacaccatggcactccagcctgggccacatagggagactctctgtcaaaagaaaatttaaaaaagcatcaaatggtagatccccagtgtctgttacagcttgggtactctatggctggatagagaggctgcatacatgttagttattgtaagtttgtttgtttttttgagacggagtttcgctcttgttgcccaggctggagtgcaatggctgggaatacaggcgtgagccacctcacccggctcaagattcttacacatttgacttgcctgtaatcccagcactttgggaggctaaggcgggagaattgcttgaacccaggaggcggagattgcagtgagcagagatggtgccactgcactcagcctgggctaacgtgagactccatctcaaaaaaaaaaaaattacgtcttgtgtcacagagctgcagataaaccagagactactcataaccgtgtactttttttttcccccatttctgatcccgtctcaacggaaggatgtaattgaggaagggcttgattggccagtgagtcttgaagctgacaccactgctggtggtattttcccctctccctggaaagcatcctgtttttagtgaacctattaaatgtgtagacaattaatggctttttgcttcccctgctgcagacttagcggatcccatgagattttgactaccgtctgtgctcagaacagtttgagccgtatggaggaagtctccgcaccagtcttactgttggtggtcaccaggaagccagcagtgtgtctgaactggacacatgtggccacttcctagcctccctttgtcctgccactggttggttggggctgggccctgggagaaacatagaatgtgagcaaatcagtccgtggcccctaagttccttgttggccccgaggcaggcaggagaggggcgggcacacagggcagctgattttcctagtgtcaatattaggatgtgacaatacaaaacaccactgggcctcgccaggcactgcatggtaaacctgtttttctgggggtgggacagaacttggcacccagttagccaaactgaaaagccatgcagcaaagagagaaaagctcacttgtttatttgagtgagggtccctgtcattttggatatttaagatcaagtattcttgaccgccccctccccgagatggagtcttgctctgttgcccaggctggagtgcagtggtgtgatctcagctcactgcaacctctgcctcccgggttcaggtgattctcctgcctcagcctcccgagtagctgagattacaggcgcgtgccaccacaccaggctaatttttgtatttttaatagagatggggtttcaccacgttggccaggttggtcttgaactcctgaccttgtgatccgcccgcctcagcctcccaaagtgctgggattacaggtgcgagccaccgtgcctggccaagagatgacatttattgtgtgtgacagtatcttcgagattagaggctccctttcatgtgagggcaaagagagctacctgattccaggaggagctgaaattccctgtgcagacaatggcgcatcatgaagataaatccgagctcggaccgtgaggtggtcagcacgggtgtgcgcctcgcagagcaacaggctcacagaatgagagctgcctcttagtgggcacttactgcataccatgcatgcagcatttcacctccttctcagggctacatctgcccatggggctttccctcctgccctttaacagaaggtgatactgtccagtccagggtctcccagccaggaacagcctgccatcgtgagcccagcaccagagtaaccccttccctcattctcaggattttgcagtgaactctcaggctgtctgcatcctctcaccggctttcactgggtccctgctctgttctggggccatgcaggttcccgactggctggggcagacacacaggtaaacatttaacgagaccttgatgggctgagtgcccaatccaggtctgtttacccaaggtgctgggacaacacagatgaggagcatttaattctgtcctggggagggtggggaggaagtgacttgtgcctgagccccaaggaagcagtgagtcccccgtgcctgcctgggggatgttggtaacagagggaggatgtaaaggaggagctggggtgtgaaagggctgggtgcaagttcataggggagacccaaacactgaagtggagcccaggggccgtacctgcctctcaagcctcagggtcggggccagggtgagcagtcttcatattcttcagcctcagcatttcagaacttgttttattttttttttgagatggagccttactcctgtcgcgggggctggagtgcagtggcgcgatctcggctcactgcaacctccacctcctgggttcaagtgattctccttcctcagcctccctagtagctgggattacaggcgtgcgccaccacgcctggctagtttttgtatttttagtagagatgaggtttcgccatgttggccaggatggttgtgaactcctgacctcagttgatccacctgcctcaacctcccaaagtgctaggattataggtgtgagccaccgcgtctggcctattttttatttttgattgagtcttgctctgttgcccaggttagagtgcggtggcacgatcttggctcactgcaacctctgcctctcaggtttaagtgattctcctgccttagtctcccgagtagcttggactacaggtgcccgccaccacgcccggctaactttggtatttttagtagagacactgtttcaccatgttgaccggggggtcttgaactcctgaccttagttgatccatctgccttgacctcccaaagtgctgggattacaggagggagccaccgcgccccggcccagaacttgttttaaatatgaacttttgaaacttaacaactgtaggcccaggtggtggcttggcattctctgcttccttcatggtgataaaaaggcacaggcttcccctttttggggtcatttcaaaatcagtcaagagaattattagtctgttagacttcctctacggttaggattatttttataggtgttcgaacaggaaaggacatagaataaaatctcctcccctaacttattgatacagggtctcactctgtcgcccaggctggagtgcagtggcgcagtcacagctcactgcagcctcaacctcctgggctcaagtgatcctttcgccttgtgctcttaaagtgctgggagcctccaaaaggctaagctgtgacgttgggtaggttacatgtattaaatgcatttttttttttttgagacagttttgttcttgtcacccaggctggagtgtaatggcataatctcggctcactacaacctctgcctcccaggttcaagtgattctcctgcctcagcctcccgagtagctgggattacaggcgcccacccccacgcccggctaatttttgtatttttagtagagacagagtttcaccgtgttagccagaatggtttcgatctcctgacctcgtgatccgcccgcctcggcctcccaaagtgctgggattacaggcgtaagccaccgtgcccggcctggtgaaaccccgtctttactaaaaatacaaaattagccaggtgtggtggcgtgcacctgtagtcccaggtacttgggaagttgaggtggaaagatcacctgagcccagggaggtggagactacagtgagccatgttcatgccactgcactccagcctgggtgacagagagaccctgtctcaaaatagtaatactccatattgggcctctcacaggggaatcttggggggagctgcagctcagggtgactcccatcttgtcactagccaggtgaccccttcattctggagccttagctctgaaagccgcaggtgggggtgccgtttcagatgccccttttccatttcaaaggctctgattctagatcttgaagccggatgcggcactggcacttggcttcagtttccactgtgacggacggaggtctcccaggcccagcccaggcagccaagcccatcctggaatcagaacacgctgagcacattttgtagggtggcacctttttatccaagttactagctacacatcagtgtttaaagagaaaaaagtgagctgtcttttttttttcttgaaacttgaggaaacaaggtacatactacggatttttttttttctttttcttttttttttttgagacagtctcactctgtcgcccagaccggagtgtggtggcatgatctcggcttactgaaagctctgcctccagggttcaagccattctcctgcctcagcctcccgagtagctgggactacaggcgcccgccaccacgcccagctaattttttttgtatttttagtagagacagggtttcactgtgttagccaggatgctctccatctcctgaccttgtgatctgcacgcctcaacctcccaaagtgctgggattacaggcgtgagccaccgcgcccggcccatattttttttttttgagatggagtttttcgctcttgtcgcccaggttggagtgtaatggtgtgatctcggctcactgcaaactcctcctcccaggttcaagcgattctcctgcctcagccacccgagtagctggattacaggcgcgcaccaccacacctggctaattttttttgaaacggggtagagacggagttttattaccatgttagtcaggctggtcttgaactcctgacctcatgatctgcccaccttggcctcccaaagtgctgggattacaggtgtaagccaccgcggctggcccatttcatatatttttaaaattttttattgttaatttatttttagagagggggtctcgttgtattgcccaggctggtcttgaactgggctcgtgcgacgtgcccgcctcggcctcccgaagggctgtgatgacagcacagcggtgcctgtgatctatggcttcaatttttcaaggctgccaggtccatgcaggggtgtgtgtgggatgcatccctagaaatcaaaggtcatgtgcgtgtgtgactggtggatgctgatggtcacactaccctccagaaaggcagcaacatgttcagtccaccgtggcgtcctgagctgtgagtggcctctggtctcctctcttctaaggctgttgattgtgttaaccagcttttatggagcccctgctaggtggtggaaaatgggcagtagtgtatgttttcatcctctcagcagccctggaggcccggctgtttctgcaaggctcagaggtgagctggttgttctgcctcacacagcaggggccgagcagggggtggaactgaggtccagcctggctgcaggctcagggcgtttcctgctgggttacactggagttgtgtgcgctccaagggctttgtgccaccccaccctcatggtccagggccaggctgtgactgggagggtggcacgtggaagactggaccagggttttctagctgggcccactcagctggccctccctgtgaccccagcgtggcccctgaccctctcggtttgcctgcctgtgaaacaggaagtgtcagatcccgcctgcttggctttgacaggactgggcgaggtcatgagagtctgagggtccctaccaggagttcgacctcatcctcaggtccagccccatccacctctgcccccaaccccgctctgacactcctgcagcctcggccctcgaacacctgctgagggctgagcagaacacatctctacttgcttgtgcttctgggcaacctgggaggggcttgggaggtagatggcgtttccccatcttccagatgagccataggcgagctgtcgagtgcagagctgttcaccaaatgtaggctgctctgtccagaacctgccctccctcccactcggagccctgcaggtgccctcaaggccgtgggtgtggtactcttttctgcacatactagatttgcatcctaacctcttagggtaaaatagggcttctgactggcgcctggtgtttccactggtgagtgtgtaggaggctaagtgcgggctgtagcctgggtggggacacatggctaggtgtgtcttccttcaccaaagaagggtttcaactactcatttgcaagtttgctggaaaaaaaaagataataaaaaccagtccagtttcctgtatctgcagctgcagtgacctcacagtgggtcctctgggaataggttgccttcatgtcttcagtcaacaaacatatgtctgctctatgccaggccttgggctgacaaccagaaactgataagagcagcagcccctctcttagcggtttactctgtgccggatcatttcatccccacaacagtcctgtgcaataggtgttactagtatctccattctaattttttttttttctgatatggagtcttgccctgtagcccagcctggagtgcagtggtcagctggagccagaggggagcagagacaggggctgcaggacccccaggaggcccccaagcagactctgagggtccaagaaggtgatgcccgaataggccagcctcatacccatcctctcagtactttgggaggcccaggcgggagttgaagccaggagttccgagacaagcctgggcaacaaagcaagaccctatctctacagcaattctataaaaatgagccaagtgcagtggtacatacctgtcgagttaccctggaggctgaggtgggatgattacctgagcccaggagtttgaggctgtagtgagcatgatcaggccactgcactccagcctgggcaaacgggtgagaccctgtctgtgaaaaaaataataataaaatttaatttttaaaaaaggaccaataggcgtaggcatgggccggtctgaggttggctggtgagctctgcacatttgaagactttggaggcatggcaggaccaggcaccatccatggaaagcatacttgagtgtggttagcgcgggaaccaagattggggtggcagggccacagggggagggcctgttagtggatgtggcacaaccccccacttgtttttgagacaagtcttgctctgtcacccaggttggagtgcaatggcgcggtctcggctcactgcatattctgcctcctggattcaagtgattctcctgcctcagcctcccaagtagctgggattataggcgagcgccaccacacctggttaatttttgtatttttagtggagatggcgtttcaccatgttagccaggctagtctcaaactcctaagctcaggtgatccacctgcctccacctctcaaagtgctgggattacaggcgtgagccgcactgcaccaggccaggtctagggagccgaacagagcagtgacagggtcagggttgaggctgctaccttgagattaggttggagagagctccactgaaggctggagaccagtaaggcattcagagctggtgccaggtaggagctgacaggactgggcctcccttgggctggtggggtggccaggagagaccagagcaggaggtcgctgctgcaaggaccctcctgggcaggctccccaccttccgctccctggctccacacttttcccatgcagatctgggccctaaggccagcctaggcccagttggtgatgggatctttgccattcatatcaagtcaatctgagggcctgggcccagaggccagatggttaaaggttcagattaggtcccttctttgtggtagagggtaatgggtatttaataaattaatccaaagtgctgtaatcccagtactttgggaggctgaggcgggtggatcacttgagatcaggagttgagaccagcctggccaacatggtaaaaccccgactctactaaaaatacaaaaattagccgggtgtggtggcatgtgcctgtaatcccagctacctgggagtctgaggcaggagaatcacttgaacctgggaggcggaggttgcacctgagctgagatcacaccactgcactccagcctgggcaatagagtgagactgtctcaaaaacaaacaaacaaacaaacaaaaaaacactaccaccaacaaaaacacaatagatggggaaactgaggctggtgcaggaagggttgggctagggtatcaacctaaggtgagatgtggtcctgggtctactcagatggggaggttggcagggtggggagcttgaaagggtcttgcaggcagagcgtgggtgactgactcctcaggtaggcctgacctgcactctgctgcagaccctcggcagcgcagcccactctggtggctggggccttcttcctatctggcgcctaaggattctcggaatgcctgctgggtaagggggctgtgggcacagtgggtcaaggcgaggctcggtgcagctcacagctcagctcacagtgaggtgaggttccactgttgctctggctttgcggggcgtggaggtactggggtctccaggagcacaaagcaggagactgccttttcgaggggaagggaaaggggggaaaagcaaacaagggctggagctgctttcctagggaaatgccatttgcatagacacccaaggcagctggaagttctggacacagttcttctaatgccagcttaacacgcacactgctggccgtctatacaatgtaaaacatctcatctgtgaaaccttattttttctttttgagtcagaatctagctctgcctcccaggttcaagctgggattacaggcgtatgtcaccacgcctggctaattttgtatttttattagaggcggggttttaccatgttggccaggctggtctcaaactcctgacctcaggtgatccgcctgtctcagcctcccaaagtgctgggattacaggcgtgagccaccgcacccggcccatccatctcccttgaatgctgaaagcaagtcgtgagcacacacttgtgcctaggcctgtgggagggcggcgctgtgggtcctgcctgccgtcagttttctctctcctgggggtcagggagacttggagctctgtcccttcttggcttagtcatgaacctctctaagcctcagtgtcctgtgtgaacaaacagctcagtgagatggtgggagggcggagtgtcctgtcagcaggcatgaggaattaaaaattaagaacacccagggcattatggtaagaaaataatgagttgaagcataaaggtaatggttagtgccaacttcctcccagcgtgccaggccctgttcaaagtacatgaaggagttccttatttcgtcttcccaatagcccagggcggggctctcagaccatgaaacccatttcacagatgaagaaattgacacactgctgctaactgccagagccgggctttgaactaggccattagatttccgtgccacagtcatcgtcattatcgtcatctacatctaaggctgtttggtaccctgtagggtaaatgtggggtacatgatggtgaatcaggtcgcagaacccttctctgccatcatgatgaaacatgtactggcatgggattcgcaatgatcatagttaggaaggcctttggtggcaaagaagaggaaactcagtgaatggtgatgaggacacatttgggttcatttttcttacacacagttggaggagacagctcagtgacaccctcaggcctggccgctctctgcctccccactctgctcttcttggtcagccactgcagctccatctttgaaggagctgccctggctgtgtctactccctggcatccaacccctgcctccagcctctgagccctcattgaccagaactgggttacatggttgtcaccagctgcaagggatgctgggaagctgagggagaggagggccatggttggcttagatgaatgaggatgcagggccaccccgaagaaaattggggttctatcagcaaggagccaggtggaatggatatcggagaggtaaatagcatctgccagtaaagaaggctgtaagacactgtatggggtgatcccatttgtgaagaaggatgtgtgatgcgcacaagtgtttaggaaaaacactagaagaattagcgatggtctctctgggaatggggattgtgatacgtttttctcatgctgcctctctgcctttcttctcaagagaaacagcagacaccaaagaacaggtgtagccttctgttaagtggtacagaggaatcgccctgcagcctggcctctgtcccctgtgctgacagcaggtgcctgggttttctgctttgacaggttcttgagggctggtgtccgaggagaacttctaatatttatttatactctgattttgtttcacaaagaagaaaaaggctgggcgtggtggctcatgtctgtcgtcccagcactttgggaggccgaggtggggtggatcactttgaggtcaggagttcaagaccagcctggccaacatgatgaaacccccgtctttactaaaaatacaaaataattagccaggcatagctcatgcctgtagtcccagctactcgggaggctgaggcaggagaattgcttgaacccaggaggcagaggttgcagtgagccaagattgtgccactgccctccagcctccagcaagactcagtatccaaaaacaaagaaagaaagaaagggcccttatgaatcatcttcaagttcctcccttccaagaacagagatgctaggcgacttgcccagaggcacacagccagcatgtagcaggattcatgcctgtgggagctggggttgggggatattgacggctttagcggatcaaaagagctggtgagtagggctatacaatctgggggtcatcctgtgagagagcccccagactgctcagttcttaggggtccagtcatatgctgtctttttgccccagaggagaaatgtctgaagtaagacccctctccagagacatcttgatggagaccctcctgtatgagcagctcctggaacccccgaccatggaggttcttggcatgactgactctgaagaggacctggaccctatggaggacttcgattctttggaatgcatggagggcaggtaggtccccatggcctgccctaccccctgcctgatagtgacttcaggggtgggctggatgagcagacattctatgagcgggggagcgcctgcagatgcctcccaggcagggcctccgagaggaagatttcccggatgtgggcatggaggcttctgccctgggagcggcttcactttgctgccccaccctcccctgataccagctcacagacccctggacagccagcatgttcacagtctcaagatggacctggggcccctggctgtcaaaatggcacagtgtttgggcctcagggagctagacaggcccttagcgacctgctgaggacatcagggcctcttgaaggaggtgactctgttgccagaaaggggacccgatccagatcccaagagagggttcttagatctcaagcaagaaagaatttgggccacacgcagtggctcgcgcctgtaatcccagcacttagggaggctgaggcaggcggatcacttgaggtcaggagctcgagaccagcctggccaacatggcaaaaccctgtctctactaaaaatacaaaaagtagctgggcctggtggcacatgtctgtagtcccagctagtcgggaggctgaggcaggagaatctcttgaacccaggaggcagaggttgcagtgacccaaggttgcaaaaatgcactccagcctgggcaacagagcgagactccatctcaaaaaaagaaaacctactctataggcagagcagcggcatgggctgctcaactgaatatacttatagttatttcctgattacatgctaaacaaggggtggattattcatgagtttccgggtaaggggtgggcagttcccggaaccgagaattcctcctccttttagacaatatagggcaacttcctgacgttgccgtggcatttgtaaactgtcgtggcactggtgagtgactccaacatgctaatatagttggtgcacaatgaatagtgaggatgactggaggtcacttttgtgcccatcttggctttggtgggctttggctggcgtctttgccgaatcctgttttatcagcagggtctttgtaacctgtatcttatgctgatgtcctatctcatcctgtgacttagaattcctagcctcctgggaatgcaacccagtaggtctcagccttttgttacccagcccctaatcaagatggagtcgctctggttcaactgcctctgacggctctcattttagaaaaccagaaccgggccgggcgccgtggctcatgcctgtaatcccagcactttgggaggctgaggtgggcggatcacctgaggttgggagttcgagactagcctggccaacatggtgaaacccaacctctactaaaaatacaaatgttacccaggtatggggccgggggtggggggatgggcgctggtagtcccagctactcaggaggctgaggcaggaaaatcacttgaacccgggacgtggaggttgcagtgagccctgagattgcaccactgcactccagcctgggtaacagagtaagactccgtttcacaaaaaaagagaaagagaaaagaaagaaagaaaaaagaaagaaaaccagaacctatggaagagcctgaggaggccatgcagttcctggtcccggcttcaaagaatcactgaggcatgaagaagggatcttccttggactgacaaggaccctggaggcagcaggatttgcctggggtttcaggggccaaggtccagtaggacctgacccttgcactctgccaactgctcccagctatgtccagcacacggcagcatacccagatgtccaggcacacccggccatcccagcggcaggaaggacctgcactttttttttttttttttgagacagagtctctgtcacccaggctggagtgcagtggcatgatcttggctcactgcaacctccacctcccgggttcaagtgattttcctgcctcagcctcctgagtagctgggagtgcaggcgtgcaccagcatgcccggctttttttttttttttgagacggagtctcgctgtgtcgcccaggctggagtacagtggcatgatctctgctcaccacaagctccacctccctggtttacgccattctcctgcctcagcctcctgagtagctgggactacaggcgcctgccaccacacctggctaattttttgtattttcagtagagacagggtttcatcatgttagccaggatggtctcgatctcctgacctcgtgatctgcctgcctcggcctcccaaaaagtgctgggattacaggcgtgagccaccacacccggccaggactggcactttcattcttcccctggtacagatgaggaacgtgaaggcccaggagcagctgacctcagtagtttctaccctgagcctggaagagaatggtcaggcctgacctgggctgttgctttctgctggggaatcctgtctctgatgtggcacctcccacaggccagggaccagctccatgttccacaggattcttttctgctcaggattttttttttcagcctcaggatttttagtcattaaggattttagaactggaggcacctgtccattaatggacaaggttggaggacatgaagcctggggcagtattttcctgaggtttcccagggtaacagaaggtaggaccacagcccccaaccctgattgccagcccacacctgtacccctcccacccgcatcccctccaagtagggagtgtaggcccagggcattggcaggtcaggtgggtggggccagggcccagggccggcctcagctcagggcccctaggagtcccacttccctgggagttcccccggtgtagtcactgggatggaatgcacacaggtccctggtagaggcccagaccagcaagctgggagggtggggagtgtcttagtctttgtgtgggagtgaatgcgggtggggtgtaggatcaaggatgtggtttagtggggggcctactaggggcttcttagtccccccatttggagaggggtggtgccagcagggctggtttcaggattgggaccaggacacaggtcttagagccccctcacctcccacaaaggaaggtaagctgcaacccctgtgggaagggggctcaagggggctcagccatccgggggactcagcaccaccagacctgtccattccccttggtcagcctcagccatccgggggctcagcacccccagacctgcctgttccccttgtccaccatttccaccaaagcccacaggtgggcctgccccaggattctttttgaaatagcttgcacctctggggccacccacggatgggacctcatgggtatctctgaatccaagtgggagccggaggagggatacagggaggcccactcactgcctgccccaaatctgacaccatctcttatcctctgggccactcccagctgcacacaatccgttggctgggtgggtccaggtgcatgtggcctccacggcacagccacacccgactcctgtgtgtgctccctgcagtgacgcattggccctgcggctggcctgcatcggggacgagatggacgtgagcctcagggccccgcgcctggcccagctctccgaggtggccatgcacaggtagccggcctatgccctatgcctctacacctggggaggggccctgggcggtgggtggaggccctgaacacagcacagggctgggccctgaggaagctctgtgggggatgtgccttgacactggggctatactgaaacccttggctgcttcccgcacctctcctgggagcccccagctcctggcactcgccccctgccacctgtccctggcattcctgggcaacaaagcagagcccagggcccttttctctctcgccgtcctcattgagcccagatggtacatttccaccgtggtcttaagagggggtgctacgtgagctcggatcctagatcctgggggctgggcctctcagcgagtctccggtgggggaatagagtgggcagtggcttgtgagggccctgtagaatgggggtttattttccacgtggccagctctggaagacagggccaaacacccggtgggctggcgggcggctggctggcggaggaagcaggaagttggaatgaatttgaccacaaacagtccataccacgcggcccctgcaggtggaggcgcccacggaaagggccccgggtggctgtggggtgggagggcacaggcccctgctccccacagctgtgatggtgtcatctaagtacaggctgcccctacctgctcctgcagtaatggctttgtccccccatcctctttgtctatagcctgggtctggctttcatctacgaccagactgaggacatcagggatgttcttagaagtttcatggacggtttcaccacacttaaggagaacataatgaggttctggagatccccgaaccccgggtcctgggtaagagccttgagatccctgaccctgacttgcgctgcggccagtgggggctgtcagagccgctccttggggcgccacagtccccaccactccgtatcatcatctgtgtcacctgtgtccacatctgcctgatcccatgggcttttgggtttgagatgcctggttctgagtgcacaaaccagtgcatggtcctgggtctccctctggtccgagagccttcacctggcaggcaggactcccgtctcctggccagggcaggggcctccctgagcagccttcctggtagcctggtcccatggtgtccactcggcaccgcccaccacaagggcagctgactgccctcacctgtgcccaccgggtgtctttgcctgtgtcccgcagactggcaggcccaggccacgctggcctctctggccacgtcctcagggccactttccccctctcctgaactccttccttctctggtcccctcgagctccttcccagtccccaccctcctgggcttccccttggcactccgctgtcacccgtctggccccattgccggggcctgccccgagcctgactcctctgctttgctcccacaggtgtcctgcgaacaggtgctgctggcgctgctgctgctgctggcgctgctgctgccgctgctcagcgggggcctgcacctgctgctcaagtgaggccccggcggctcagggcggggctggccccacccccatgaccactgccctggaggtggcggcctgctgctgttatctttttaactgttttctcatgatgcctttttatatttaaaccccgagatagtgctggaacactgctgaggttttatactcaggttttttgttttttttttattccagttttcgttttttctaaaagatgaattcctatggctctgcaattgtcaccggttaactgtggcctgtgcccaggaagagccattcactcctgcccctgcccacacggcaggtagcagggggagtgctggtcacacccctgtgtgatatgtgatgccctcggcaaagaatctactggaatagattccgaggagcaggagtgctcaataaaatgttggtttccagca

SEQ ID NO: 422 - DNA, 6844 bp, Homo sapiens
tgacttttgggagagctgaccttttgtgacttttgggagagctgccaaaagtgaaacttagtgcctcagacaagcaggggcaagtctgctaaggaagctgtggccagaagcacagatcaggtactgccgcccactctgtccactgggccctctgctgccacttcctgcctggcagcccttctgtgcctcagccctggcctcccgctgccccagccccagccctgggctccttctcctctggctcccctgccatccccactcccacccaggctctttgccctgctgtgtggtcaccccactgctgcttctgaacgggccgcctccccggcctgcaccagcccaagacccctgctgagactctcccctaagagtcatggctgggctagtgctccccaccttgggagggtgctctctctgtgtgcttcctgccattcctgggctctggaactgggagaactgaactaaaggatgatgggagcaatctggaattttgttcacagtgctttgatgaactttgtgtaagattactttgtttcaatacaaagtcttaggagagggtgtggggaggcaatgatctctgaagcacaaggcaaatcatctcttccaaggatgtctccactgtgggcagaggaggatgcagatgaccctgaacacacactcctcctccatgatcagtattcacattcaccgtttataatgacaccagtaacacggaatatacggaaaaactcaatgatcaggagaaatgcttttattttaaaatttaggaagaagagagcctggttcccaaaggctccctcctgcagggcccgtgatgcagaggctggcagggctggccaggaaagtggcccagctccatggcctgggcaggttaccccacctctctgcacctctggcccctcctctgtaagatgagaatggcccctgcaggcctagggcagcctcacgtgagctcagatcctctcagcacttagaagagtggcctgggcctggggatggaagtgctaccctgattttttgtttcgttttgtttttttgagaaggggtgtctcagtctgttgcccaggctggagcgcaatctcggctcactacaagctccacctcctgggttcacgccattttcctgcctggccaggcaaaatggctcatgcctgtaatcccaacactttgggaagctgagaggggaggatcatcactaaaggccaggagttccaaaccagcctgggcaacacagggagacccccttatctactaaaactaaaaaaataaaataaaataacatgaataggtaaaatgccaggaattaattgaactgaaatattaagagctcttattttgaaggggagaattttattcacttttcttatttttaatgggttagaggatgggtggcagaaatactgggaggatgggagatccatccctggaaagaccagagctagggccctgagctgggagaggtcaccccggccctgctgcccctgccagcatctccttctcttctcctctccctggtcttcctgcttgggaaagctgcagaaattctcaggacttggaggcttgaaatgctcaggggttttccagaaagcagaatagaaagtagatgggcaaccatcaatcagacaggccaaagaaaaggagctcaggccctcggggagacaggaggtgagcgcatgggtcacaatcctggcggggcgcggtggctcacgcctataatcccagcactttgggaggccgaggtgggtggatcacctgaggtcaaaggagttcaagaccagcctggccaacatggtaaaactccatctctacaaaaatacaaaaattagccgggcatgaaggagggcgcttgtaattccagctacttgggaggctgaggcaggagaattgcttgaacccgggagaatcacttgaacctggtaggtggagcttgcagtgagctgagattggaccactgcactccagcctgggcaacagagcaagactctctctcaaaaacaaaaaaaaagcaaaatccaaaattgaatcctctgtagaatgtaatcacaattcaggagagcaaaatctatgtaatttcttcagccaaaaatgtgtcacaacactcccttggtgacaacagcttttctgttcactcaactgtgttctgtgcagacaaacttgtcaaacacacacctgagcaaagagcacagtgctggaggaagccccagtttccaccccatcactccccaaggggaagggttctggtattggacatgtaggggtcgagaggcctgtggacctcaaggagggggtgtccaactgcagctggaaagagggatctgggactcaggccagaggcgtgtgagcagctcagagcagctctgagcccaggggagccagaaaggcacacccacagttctcaggcaggggatccccacccaacccaggaagaatagtgacgaggtcggggcatccccatgcaaagagcctcagctgtgggcagcagccggtgccctcccaggtgggaggatgggagatagcagacaaggtgggagggagcactcccctcctcctgtcctcctgccagcccttccttcccctgctccactgcagtcctcctggccaacaactaaaggggagaccctccctcaccaaggggaagggcccaaatgaacagaaagggttgggtttggctgggcgcaggggctcacacctgtaatcccaacactttgggagaccaaggtgggtggatcacctgagatcaggagttcgagaccagcctggccaacatggtgaaaccccgtctgtactaaaaatacaaaaattagccaggcgtggtggcaggcatctgtaatcccagctacttgggaggctgaggcaggagaatcgcttgaacttggaaggcggaggttgcagtgagccaagatcgggccactgcactccagcctgggcgacagagcgagactctgtctcaaaaaacaaaaaagagttgggtttgaaaagtggcttgagcctggggtgactcaagaggacgctcccttcatctttggttttcccctttctgttgcacagaaacacgatggctctgttaacagccgaaacattccgcttacagtttaacaacaagcgccgcctcagaaggccttactacccgaggaaggccctcttgtgttaccagctgacgccgcagaatggctccacgcccacgagaggctactttgaaaacaaggtgccacacgggctctctgggcacagggccggcaggggctaaccccatctgatgtgtgcagaaaatacatgaaatgcctgcctataaatttctcaatttttgatgtaacaccctctgtgttttcgtaacccttggtgcctgcctgggttttggcttagctggatctgagtggcccagtttccctaggacactcccattctttcccgtccccggacctctgaagaggccaacccttctgtagaatgctccttctgcccctctcatttactcattctcccgatctcagctcagtcactacttcgggaaagccgaggtgccgtgccacggtccgagtgcaactccatcacacccctgtcctctccgctctattgccagcccctacctgccctgcctccccgcctccccgccccccgccccggctctcacctgctctttaggatcatcccgggttggacacagcctcctaggcgggtgtccaaaggcagggtccacagagcttcgggactggggcgtggaggtgttgtctcctcctctggacacagggatctttgtccaatttacagaaagatgtggaagtcctgggacagatgaattaacacacgggtgcgtgagtgcagggctgtataaaccagggaaggcaggaagcgggtgcttgccctgcactaggccaggccacgcactagaaagttcaccggacagacccctctgcccccccatccccgcccccgtcccggcccccgcccccagtcacatgactcctggcctctctcttctcccctcccttctctctgtttgggaccctccccagaaaaagtgccatgcagaaatttgctttattaacgagatcaagtccatgggactggacgaaacgcagtgctaccaagtcacctgttacctcacgtggagcccctgctcctcctgtgcctgggagctggttgacttcatcaaggctcacgaccatctgaacctgggcatcttcgcctcccgcctgtactaccactggtgcaagccccagcagaaggggctgcggcttctgtgtggatcccaggtcccggtggaggtcatgggcttcccaagtaggaaagaggctttgcagttataagagtgcaaacccccgggggcacaggcttggcaggggctgggggttgggggttgggggttggaggaggttggcggggggcgggggcgggttggaggaggttggcggggggtgggggcgggttggaggaggttggcggggggcgggggcgggttggaggaggttggcagggggtgggggggtggcggggagcggggggtctgtgggaggccaggaaggaaggattgtggctcagtcaaggcccaagatctgacaccacccgggagggagaattccccagacagagcaatgtccagggagaggaagagaagagaggggaaaggaagcaagagctcctggcactgcagctgctgcccctggggcctggctggtttccctcttccctctcagagtttgctgactgctgggaaaactttgtggaccacgagaaaccgctttccttcaacccctataagatgttagaggagctagataaaaacagtcgagccataaagcgacggcttgagaggataaaggtgaggcactgtcctgcctgctgcccccgacctcctcaccgcctgccgcagccccatacccagtcacacctctgcccactgcccttacccctacctttttttcttttcttttcttttcttttttgagacagggtctcactctgtcacccaggcaggagggcagtggtgtgatctcggctcagtgcaacctctgcctcccgggttcaagtgattctcctgcctcagcctcccgagtagctgggagtacaggcactcgccaccatgcccagctaatttttgcatttttagtagagatggggtttcaccatgttgcccaggctggtcttagaactcttggcctcaagtgacctgccttccttggcctcccaaagtgctgggattacaggtgtgagccaccgtgccccgccccactacctgtttcttttttgtgttctcctctcgcaccaggggctccttcttgttcttttagattccaggggtacgtgcgcagggtcgttacatggatatattgtgtgatgctgaggtctgagtcacccaatctactggaacatagcacccaataggtagtttttcaaccctggcccccctcccaccctctcttcttttggagtctccagcgtctattatttacatctttatgtccatgtgtacctctcaccatatacaaaaattaactcggccaggcacagtggctcacgcctgtagtcccagcactgggaggccgaggcaggtgtatcaagaggtcaggagttcgagactagcctggccaacatggtgaaaccctgtttctgcacctataatcccagctactcaggaggctgaggcgggagaattgcttgaacccaggaggtgggaggttgcagtgagccgagatcatgccactgcactccagcctgggcaacaaagcaagactctgtcccaaaaaaaaaaaaaaaaaaaaaaaaaaaaattaactcaacatgtgctgagcatgaggactcatgcctgtaatcccagcacttcaggaggccaaggcgggtggatcacttgagcccaggagttcaaagaccagcctgggcaacatggcaaatccccatctctacaaaaaatacaaaaatcagccaggcatggtggcatgtgcccgtggtcccagccattcgggagggtgaatgggagattgcatgagttcagggaggtgaaggctgtagtgagctgagatcgtgccactgcactccagcctgggcaacagagtgaggctttgcttaaaaaaataataataacccaagatgaattaaagacttaaatgtaagacctcaaactataaaaatcttagaagaaaacccgggaaatatgaaatactctactggacactggtctatgcaaagaatttatgattaaattctgaaaagcagatgcaaccaaaacagaaattgacaattgggatctaattaaatggagcacagcaaaagaaactatcaacagagtaaacagacaatctcccttttctaagatgctcttgtcacctccgtgtttttctccaggccttctgggcccttctggtgccagttcttttctcttcctaatgatctcatcctcacctctccctcccttcctccctgtggtgtcccaccagttggtacctcctaacttctctctttccctctcagcagtcctgaagtgtggatgttttagagaatgacttaagaagtttgcagcttggacccgtatcccactcattatcaagaagcaactcaagatgactttccctggggcatgtcagttgcctcatagcctgctggtcctgtaagcaagcactaagctccacagtgccagttccttgccccaacctggccccatccaagtacagaagaccttcctttcctcctttttccatattgctttctgttctaagtgggtgaataattttataattgaaaaaataaagataaagtctgtaaatccagccgggtacggtggctcacgcctgtaatcctagcactttgggaggctgagatgctcggccaataaatttctattgtttatgaa

SEQ ID NO: 423 - DNA, 32508 bp, Homo sapiens
cttgcgcgcgctcgctcgctggcgccgaggaaaacgttgcgcaggttcaaaaatggaacgtcggcggcgtgagggagcgcgagggggtgtgcgcgcgtgcgcgtgcgcgtgcgcgcccggacgagggtgacggggaccccgccagccccagcatcgcgcgccgcagccgcggccccgcagctccgcccccggcccggcccggccccgggcccgctcgcccgccgccccgcatggagctgtcagccatcggcgagcaggtgttcgccgtggagagcatccggaagaagcgcgtgcggaaggtgaggctgcccgggggcggctcccaggaccccagtggggtccctcccgtccccagcaccgctccctccacgctggggctgaaggggaaagcggggcgcgggggccccggcagccctgcgctgctgggcccgtctccccagcccgtgcctcagtttccctgccaccgtgtagggcgagtagaacaaaagttgtcgctccaggatgctagtggcggccgagcctgcctgagctggagattaggatcggacgtagggatcctcagcgccatcccacctcgctccccttttattgtaaatatggggagactgaggcccaagttgaaaggacttgcctagcgcgttatggtcagagctgggttttgaactcgggactctggacgcttggcaccaaatcctttcaagttgtaagtggagctttggaaaagtctcctccggcctctgaagtttttcctgctggactttggccttttccgatcctgccccctctacgccacccgagcacatccctattccccgcccccacccccacctcaactcctagcccaggccagggctctgaagcccgccccctgcgctggggcatcccctagtctcctaccccatctgccttcttcaaaacatacaccctgcaatttaaggaggtgtctgttctgctggtttcagaaccccacactttggggctagactttgtccgggcctggcgtctacacctcccgtgcacttgtttggcgagggggctcgcctaaggctggggaaatccttggggagaagttcctttcctggtacgcactactgtccttcctttgtctcctcctccctgcagccctttgggaggctccaggccgactgggaggggccttagggggtcacctcctcccatttaacagagacaaaaactgaggcccaggcagaggaagtgacctgctcaaggtcaccgagcaagttagatagggaggtagagcaggagctcaactgggctgattggcagcccatcttctttctccatagagaaaactcagtcctggcatctcgggccaagggtgaaggtcaaggtggtcaggagcatcttttcttcctccagctgtgcttggggttttactcttctgattgaggcagctgttcctcctccttctcctttttcctagggttttctccacttaaaagagaattgatttattccacaaagctcagtgcttttcgtgctgtgtagcctgaagcaggcacagcactaactccctctacgatggagcccgcagggtagcacaagagggcgagatcatcattccttcggccagtcactcaaaatatttattgagggttggtcaggtaccaggcaccagtctaagccccagggatccaccccttccctcagggagctggcattctgcagaggcggcacacagtgaatgaggagatacagacagatgccttcagatggagctgtgtgctctgcagaaatagaactgcaaggtgccagtggagacagcatgggagagggtcaccagggaaagcctctgtgaggaggtatcatattttggtcttaaagttctggcgtgcaggggcttcactcacaatggggttggactgtaaacttttttttttcttggcaccaagatctcactctgtcacccaggctgcagtgcaggggcatgaacatggctcactgcagcctcaacctccccggctcaaacgatcctcctgcctcagcctcctgtgtagctgggaccacagacaagtgccaccatgcccaactaatttccttttttcagagacaggggtctcaccgtgttgcccaggcttgtctcaaactccttcctgggctcaagcgatcttccagcctcagccttccaaagtgttgggatgacaggcttgagccaccgtaactgtaaacttttaaagcctgtgaggaagggaggggcctggctctactttctaacaaccacagggctgaccaccccttctgaaggtggagactttgccagtcttccatggggtcctgccagggtcttttgagttgagagtcctcaagtcactggcccattacctctgagccagaggcagccactcacagactgaaaggggactcagcagatgggggaggagcgtggggactaccccagagaggaatgttttcgtatttggagactcttccaatctaaaaaagaaagtaagcgttcccacctgtgcactggggctctagacactgtgggtctttggccacgcatgcacacctccatgcagtctcagctcccagtgtgtgacatgagccctgggcttgggcctcaggagcctcagaggtggctggagccagacgcactcctgtgctgtcctagggagggcagtatggggcgggcatgcagcagtcgcggttatatgggttggcgaggatctggtggacagtccccggattgtgtttgtgtgttggggagacacctgtctgcagatgggatttggagctgggctcctttgggccttaactgtccttccgagtggctgtaggggcaaccacgagactcactgtgtctgcttctctctcttctcagggtaaagtcgagtatctggtgaagtggaaaggatggcccccaaagtaagctccttcatgtgtgtgtgtctgtctgtctgcctaccgacccatgcattcctccacctgccttttgccccctcccctgcctagcttttagctccagctactcttgtaactggacagctgaccttgatttaatcatcatcttctctgggcctcagtttccccctggaccacaggagggtcaaggtgggtctccagcttctcttctcaccctgccctcctgagtgttgagctcctctgctagttggagcttctgctctccctcctcccctccctgtggcttttcttggcaactgggaggtgaaggcccagcatccgggctactggagatggctgctggacaggaggaggggaccccagctgctttaagcacagtgctgcatgagtcctcagtgctgtgtggccaggggcagagcctgaatccccctcacctctagacggcactttccagtctatagagcaggttcccatacagctttgtaaggtaggtgtgatcaggcgctctcaaggtgaggaaacaggctcagagagggtaagcagcttgccttaggtcacacagcaagtggaggcagagttgggacttgaactaggccttctccttttcaggtgtctcctctgtgccttcccagcctcccatctcggagttgggaggcagggagctgtatctgagacctcccagcttctccacctctcctgctgaggccccatcaggaacccaccaatgccctccagcagggagttgttgggagggaatgagctagtcgtggggcctccccattggtctgtgggtgccccaccccctgccccgcctcccggagactgagtcctggaaaccccctctgcccagagctgctgctgtcgggcagggactttttgctgtgctggtgggggctgacctggtatggggtcctgtgggcattctggggtgatggtggggagagacagcagagaggaagacagcccacagtgcctcagcttccctctctgcaaaatgggttcagaaacccaggccctgcactcatctcacaggcttggtggccctatcggatgaaaggcctgggcacatgttctgggtgacctgtggatatcctgatgacaggggttgggagctggcaggccgagaatacactccacccctcacaccaacccccacttcagttctcccttcccgaatattctgagggctgaaggagaatccctcccccgccacacccagctgctagaaggtgggcttccagcctgagtgaagggggcagtaaagggagtgacgatgcccagagtgggcagcaggagcaccgcctccctgggcgcgcacacccctgcctctctcgcttcgcaccaggaagctgtggccaccagctgttagccttcaggacactattggctatttttcctcctctggagactccactctttggaagattctcttctgtaaacagaggccgttatgaatgaaaagttccttcccccactttgattgatcctggatgtgaatccatctgcccactgcagctcgtcaggagggaaggaacgaggctcccagagcagaggccctcgatgcttctgttgcgctgtgcccctagcctggggacccatttgtttcttaacatgctgaggccaccagatgggccctcatggctgcctcttctcacccccctccactttggtcctgggttctaggcctggctgcccacccgacaggcatgagccctgggacagggccccaccatggctgggtctctgcttcctcatcttcgagttgagatggtgaagcctcctttgcaggctactgtgagggtgagagggtggatgtaattgagcgaatgcatgttcagcccagtccaagtgctttagtaaacatttggttttaagattaagttagatagatagcctagctgttctttttgttttccccagtcaggaaagggacctaagggattccattcttctcaggagtgcaaagtatccttagaaatcatttaggccagtcctctgatttttcagatggggaaactgaggcccagagagggttggtccttaaaaaaatataactgccaaccccatgcactgtggtgcccacttcatgccatccacagtgccaccacggtctgggagtgaggcaggtatggctgctaaccatccccacctcacttgggggaaacagaggttcactctgggggagaagcaggggagccagctctgtcttcccctcctcgggggccctgcttggagaaaaagctgagaaagagggtggggggtggggagttaggcaggctgtgtcctccaggcctgggagccttggctgggcagtgccggcctgggtggggtagtgattctcctgctcagcatctgccctgtaggtggggagacttacattcttctcagtaacagtaacaggaaccatgatttaaatggacactctaggatgggcatggtggttcatgcccgtaatcccagcattttgggagactgaggtgggcggatcacttgaggtcaggagttccagaccagcctggccaacatggcaaaaaccccgtctctaccaaaagcataaaaaattagccaggcatggtgatgtgcgcctgtaatcccagctacttgggaggctgagacaggagaatcgtgccactgcactccagcctgggcaacacagtgagacgccgtcccccacaaaaaaaaaaaaaaaaaaaaaaaaaaaaaaagtggacactttgtgccaggcctaggctaaaccactacatgccttgcctgttttatctccccagcaaacaagtgtggcagaggggctctcttgcttcttctggaaagcacagcaaatggcacagggaggggctcggggcccgggacagggaatgtgacattatcaggtacaggtgccagctgtgcctgaggcctccagataacatttcagcctgtccagggccctgctgttcccccttccagaatgacttcctctcttccccacttgtgaatggttctccatcgttttggaaggagtggccctatggagttttaggaatgatgtcagtggtcacagccatggccaggctgtcaataagcccctattatgaatcaggcattgactctttgaaccactcatagcaacccattttacagatggagagacagaagcctacagcaaatgaggccttgcccagggtcatagagctgggcagatgtgaactacgggctgcctgatacacaggcaactccactagagatgactaggactcttgcctgctggccttttggccagttcagtgagaagtgctgaggctttccacctctgaaggtttacagctgtgtgacccagggcaaagccctcaacctctctgtgcctcactttccccacctataaaaatgaggccctaacctcacagggccctgctgaagattgcctgagacaagacaagattcattaacaccctgccaggggcagagtgggagctgtctccacccaggctggggagactggagttaggagccgcagacttttacgctccctgggcttttcattgatttaactcaggcttatttgccttcactgtgtaccacactgatcgaaatgctttccgtggcttaacacatctaatcttcactacagccctatacgactggggttactggtgggcccactttaggatgaggccccagagcggtggcgtctcctgaacgaggccgcaccccgcagtctggaccagagcccgtgctgtgtcttctgtgcagcagctttaaatcggagtggggactggggcttgggggttggcctggctctgcggggttccgggtggttccacctgccccaaggccgcctgcgtcacagctcagcagcgcctccaaaccccgcttcccccgaccccccgggaaaggccggcgggggtcctgcacccgctgcgccccttcccactgcgtgccctcaccgcagcagggcgagccctgcgcggcggggctttggctgggcggccggggcttgtttacccggccgtggggcggggcggggaggtcacgtggccgtgtttatctcggagccggcgcgcgccgtccctgtccccgcccccgcccccgccccctcggtttgccggtaatcccggcgcgcgcccctccccgtgcgtgcgtgcgcgcggccggcgggggcggggcctggcgctccgccccctcccacggggtgatcggttcccgccccgccggcgccgcgagcccagtgcagacccccgcagtcccccggtgtccacgccgcggtccgcgcagcccaggcaacgagcgtgtccccagagccctggctcctttccactctccctcccctggtgtgggaagggtgtcctgggacttgcgggagcccgctttcctccaggcacccgagggtctccgatggtcgtggggtctaatcccttcgatccgcggcgcccacgctagtggcgcgctcctgggttgccagcgcccggctcttcggaagcgcgttccccttggcgcctctgggctcctgcactgcggagggcgcggcgcggtgcggcgcggcgtcctccttaccggctgggtccaaacaattaagatgctggtgccgcccctgccccccacttggggctgcactcggcagccaagtgcgaccctgttatctcagacccagctgcccgggccggcaaccaccccttctgcatccagccgagcctttcggggcgctcactgtgcgccgcgccctgcggtcggacactgaggactggagagggggcgacgccccctcccgcgggctgcacagtcgggggtcccagacgcggtggcctgggaggagcctgaaggcggagtgtggccgagagccaacacgggccggccactgactggctcagtgacgctgggctggctgcccaacctccgtgtctcagtttctccatctgtaaaatgggggtaagaactaagcacctacctcgccagcgccttttgaggatgggtgcggtcctggcggtcccggccgcacacctgctgttactgtagtggtcattattcttgagatgaggaaactgaagttcagagaagggttgggacctgccaggatccacacagcagggacatcagcaagcaatgggcagggcggtgtggaggagcacgctgtggagagaggagcacgaaattccccttcctaccagttagagtgaggagattcagccttttccggggggaggaagggttagagtgtctgccagcctctcgtggcttctgctgtagtttcgctttcggcattctgcaggggctccccagcccttcccagagccccgggcgggcctgagcgggccactttgcggtggctctgcgcgccagggtgtttcctggtccattagtgattatggccaaggctaggtatagctgtaaggagggtggaggaggggcaggctcgtcctgctggcagtgggacagcctgggagggatgtcagggaaggctacaaatacctgactcttaagggtcggctaggagttgactggagggatggggcacccaaagggagggagggccggctggcagggggcacatgggaaggggcagcccaggctcagggcttcactgcgagcccatagaggcccgacaccaagtgggtgtgccagagtgttagaggaagcaaggaggcgagcattctgtcgttgggcagcattttgggactgaactagcgttaggtagttcccgggatactgtaaggtagaggcctcagctctagggattgggaggcggcagggcaggggctctcccaggctctttctgccttttaacccctcgctaacgcccattgccttccgtcttacctagcagagcctctggccaggaccatagggcatcgctttgcttttgtctgtatgttttatacacagtcacacgtcggttaatgacaaggatacattttgagaaatgcattgttaggtgatttcattgtacgaacatcagagtgaccttaggcacacctagatggtacaacccactgcacgcctgggctgtgtaatagagtctgctgctcccaggctacaagcatgcacagcgtgtgactactgaatacatccaaacgtagaaaaggtgcagtaagaatacagtgtaaaagataaaacctgggacaccttctagagcacttcccaggcacagagattgcggggctggaagttgctctgtcacccagacacatgtcactcactgtcgatgagtggaatatgaagacctggtctattgtcaacattgtacacttacgctacactaacttatgcagaaatatttttcacattgaacacttaggctacactaatttatacagaaatatttttcttcagtaataaattaacctgagcttatagtaactttcttactttataaacttaactttttaaacctttttgtctctttttgtagtaacacttagcttaaaacataaacatgtatggctgtacaaaatatttgttttatattctataagctttcttctatttaaaaaagtttaatttattttacttttaaagttttttttaattttaaaataaaatttatatttttattttcattgtttttgagctggagtcttgctctgccatccaggatggagtgcagtggtacgatctcggctcactgcaacctctgcctcccaggttcaagcgattctcccacctcagcctcccgagtagctgggattacaggcgcccgccagcatgtctggctaatttttgtatttttagtagagatggggtttctccacgttggccaggcttgtctcaaactcctgacctcaagtgatctggccacccaaagtgctggaattacaggcgtgagccactgtgcccagccttaaagctttgtttttaaaacctaagacactggccttaaagctttgtttttgaaacctaagacacaaacacacacattggcctaggcctacacagggtcaggatcatcaagacgtcactagatgacaggaatttttcagttccgttgtaattttatgggtccaccattacatgcgcaggccgtcacggacagaaatgttattcggcacttgactgtacatatattgtttttaatggaaaagtttttatgtttgcgtcgatggtgagtgatactggtttttccatttatggaagtcatagtttgcttttaaaataatttaaaccaaaaaagctcctctaaaggcagatacgaagtaaacaggagtgctagtggaacgagggtgtggtgggtgtcaccacggtggttccacagataggtgagctctggagccgctgcgctgacatcacagggtctgccccagcaggagggtgctccctggctgggtggcgagggtagaagatcccctgtagcattacccgggggcctgcgctaggcctgctgaaccattcagccactagacatttaccaaatacctgctgtgtaccaggcccagagacaagggaacttcagacctggctgtggcctgggtggggtgcactgaagagggagactatgctggggatggggatggggtttggagggcggggaggaacagcaacagcagcaaacacagtgcgctgacgacacatcaggcacgctgttactcttgtaacaccctctaaacacttggaatacacatctcatcagcacaagagtcctttacagagggggacattgaggcacagagctgttcaggaagttgctcaaggtcgcacagctagctaggggcagagatggacttgaacccaggccgtgagcctgtccccagagccctggctccttttcatcctctcttgcctggtgtggggcttacaggcgccctctctcctcctggcacccgagggtctctagtgattgtggagtctaacaaggagttggacccagtcacattgtagagtgatatgaaccaggacaactctggtgttgctggagccctcaggaggcccaggctgggtctgtccttgaagtaggtgacaatgacaccttaccaggacagggtgaaggcacacttgcagtgggcactgggtcagcagcagtggcctctgctggtgcacctgcccagtagaagcgatggctctgaccttttttttttttttttagagtcttactctgtcacccaggctggagtgcaatggtgtcatcttggctcactgcaacgtctgcctcttgggttcaagcaattctcctgtctcagcctcctgagtagctgggattacaggcatgcaccaccacgcccggctaatttttgtatttttagtagagatggggttttgccatgttggccaggctggtcttgaactcctgacctcaggtgatttgcccgcctcggcctcccaaagtgctgggattacaggcatgagccaccgcgcccagccccaactctgacctttcattcctctccccaggtacagcacgtgggagccagaagagcacatcttggacccccgcctcgtcatggcctacgaggagaagtacggtgtcctcggcaccgccgggtggggcttagggccggctcagaggcttcccaggagcctgctgctggcttggcaggggttgttggggcagggcaggggtgtccgatggggcaggccagcccagcctgcagctgggtgaaaatggtgggcactgagtcccagggcagctgaggaccctggggccctttcctgttgttgggtgatctcggtcacttcctttacccacccgggcctcagtctctctgctgtcaaatgggccaccctgaagagtacacccatttcccagggtgaaacctcagaggggccgtaagaggtttctgttccagtgaagaatgttaaaatgcttcacaaagatgccctgtgtgctaggaggcggcactgccagttgtgcgggggtgacagatcagagacggtgtctctagaggacctcttagggcaggaaggagtgtctgacgaagctcaaggaaggctgggcaggagcgtgggctttggggctgggatttctgagttctggcctgtccccctgccacctcctgtccaagtggcccaggcacagtctcccacctctgccagggcccctcagggaagctgggcacaccctaacagttctgtgtgccctctctggccgccccccccaccagcaggcagcccaggtcccctgcctctcccagcccgcctgccttgtgcggcttgggaccatttcacaaaatcatttgtatttggcccctatggcaacctcctgaggcaggaatgagggttttgtttgacagagaaggaaactgaggctcttacctggagcccagagcaaggacctggccagggctgccacctccaggtgggggcttttccactgcccctcgctgctgggttcttctggctccttctccaggagatttcctgccatggattcaaaagacaaattttattgttctttccttttaaaatcagggtgtccccatcccagggtttctttctgcctcccaggtgtgtggtggggccttggtccaacagggtgcgacacttgggaatcccatggagcgtggtaaggagagcagtggacaggtatcaaaggcccggattctagtcctccaccagggacactttccctttggtccgttggtgtcctgctggggatggatgctcagtggatggtcagacatttgcaataggtgccgtggggttcattggtatgtgctaagctcagagtaagagcctggcccaaggtcacacgaggcctccacattctttctgttgtccacgtgacctctgtactgggggctgcagagagtgtggatggaaagaactgaagtgggaggcaggatgaaatgactgaatctcctcattacttttggcagttgtttggagtctctggttgtgttgtcttatgtgtcatgtgtagcttcgtggcattgtcaagttgtgcttttttttgttttttgagacagggtctcaccctgtctcccaggctggagtgcagtggtgcgatcttggctcactacaacctctgcctcccaggctcaagcaattctcctgcctcagcctcctgaatagttgggactacaggtgtatgccaccgtgcctggctaatttttgtatttttggtaaatggggttttttgtttgtttttttttctttttctttctttctttttttttttttttttttgagatggagtctcgctctgttgcccaggctggagtgcagtggcgcgatctcggctcactgcaagctccgcctcccaggttcacaccattctcctgcctcagcctcccgagtagctgggactacaggtgcccgccaccatgcccggctaatttttttgtatttttagtagagacagggtttcactgtgttagcctggatggtctcgatctcctgaccttgtaatctgcccgcctcagcctcccaaagtgctgggattacgggcgtgagccaccgtgcctggctggtaaatggggttttgccatgtcacccaggctggtctcaaactcctgagcttaagtgatccacccacctcagcctcccaaactgctgggattacaggcgtgagccaccgcacccggcctgagttgtgctttgtgtttttgatacatgggaaggcatctgctgggcactcagaacaggctggttttcatcctgtcccccgacaagatgggacagacagggtaggagccggtccgctctcccaggttcacagagatcccaaattcgggggagtctgtgcagagctttacttgcagagggactagccattcccatcagctctcctgggacattcaaggtaaattggattgacaggcttctgtatcactcccctaggaggaaaaactgagccacgtttttagggggtccttaggagcacgtagagcagagcccgcacatggccctggagccccttaaggacccactgtttttggagatgctgcaagtcccccctcagcagttgccctccacgtttgtcagatgggaagaccttggccctgggagttgaacatctgaccccgttgttatggccccagccaggcaatggggaggattggtgggcaggcctgtggggagtgtcccctccctgacagacagcagagggcgggcgaagcggatgccttcccttcccttagatgtcaccagtgtttccttttcttctgccacctgcttcacaccccagggaggagagagaccgagcatcggggtataggaagagaggtccgaaacccaagcggcttctgctgcaggtaaccagcctgcctttgtgcctcctttctccccctgcccaaccccaagtccccctctgccccttggtgcatttgcactggctgattgagctgatctgtgtcccctcgcctgtaccacccagggcactgtggggtggggcacttgggtaagttttgatgggaggaattgggaaaagcctgcgtgtggggctggtgcccggggaagacagcctgggtgggcggtgccacctgggagggggagtaggcatatggccagtggaatcctagaattctcaaagcttagaatcttgctgtaaggaagccctgaaagctttgagcctttcgatgctcagaatccctaaacacaaaattatcactgagaatctcagaaacataaacttgagaattgaggaaacatgagaggctggagtttcagaatctaagaaacagaatcttttttttttttttttttttgagacggagtctcgctctgtcgctcaggctggagtgcagtggcgcgcgatcttggctcactgcaagctccacctcccgggttcacgccattctcctgcctcagcctccccagtagctgggactacaggcgcccgccaccacgcctggctaaatttttgtatttttagcagagacggggtttcaccgtgttggccaggatggtctcgatctcctgacctcatgatccgcccggcttggcctcccaaagtgctgggattacaggcgtgagccaccgcgcccagccagaaacagaatcttagaattgtagaactacagccttggaatgtcagacccctagaagtgtgtcatttttgagtgggcctcctgttccagccttcagtcagttggggacccaagtctctgcagcatcccggagtacccacgtcgtaggtcttgggggcctttcctgacctcagtgctttgcagtgacagggacgtggatcttggagcagtgcagtcacaggttgagtctccctgatccaaaatccaaaatgctgccatgtgcggtggctcatgcctgtaatcccaacactttgggaggccgaggcgggtggatcacctgaggtcagaagttcaaaaccagcctggccaacatggtgaaaacctgtctctactaaaaatacaaaaattagctggggatggtggcgggcacctgtaatcccagctactcagggggctgagacaggacagtcacttgagcccgggaggtggaggttgcagggagccaagatcataccattgcactccagcctgggtgataagagtgaaactccgtcccctgccgccccgcccccccaccccaacaagaaaaacaagatctgaaatgctccagaatccaaaacattttgagcaccaaaatgatgttcaaaggaagtgttcattggagcagtctaaatttcagatttttggattggggatgctcagctagtatatataatgcaaatattccaaaatcctaaaaaaattcgaagtctgaaacacttctggttccaagcatttcggataaggaatgctctgcctgtgtgtggttgtaggtaagcctcttcacctgtaaaatgggtatgaagagaatacccgctctccttaatgtaataagacccaccaggcaggatattggaagccagaaagtcaggattcttggtccacttgtatgtggtccatgtcaagcgtccttggccactcctgattaaaacccatggaggctttcgccagagggggtgggcctcccttcatgcagtgggcatgttccattgggtttggcatgaattgagcctaggaagggaagtaacatctcctggacgtctgtgtgccaggctgtctgcccagtgtgcctcacagatgaatatactccatccacatactaagcctacagggcaggtgtgttcgttatctcttcccctctaacatggcaactcaaagcaataaacattgattatttcacatggcttctgggggtcaggaatttggaattgtgctagctggttcttcagtggttctagtctgggctgcagtcaaggtgttggctgggctgcagtcatctgcaggctcgaccagggctgcgggatctgcctccgagggggctgctcacgtgccatcgagtcagggctggacgttgacagggactggtcctcaccatgtggacctctccagagggttgcttgagtgtccttacagtgcagccaccagcttcccagagtgggtgacctgagagagagagcagggaagaagccacagtgtcttttatgccctagcctgggaagtcacacaacacagcactgggtgtgggaatggacggcgcataggtgtgaattccaggaggtgggtgtggttggggccctcctcggaggctggctcctacagtctcttcattgtttcgctgagaaagaaactgaggcccagggaggccggtagcttacccaggacctgactgttggcacccgcgtccctttagtagctgtagttctctcgtgatgaggttgccaaggacgtagaagaccctgccttgcagaatggtagaatgtactgggcttctttttttttttttttttttttcccagacagagtctcgctctgtcgcccaggctggaatacagtggtgcgatctctgctcactgcaagctctgccttctgggttcaaatgattgtcctgccttagcctcccaagtagctgggattacaggcacctgccaccacacccggctaatttttgtatttttagtagagatggggtttcgccatgttggccaggctggccttgaactcctgacctctggtgatccagctgcctcggcctcctaaagtgttgggattacaggcgtgagccactgtgcctggcccatactaggcttctgatggcctgtgagcccgctgggaggagtgggttttgagtcagctgcctaccagatgtgcctcccaggcactgcagtattttcccagtcccctcccagtttagccctcctcccatcactgcagcagccggcacctggggacatgtgatgccgttaacaggcacgactgtgagtgggacctgcgtgtgtcatcccttccctcagcttggaggtgtttgacctcacaggtcccatctgatggctgcactatcttcctgggagctcctgacctctggtagcaggtggcaggagaaggtactgtcccagtgatccagagtctcccaacatcttggcaccatgaatcttttgtagattcatgtaaattctccccaagtaaataagataaatcccgacattacaaactccaggggtggacagacttgccctccagctccagatgtgtcgcgggcaatcagcagagcgggctgcaatcacagagcccaggagccccctggaggggtcggggtgcatctgcaggccaggtggagccctgtccctttggctggatagcatgggcatccggggctgtgtgtgctgctggcctggctttgccccaagcaactccaagagcacaccttggccctctgcctgcaccatctcccgggtgagctggcagtgtcagttttggaggtgctctggcaagcaaagatgcctttcctaaaacgaaggctaactccttaatgcatccagatttgtttctcttggccagttttcagtttgtccttcttgtatgcttctctgctgggtatcaaaggagtaaacgctgggacgcgagtgctctgtggggcccagaggcagggctgagctggccgaccctggggttgcccggggcgcactctctgggctggggtggggtggggtgatggccagccgtggcatgggaaggagttgagtgggtagacatggcatgggaagggcattccgggtgggaggaacagcatgagcaaaggtgtggcgggtgggagggtggggctgacccgcgctgccctggcttgcccccgcagcggctgtacagcatggacctgcggagctcccacaaggccaagggcaaggagaagctctgcttctccctgacgtgcccactcggcagcgggagccctgagggggtggtcaaggcgggggcacctgagctggtggacaagggccccttggtgcccaccctgcccttcccgctccgcaagccccgaaaggcccacaagtacctgcggctctcgcgcaagaagttcccgccccgcgggcccaacctggagagccacagccatcgacgggagctcttcctgcaggagccaccggccccagacgtcctgcaggcggctggcgagtgggagcctgctgcgcagccccctgaagaggagggtaaggcggccccagcccagagaccctcagagctggaaagggccctatgggtcataaggtccagctggttcaatgtccaaagagggcctgtagtgctttgtggggccagtcgggtctgggctcagggcccaacactagcccagggctcctcctgtcgtcccgctctggctgagctcttgtctaggtggggaggatgcacccagtgccctcctcccaagtgtccagccctgtgtgaggccctgagctgactgaagacacagagaggaggagctggagttggggtcgggttgggtggtctgcatggcttcccaccttgtcaacgctgcccccatctgtgtgtctgacgctgcagcagatgccgacctggccgaggggccccctccctggacacctgcgctcccctcaagtgaggtgaccgtgaccgacatcaccgccaactccatcaccgtcaccttccgcgaggcccaggcagctgagggcttcttccgagaccgcagtgggaagttctgaatcaccgtttttactcttcttaaactgttttcttttgggcttggggtgggacttccagagatagggatgggttgggggcggggtaattattttatttaaaaaaataccgagcagcaaaaggggagaagatcccactactctcccaccacctgccctttctctgagggacgtttaccacgaggcctcaggctggggatggagagagttgctctgggagttggggtaccacccccagggcaggatggggacaggatcacctgcccgggacaccaccattatcattctcctctagtgacgcagcagctggttctgggagttaaaggagcattggaaggcccaaaccctctcccttgagtggccaccccagcctggttggctggttttccccttttctcttgtttcaattgggtctttaccttgaactctcctctctggctttgcggtgggctgtggaggctggttttgaccaaaagtgagtggggcgggaggaaggggcaggaggaagggttgaggttacttggggcgagtcccttccccttcagagaggcttctatccttcccagggaggaggcgccgctgagacccttctgctgagagctctgccctcccctcatcacctggcctgtgcagaaacgctcatgcacacctggctgcacaggtgtgcacgcattacccttcgcgtgtacgttcccatgtgccccgtgaaagcatgtgtggctgcagacgtgtccacatgggccttgcgaacctgggttagaaaccctggccaggcgaacgtggggtgattcacagcacaaaagacctcaccaccacacctgcactcaccccaccttgcatgcaccttgctacctgcttgcggctttcagtggagggcaggggtctggcacaggtgcgatggcaccccatgctccaggcatacagatgtggtttctcggctgcaccgggccaggctgcgggtgtgcaggcgtctgctaagttgtgtgatgtatcagcacaggctttgagacgtctggaccctgtccttcctcccgtgaggggttcttgttctttctgactcaggtgacttttcagcccttccaattcccctctttttctgccctcccctccaactcagccaacccaggtgtgggcagtcagggagggagggagtgtcccaccacgttctcagggcagcccttgactcctaagccccttcctccttccattctgcatcccctccccatccaacctaaatgccacagctggggctgagctgtattcctgtggagggacctctgccgtgcctctctgaggtcaggctgtgctgtgtgatgggcaggctttgccccagcccacccctggcaaggtgcacttgttttctggtttgtacaaggtgtcctgggggcccgtggcttccctgccagtgaggagtgacttctccctctcttccagtcctgtaggggagacaaaaccagattggggggcccaaggggagcatggaaaaggccggctcccctgtctttccttggctgtcagagtcagggtaacacacaccaagagtggagtgcggccagcaagtttgagacctgcccgccctcctcgcagctctgctctgtgtcctcaggaagtcacagagtctactgaggcaaggagagggtgattctttccccaaatcccttcttccctggttcccaaaccaaagacagcctgcagccctttctgcatggggtgctctgttgacaggcttcccagatccctgagtctctctttccttcctcctcgatctttagttgtccacggtcaattcagtgcttccattgggggacagtcccctccgggatgacctgattcacctccagcccagggaatggaatctagaggaatacgtggggtgggtctggacaaggagcggcaggaatcaccacccatctccagctgtggagccctgtggaggggaaggggaagcttggggttcagaggggactcttccaggagaggggtgcccagcggaggtaaagatgatagagggttgtggggggtctctagttgaatgttttggcccatgactttggaacatggctggcagcttccagcagaagtcacgctccccatcccccaggggacataggacctttttcctgcttcctggtcactttcaaagaactatttgcgcaatctgtgggtctgtggattcacggggctttctgtgtgggtgctgcagttgcttttgtctgcagcagcaggacacatctttcctcttactcagccctttatggcccatggggaactccgtggctcagggagagctgaactccaggggtgtgacctgggacgggtgggcctgaggtgcccagctcagggcagccaggtggctcatgggctgtagtgagccagctccctgggggaaaaggctgtgggccgttaggaccatcctccaggacaggtgacctctatgaggtcacctacggctgtggccgtgcaggcctccttccagcccagagtggcccagtagagcaaggcagacagtgacctccacccccgcagccctcttaaaaggccagtactcttgggggtggggggagggtttagaaagcatttgcccatctgcctttctttcccccagcccccacccgctttgaatgtagagacccgtgggcacttttccttttgtggtggggggtgcggaggaggtacccccacccctggcacagccgcctggaatgcaggactgtcactgctgttcgggtgatgacctcgttgccaagctcctcctgtccccttgttctgggggcaggcgctgtgcttctgtgaggtggtttagcttttgctttcgaagtggccagctgcggccaccaggtctcagcacaagagcgcttcctttgcacagaatgagcttcgagctttgttcagactaaatgaatgtatctgggaggggtcgggggcacgagttgattccaagcacatgcctttgctgagtgtgtgtgtgctgggagagtcagagtggatgtagagcgcggttttatttttgtactgacattggtaagagactgtatagcatctatttatttagatgatttatctggtaaatgaggcaaaaaaattattaaaaatacattaaagatgatttaaaaaaaagaaaattcctgggcatttgattattccttctggtggttgtcaagtgcatccgtccaccaacagactttgtgcgagcaacaaggctgtttatttcacttgggtgcaagtgggctgagtccaaaaagagtcagccaagggagataggggtggggcagttttataggactggggtaagcagtggaaagttacagtgaaaggtggttagctattgtcagcaggggagggggtcacaaggtgcctgttggggagatcataatactcattgtccggaagaaggtcaccaggtcgatcagttggggcagggcaggaacaagccataatggacctgcaggccatctggatgtatatgtgcaggtcacaggggttacaatggctgagctgcagctcagaggccagacagtggtgtccccactgtgctgaagaaagagcttcagcccctggcaatgcctggggtttaggtcccaggtctgctggtcaccggccataatctcggacaagtctttcccttcgctgagaccccagatggacagagaattcactgaggtgacgggaacaggaaactgcgggtgtctctgggtgaggccatcaccatggtccgtagtgtgtcatcagaggcctggaagtgcttctggcaccttttatctgcttctccccaagagtcctttattccagaaccttggaggggtgagcatcgcaggtctctgcaacggcagattccggatcgcaggactgtcatggggctaacgctcacctactgtgtgttcagccaagcttagcacacacatctgaacgttgagacaggtggtcagagccaagggcaagtcctgggagcacgtctgcatttcagtgcatcatgggctgcaggacagaggctaggctggagcaggcagggctgatggtggggagaagagttaaacagtctgttgtagccatgcaggtggaaggggatggtggccgcaactgtggacatgtcagtgaaagagaaacagatagactggggataggtttaggtggtggaagcgtcaagatgtggccactgaattgatgaaagtgagggatcaagaatatgcctgggacctggcacaatggctcatgcctataatcccagcacttggggaggctgaggtgagcggatcacctgaggtcaggagtttgagaccagcctgacctatatggtgaaaccctgtctctactaaaaatgcaaaaattagccgggcacctataatcacagctactctggaggctgaggcaggagaatctcttgaacccaagaggtggaggttgcagtgagccaagatcgccactgcactccagcctggagactccatctcgaaaaaaaaaaaaagggggggagggggatattggacacaaacacatgctgtgagatgactgtgtgaagacagagatgccatccataagccaggaagagaggcctacatcagagccttctctccaagctcagaaggaaccaaccctgctgacctttgatcctggacttcagcctccacaactgtgaaaggatacatttctgttgtttaagcttcctggtctgtgggagcttattatggcagccgtagcaagctgatgcagcgtccatgagaacagagtctaaggcagggacttgggtgcaggtagtttatttgggagggggttctaggaagcaagagtggagacagggccaggggaggagggaaagccagggtaagggcacattattgaggtgggtgctgtgggaacaggagtttgattccacctggactttcggggaagggttcgaaacgcctcccgaaattgtccgtccaactggggataggaatctatagccactctcccatccttcccatcccattactgaagctgctctggcgtgttgacttcgtgcacttctcagctgggtccatgcagaggccaaggcacccccacctggcatccaaattacccactaggcagaaagtgaagactggaccctggccatggctaaaggcagagatgaggatggcagggtgagagctgagcaagtggaaacacctggcagaggaaggcgtggccgggctggtttcactgagttcagagtgtgtgtgggttggcagtacaggcagctctaacacagtgtcatacaccagaacacagatattcatttctcacagttctgggggccgggaagtccaagaccaagatgccggcagatacagtatctggcgagggtcaccttctcactgtgtctttacctggcagagagaggatgctttgatgtctctttcttttcttctaagaatgctaataccatcatgggggccccaccctcatggcctcaagtaaatctaaagacctctcaaaggccccacctccaaataacgtcacactggggcctaaggcttcaacataagaatttgcggtgggtgatgagagggtggacacacacacagacattcagtccatgatacaggtgttgaggtagagtggtcccacaagcagttcacaaacagttctgaagcttaggggagaaaaacacatttggtagaatcgtgcagtggcacgatttcagctcactgcaactccacctcccgggttcatgccattctcctgcctcagcctcctgagtagctgggactacaggtgcctgccaccacacccagctaattttttgtatcttttttagtagggacgggatttcaccatgttagccaggatggcctcaatctcctgacctcgtgatccacccgcctgggactcccaaagtgctgggattacaggcacaagccactgtgcccagcctttttttttttttttttttgagacggaatctccctctgtcatccaggctgaagtgcaatggcgtgatctcggctcactacaacctctgccttccaggttcaagcgattctcccgcctcagcctcctgagtagctggaattacaggcacgcaccaccatgcctgtatttttagtagagacggggttttaccatgttggtcaggctagtctctaacttcagacgtcgtgatccacccgcctcagcctcccaaagtgctgggaatacaggtgtgaccactgcgcccaccctgttttttttgagacagagtcttgctctgttgcccaggctggagtgcagtggcacgatcttggctcactgcaacctctgcctcccaggttcaagcaattctctgcctgagcctccctagtagctgggattacaggcgcatgccaccacgcccggctaatttttgtatttttagtagagagatggtttcaccatcttggccagactggtcttgaactcctgacctcatgatccacccaccttggcctcccaaagttctgggattacaggcgtgagccactgtgcctggcctaaactttttattatgaaaaaattcaaacatgcagaagtagaggcagcaatataaagaccctcatgcgccactcacccagactccaccatcctcagtgctaccccacacttgctgggatgcagatgctggggcctgggcacatagtggtagataaagccacgggtgggggaagggtcagaggaggaagaaggcgatgtgcctgtgtttggtggtgggtagatttatgcatgcctgcccccaagaccaagggaggcaagagaccaaagacagaggctgacaaatccagtttctgagaaagaaacatttaatggggacttaagaacagaggccgtgtctccggcagctgagagatggcagatccccgtagccgccctccagaaagtgttctttatatagcaagcttttagggtgaaacgtgtagctggtcatgtcttcagactttgttgtcaagactcatgagcactggggaggctggataagcatctttacgaggggtcatctgtgcgatgggcattgtttaaagaccttgctgcaggacacattgttatgcaagggtcagacaccagtcctcctggcggttacgcttcaaggtggcgtcactcttgctgttttcctatagcacgctcgtgtatgtgtgtgcgcacgcatgcacgcacatgtgtatgctcataggtggtaacatgagggctgattctgcctcgtcctagtttcctgcactgggggtagagtctggctctagtcgattgctggcaactccttggtggctccctttaggaagtggagcactcagggccgggcgcagtggctcatgcctgtaatcccagcactttgggaggccgaggcgggaggatcacctgtggtccggagtttgagaccagcctggccaacttggggaaaccccgtctttactaaaaatataaaaattagacaggcatagtggcgtgcacctgtaatcccagctacttgggaggctgaggcaggagaatcacttgagcctgtgaggcggagcttgcagtgagccgagattttgacactgtactccaacctgggtaacagaacgagactctgtctcaaaaaataaataaataaaataaaataaaataaaaagtggggcactcagcatgctttgtctttagctttaagccttaacccaagttctgaatccccaagaacatgtcatggctgggtgtggtggctcaagcctgtaatcccagcactttgggaggccaaagcaggtggatcacttaaggcctggagttggaaagcagcctgggcaacatagcgagaccccgtctctatgaaaaatgagaaaaaattagctgggtgtggtggcacctctagtcccagctacatgggaggctgaagcaggaggattgcttgagtccaggaggtcatgactgtagtgagctatgatcatgccattgcactccagcccaggtgacagagtgagatcctgtctcaaaggaaaaaacgaaaaacaagaaaagtctcagaattgccctggtacacgtgctcagtatagctcttgtgtatgttgttacctgcatgctgacaacgactctctgaggtaggtactattgttgcacctgtttctgtgagtggagacaagtggttagagaggctgcggttagttactcaaggctacatggctaggacgtagcagagcagagacttgaacctgtatctggcaccagacacctcatgactaatccttctacagcagttctcaaactttttggttgctgaatccatatacattcttaaaaactgttaagaaccccagagagcttttgtgtatgtgggttatagctatcaatatttatcatattagaggccaggtgcagtggctcacgcctgtaatcccatcactttgggaggccgaggcaggtggatcacctgaggtcaagagtttgagaccagcctgaccaacatggtgaaaccccatgtctactaaaaatacaaaaattagccaggcgtggtggcaggcgcctgtaatcccagctacttgggaggctgagccaggagattcacttgaacccaggaggtggaggttgcagtgagccgagatcccaccactgcactccagcctgggcgacaagatcgagactctctccaaaaaaaaaaaaaaaaaaaaaagtaatggcttcattattttttaatgaattagatatttttaaatttctcatatatatatatatatatatatatatatatatatatatatatatatatatatatggtttttgttttgttttttttttggagacagccttgctctgttgcccaggctggagtgcggtggcgtgatctcggctgcaaactctgcctcctggattcaagccattctcctgcctcagcctcccgagtagctgggaatacaggtgcccaccaccacacccagctaatttttgtgtttttagtagagatggggtttcgccatgttggccaggctggtctcaaactcccgacctcaggtgatccacctgagcctcccaaagtgctgggattacagatgtgagccaccgcactgggcctgaagccattacctattaacataagtaacacattttatgaaaaatatattttccaaaacagaaagattcagtgaggagagttggcgttgctttactccccgccgtgtcccccccacgccccgttgcctcttttttgtttggcttaatagttaggtggattatcatatctcctgcgtaaaaacctgttgcagtattgcatggcatgcagcctctggaaaattccgcagttcgttgtgagaacatgagagcgggaagacaacatcttaaacatgatgatgagaaccgtggaccttacaggccctgaaaaggctgggggcacacttggaagccaccgtcttcttccctgtagctcgcctgggcaggtggccacagctagccatctgaggccggtccgtggtccattcctggaaggcgtggcttctggccggtgccccgggagagctcattgcgtggagatcccctgtcagcgccccgcttcacagtcccccacgcttcaccgtccacctcccagcttcactgccctcccccgcccccctccccgaccccctccgcacccccccatccctggccgcttcactgttcagtccggatgcctcctggaaagaaaagccatacagcacgaaggaaagcaggcgcgggaaagttcctgtgaagctggaggggagggggcaagagagaaaagctgcagaaggaaagaggaaggaatgcaggcactaggggagaggaggggacggcggtcgctggggtcaggggaaggcggacgcctcttccactgtcctgagagggaggaggcacagaggaagcaggccccaagggccgggtgccatgagagggagagggagaggaagagcagcaccccaagaaggtggagcaggggagggaggccgcccggctggcctggggtggggcaggtgcagccttcccggctccccaaattgcccagctgtcctgaaaataaatcccatgggaaagcggggaagaagctgccccacccccggacccccaggacctccctgtcctcctcttgactgcacctttgggccctgccttttagatggaatccgatggctctgagccccgcctgcccctgcaccccctgcctccttcctccttgtgctcctctgctggcctcctccagtggcttcggtgctttctcacctcactggatccgttcttattaattaatttatttatttattgaggcagaatattactctggttgcccctgctggagtgcagtggtaccatttgcgctcactgcggccttgagctcctgggctcaggtgatcctcccacgtcagcctcccaagtagctgggactacaggtgcccaccaccacgctggctagttttttgtatttttggtagagatggggattcaccatgttgcccgggctggtctcaaactcctgagctcaagcgatctgcccgcttcagcctcccaagtgctgggattacaggtgtgagccatctcgcctggcctcaccgggtccattctgactttgggagggtgtggtgggatttgggtccctgcccaccacagacagggggtgggaatctttcaaggaagccatgtggctggggggatgcggggaggtctcctctggagaaggagggccaggttccggttgatggccaggccagggcagtcaggccagcgggagtgcaggccatcgtccctgccttgctggagggagagcactttgccagagaggaagagcctatgcctctcacctgtccatttgggggctcacttttcccctgtctgtctgatcatccagctgacactgtgcatgtccggttcacctggggttgtaaggtgaacaaatgcatggccatcctcagaaggcctgcttctgtctggttttggcctctggctttgaggcttcagttacttgcaggtgatcttaattttaagtaaaaatggccgggcgctgtggctcacgcctgttagcccagcactttgggaggccgaggtgggcggatcacgaggtcaggagatcaagaccaatcctggctaacacggtgaaaccctgtctctactaaaaatacaaaaaattagccaggcgtggtggcgggtgcctatagtcccagctactcaggaggctgaggcaggagaatggtgtgaacccgggaggccgagcttgcagtgagccgagatggcgccactgcactccagcctgggcgacagagtgagactccgtctcaaaaaaaaaaaaaaaattttaagtaataaaacagattttttaatagttgctttattcaagatatttttgtgtatggagaggaatactcattaacattggtactttattgctcaatttattcaagtaatataactctgaaaatcaattttccttaagcatttaaacattattaatttgattaattataaatctagtattataaatctagactgattcttttgaacactccagacatcttaactagcaggccagacacacacaaatacagtatttcagattgatcgagatggcgggatctgagcaatctaatgattgattctttacagagttgcacaaaccaaggagatttaaacggagacctttcatcgtcaggccgtgtctctttaaatcatgataacaatgtttatttgtggcatccgggactaagtttctttttgtcatagaggtgctactggggtacctgtcagagtggaggaaaatgatgtgcagccactagagggcccctgaaatttattctttatatttatttatttatttttaacttttacaaaatagagctgcggtctctccatgttgctcaggctggtctcaaactcctggcctcaagcgatcctccaacctctacctcccaaagtgctgggattacaggcgtgagccactgtgcccagcctaaaattgattcttcttcttagttattattatttttggtggcagagcagaaaagcatttctaagtatataaatacctctgacttgactttttacatcatcctacctaaatatgttgttgttttactgaccactaagaatttctctatattacacacacgcacacacacacacacacaatctctttctctctctcacttaaatgaacaaatgaaaatatattgtgtataatttctttttttgaatgcagtttatttcattttggcttttttctttcttcctttctttctttcttttcttttttttgagacggagtctcactctgtcacccaggctggagtgcagtggtgccatcttggctcactgcaacctccaccacccgggttcaagcaattctcctgcctcagcctcctgagtagctgggattacaggcgtgcaccaccacacccggctaatttttgtatttttagtagagatagggtttcaccatcttggccagactggtctcaaactcctgacctccacccgcctcagcctcccaaagtgctgggattatacatgtgagccaccttgcccggccttctttttggtttactgctccctgctccccacatcccttgtttcttctctcccacttcacacggctcttcagataactcatgtaaatgatcttggaatacaagaaatattctccatgatcatagaatttcaaaggaacataggtacttgtgcatgagcatatgtaggttttttcattgttttataaaaacaacatcacgtgatgtattaggattctctagagggccagaactaataggatctatctatctatctgtcgatctatctatctatctaataagatctatctatctatctatctatctatctatctatctaaaggggagtttattaaggagtattaactcacacaatcacaaggtcccacaatagtccatctgcaagctaaagagtaagaaagccagtccaagtcccaaagctgaagaacttggagtctgatgttcgagggcaggaagcatccagcatgagagaaagatgtaggctaagaggctaagccagtctggacttttcacgttattctgcctgctttatattctggcctcactggcagctgattaaatggtgcccacccagattaaaggtgggtctgcctttcccagcccactgactcaaatgttaatctcctttggcagcacccttacagacacacccaggatcagtactttacatccttcaatcccatcaagttgactcttagtattaaccatcacacatgattatacacatcattctgtcccttttctcaataatttcttgtagaaattttggctgcatactagtcaatggtgtgaatgtaccataaattacacattcatccaccagtgggaattcactttatttccaatttatttaccctgcaaacagcatcgcactactgatgacaagcaggcaactgcgttggagagggaggtcatcatggctgcaaggaagggaccggacccatataatatactacccctaaaggcagcttcaggcaccaaagaagaccctaatttagtcctctccatcaccaacaagagaagagtgggctgcatctgcgtagaggacaacagtaccatcacctgctttgggctgcacaaaggcgagacccagtgatgccccagctatggaacccattacaagctggtgccccgccagctgacgtactgagcacctgcaccaagttacccaaaatgtgctgcaaagtttcttctttccaataaagagtagccattgcattggctccttctcccattaaaaaaaaaagaagaaagggccgggcgcggtggctc

SEQ ID NO: 424 - DNA, 23370 bp, Homo sapiens
ctaggaaccagtcagcgattagaggccgagtcttcggccacccaaaggcggagtaagaaaccagaagcggatctgattggttgctggaagacgccgcgcccacctcacagaaggacgaaccagtgagctaagctgcggggcgcgggctcggccggggcaccggtgagtcgccggcgctgcagagggaggcggcactggtctcgacgtggggcggccagcgatgaagccggtgagtcggacgtgctggggtttggaggagcgaggcggcagggacgcaagcggtcccggggacccgatcctgggccggagggcagccctagcctggtagcagtgcgactggcgccgtaaccgttctgcgggtcggggaggtgactcgcacgggcccagcacgggcacgagagacgaaggagcagggtcggtggccgacgaaggaaagacggacattcgctgtgcacctgctgtgggctgtcacctgtcccctgcggggtctcataagcctcccagccgcccagccaaagagggccgagcctcgttgtaccgaggaaaccgagccgaagagcttgagtgtcagcgatgagtgggcgcgataccccagccccgaagggtggccgggcgctacctgcgcccacagggcctggggaaaccttgagtacgaatgccacgccgcggcttgtgggcgacaccaccgctgtcaccatgccccagggccacctggcaatgctgctcttttcccgtgacgttcagaatcacagggcctggggaagcagaaacgtccagctctgttaggattaataaacctggtgaatgggccacacaaatttgaaatatgaatcatcaaagttgctttaaagaaaaaacagatgcaggcaaggagctgaagatcccccacctaacccatatttcctactgcccggcttgacaacctactggaagcctttcctttgggtgcagttgattataatacttcagatagagccaaagcaacagaaatccatagcctagggccgggtggtgtctcgcgcctgtaatcccaacactttgggaggccaaggcgggcggatcacttgaggccaggagttggagacaagcctagccaacacggtgaaaccccgtctctactaaaaatacaaacattagctgagcgtggtagtgcacgcctgtagtcccagctactcgggaggctgagccacgcaaatagcttgaacccaagaggcagaggttgcagtgagcggatatcacgccactgccctccagcctgggcgacagagcaaaaccctatctcaagataaaagaaagaaagaaaaaaaagtccgtagcctaaattagccgtcctgtgatcttctagtaccaagaccgttgtagaatatagcttcagagctagaaagagcattaggtgcttacaattgctaatccctatgttgccatgtggagggacatcagctgtccttcactcctggcctctttctccacctgtccccattgagttatctgatccccgagtttggaaggaactgaacaccagtatctcaactttttctttccttctttcttgggatctacctgcctgcctgcagaaggtgctttctggtccactctctggcacacaggagccccagactgtccatggccacctgtgactgggtggatacatttgtctaattctggggtgaacaaggggcaagcccacgtggcaacagctttaagctgcatactccatttgatatacaataataaaactccatttctttatctttcaattggtttcaactagggagtgagaaaagggtatgggttttgttctgttttgtttttgtttttctttttcttttgattccttaaaatttcaacaaggagtgtagaagtcttccatgtcaaaatgctgcaggattaagttccaactgcttagatcagcatacgaagtctatctcaatctctctagtctagtgattcataaagttggaggcaggttatttcacctacaccacccccaccaaactactaggccatgtggggatgttttttgagaaaaggggtgggcaaaactacttcatctcctctactccatctctattttgatatcacagttcctcaatacacaagcccttggcttaacttctttcctttcttttttcttcttccttttttttttttttttttggcagagtcatgccctgtcagccaggctggagtgcagtggtgtgttcctggctcactgcaacctctgcctcctgggttccagggattctcctgcctcagcctcccgagtagctgggattacaggcatgtgccaccatgcctggttaatttttgtatttttggtagagccaggttttgccatgttagccaggctggtctcaaactcctgacctcaggtgacctgcccaacttcgcctcccagagtgctgagatttacaggcataagccaccgcaccctccctttcctatcttctttaaaacctgctcttccttcaaaacccagctaaagcgtttcctctgtgaagccttctccagctacctacgtggtcactctcttctctgttccacagtgtatagttctgcttccatttcagcacttatataatacctttcttctgtaatctatgcacacatctgtctctccagccatactgaaggcaggctatttatcttatagatcttttgcatctccagtgcttggcaaatgaaggtggccaagaaatatttgtgaatgaataaatctcctcactttatagttgaggaaaatcgagatccagaaccaactgaagtggcttgtcagagagtatacagtaagtggcagaaccaagatcagaagccagatttcttggttcccaatccaactctctttccactatgcagtgctataattattaataggaaggtaaatagcagtcatttattattaatattgctgatctcgttaatattctggattgatggctgaatacattgcaaatatgaattcagtgtgtgtttagacaaggattagctatcctaaaactacaaaaaaattctttacagttatttaacataacatttcttttgaagcccagttcaatacaaacaagtgagtttgactcatcagatgaagagcctattgaagatgaacagactccaattcatatatcatggtatgttagcatttctgatcaatgatgagctaaaatcacaatctacatcataaatgtaaatttagttacatcataatcttagtagaatgtagttcacatattgaaaatgttaagggattatccccctctgattatataattctaatcattaaaggatcttctaactccatgattcatttactatctataatacagaataagacccttttttttttttggcccttctttatacattctaactccatgattcatttactctttataagaccctttttttttttttggcccttctactaacttagtagaaggaagtaagtaggaaatagaggtaggattgaaataatctcccatttagtatcaaaatctacttattcttttatgacaaaagaataatataccaaatatgagatgagatatttaatcatttctcattaaatcaaatcctaggtaatacttagaagtaatgtcacagtaatgcatctatcaacagactctgtttaagataaaagccacatcaatgcaataacaaaaagtttctacataaaatcagccttttaatcttggcaagtgacttatggttataccagattctttacaatgagcaatcaaatgctttctctcatcactgcaaatataatagtctctcttcttaagaaagcactatccctactgtcagaagagaaagagtgtcctaaaggtcttttgtcctgccatcaaatagcattactttccatttccacttaaaactcccatttaaacacaaaaattcatctaattttcaaagtcaggtggtatttagatgatgcctcctgttttcctttaaatcatcttctgacatgcagacaaggtgagcctctgtccctgagtactgcaaactgggaatatgatttcttcacattatttctttttaaccaaaaacctgtggttttcatcatatgaaattatatctgttaaggaagttctatttaaaaatcttaaaatagtaatgtagaataaatgctggggagaaaattgtccaatagtcattttccaattcattttcctaaatcactaatacaaattatctcaggtaatataccacaggataacataagtacaccgtatactaccggttggcaatctaggcattattatctttaaggtaaatttaaattaacttggttttttgttttcttgttttttgtagagacaggatttcaccttgttgtccaggctggtcttgaactcctggactcaaacagcctgcctgccttggcctctctaagtgctgggatcataggcatgagccactgcacccagcctaacttgtcatttttaagacttaaataataacaaagcaaataagtccctgttttaaaactttgtctttctatgtttttttttgtgaccaacatattgatacttaactgtgaattcttactttgtgactactgtaaaactttaacacaactttatttggtggcaagcacccatattgattaaactgaatttccatttataactttttaaaaacttaactaaacatgaaaaatttttcttcttttcaggctatctttgtcacgagtgaattgttctcagtttctcggtttatgtgctcttccaggtgggtaacacaataatgggcttcctatcaatatgtatatattttttaatatatttttattgcagtagcttttggggggacaggtggtgtttggttacataaataagttctttagtggcaatttctgaaattttggtgcacccatcaccagagcagtatacaatgtacccaatgtgaagtcttttatccttcatcccccttccacctgttccccaccagcccccgaagtccaatgtatcattcttatgcctttgtgtcctcaaagtttacctcctgtttatgagtgagaacatatgatgtttggttttccattcctgagttacttcacttagaataatagtctccagtgaccgggtgcagtcactcacacccgtaatcccagcactttgggaggccgaggccggcagatcacgaagtcagaagatagagactatcctggacaacatggtgaaaccccgtctctactaaaaatacaaaaattagctgggcatggtggcacgtgcctatagtcccagctacttgggaggctgaggtaggagaattgctttgacaggaggcaggggttgcagtgagccgagatcgcaccactgcactccagcctggcaacagagcgagactctgtctcaaaaaaaaaaaaaaaagaataatagtctccagttccacccgggttgctgtgaatgccattttgttccttttcatggctgagtagtattccatggcatgtgtgtgcgtgtgtgtgtgtgtgtgtgtgtgtgtatgtatatctcacattttctttttttattatactttacaaccccactttttgatggggatgtttgtttttttcttgtaaatttgtttaagttccttgtagattctggatattagacctttgtcagatgcatagacggcaaaaattttctcccattctgtaggttgcctattcactctgatgatagtttcttttgctgtgcagaagctctttagtttaattaaatcccatttgtcaattttggcttttgttgcaatcgcctttggtgttttagtcatgaagtctttgcccatgcctatgtcctgaatggtattgcctaggttttcttctacagtttttagagttttaggtcttaggtttaagtctttaatccatcctaagttaatttgtgtgtaaggtgtaaggaaggggtccactttcagttttctacatatggctagccagttttcccaacaccatttattaaatagggaatcctttcctaattgcttgtttttgtcagttttgtcaaagatcagatggttatagatgtatggtgttatttctgaggcctctgttctgttccattggtctatatatctgttttggcatgtgtaccatgctgtttttgttactatagccttgtagtatagtttgaagtcaggtagcgtgatgcctccagcgttgttctttttacttaggattgtcttggctatatgggctctttttttgttccatatgaaatttaaagtagttttttctaattctgtgaagaaagtcaatggtagcttgatggggatagcattgaatctataaattactttgggcagtatggccattttcatgatattgattcttcctatccatgagcatggaatgtttttccatttgtttgtgtcctctcttatttccttgagcagtggtttgtagttctccttaaagaaatccttcacataccttgtaagttttactcctaggtattttattctctttgtagcaattgtgaatgggagttcactcatgatttggctctccgtttgtctgttattggtgtataggaatgcttgtgatttttgcacattgattttgtatcctgagactttgctgaagttgcttatcagctttgggctgagacaatgaggtttctaaatatacaatcatgtcatctgtaaaaagagacaatttgacttcctctcttcctatttgaatactctttatttctttctcttgcctgattcccctagccagaacttccaatactctgttaaataggagtggtgagagagggcattcttgtcttatgacggttttcaaagggaatgcttccagcttttgcccattcagtatgatattggctgtgggtttgtcataaatagctcttattattttcagatacgttccatcaatacctagtttattgagtgtttttagcatgaaggggtgttgaattttatcaaaggccttttccagatctgagataatcatgtggtttttgtcactgattctgtttatgtgatggattatatttaatgatttgcatatgttgaaccaaccttgcgtcccagggatgaagctgacttgatcgtggtggataagctttttaatgtgctgctggattcagtttgccagtattttactgaggattttcgcatcgatgttcatcaaggatattgacctgaaattttcctttttgttatgtctctgccaggttttggtatcaggatgatgctggcctcataaaatgagttagggaggattccctctttttctattgtttggaatagtttcagaaggaatggtaccagctcctctttgcacctctggtagaattcagctgtgaatccatctagtcctgggctttttttggttggtaggctattaattactgcctcagtttcagaacttgttattggtctattcacggattcgacttcttcctgggagggaagaagtccctttagtcttgggagggtgtatgtgtccaggaatttatccatttcttctagatttctagtttatttttgtagaggtgtttatagtattctctgatggtagtttgtatttctgtgggatcagtggtgatatcccctttatcattttttattgtgtctatttgattcttctctcttttcttctttattagtctggctagtggtctatctattttgttaatcatttcaaaaaaaccagctcctagattcattgattttttgaatggctttttatgtctctatctccttcagttctgctctgatcttagttagttcttttttttttcttgagacagagtctcactctgtcgcccaggctacagtgcaatggcacaatctcggctcactgcaagctctgcctcccgggttcatgccattctcctgcgtcagcctccctagtagctgggactacaggcacccaccaccacacccagctaatttttttgtatttttagtagagacgggggtttcaccgtgttagccaggatggtctcgatctcctgacctcatgatccatccacccgccttggcctcccaaggtgctgggattataggcctgagccaccgcacccggcttgatcttagttatttcttgtcttctgctagcttttgaatttgtttgctcttgcttctctagttctttcaattgtgatgttagggtgtcaattttagatctttcccgctttctcatgtgggcatttagtgctataaatttccctctaaacactgcagattctggtacattgtgtctctgttctcattggtttcaaataacttctttttttctgccttaatttacccagtagtcaggggcaggttgttcagtttccatgtagttgtgcagttttgagtgagttttttaatcctgaattctaatttgattgcactgtggtctgagggactgtttgttatgatttctgttcttttgcatttgctgagtagtattttgcttccaattatgtggtcaattttagaataagtgcgatgtggtgctgagaagaatgtatattctgatgatttggggtggagagttctgtagatgtcaattaggtctgcttggtccagagctgagttcaagttctggatatccttgttaattttctgtctcgctgatctgtctaatattgacagtggggtgttaaagtctcccactattattgtgtgggagtctaagtctctttgtaggtctctaagaacttgctttatgaacctgggtgcttttatgttgggtgcatatgtatttaggatagttagctcttcttttgcattgatccctttaccattatgtaatccccttctttttctttttttatctttgttggtttaaagtctgttttatcagaaactaggactgcaacccttgcttttttttgcattccatttgtttggtaaatatttctccatccctttattttgagcctatgtgtgtctctgcacgtgagatgggtttcctgaatacagcacaccaatgggtcttgactctatccaatttgccagtctgtgtcttttaattggggcatttagcccatttacatttaaggtcaatattgttatgtgtgaattttatcctgtcattatgatgctagctggttattttgcccattagttgatgcagtttcttcatagcgttgatggtctttgcatttttgtatgtttttgcagtggctcataccagttgttcctttccaggtttagtgcttccttcaggagctcttgtaaggcaggcctggtggggacaaaatccctcagcatgtgcttgtctgtaaaggattttatttctccttcacttaggaagcttagtttggctggatatgaaattctgggttgaaaattattttctttaagaatgttgaatattggcccccactctcttctggcttgtagggtttctgcagagagatatgctgttaatctgatgggcttccttttgtgggtaacccagcctttctctctggctgctctttacatttttttccttcatttcaatcttggtgaatctgatgattatgtgtgttggggttgctcttctcgtggagtatctttgtggtgttctctatatttcctgaatttgaatgttggcctgtctttctaggttggataagttctcctggataatatcctgaagtgtgttttccaacttggttccattctccccgtcactttcaggtacaccagtcaaacataggtttggttgattcacattgtcccatatttttggaggccttgttcattccttttaattcttttttctctaattttgtcttcacactttatttcattaagttggtctccaatctctgatatcctttcttctgcttgatcgattcagctattgatacttgtgtatgcatcacgaagttctcctgctgtgtttttcagctccatcaggtcatttatgttcttctctaaactggttattatagttagcagttcctctaaccttttatcaagtttcttagtttccttgcattgggttagaacatgctcctttaacttggaggagtttgttattacccaccttctgaagcctacttctgtcagttcatcaaactcattctctgtccagttttgttcccttgctggcgaggagttgtgatcctttggaggagaagaggtattctggtttttggaattttcagcctttttgctctggtttttcctcatcttcgcggatttatctacgtttggtctttgatgttggtgacttttgaatgggggtttctgcgtgggcgtcctttccgttgatgttgatgctattgctttctgtttgttagttttccttgtaacagtcaggcccctcttctgcaggtctgctggagtttgctcgaggtccactccagaccctgttttcctgggtatcaccagtggaggctgcagaacagcaaagattgctgcctgctccttcctctggaagtttcgtcccagaggggcacctgccggatgccagctggagttctcctgtacgaagtgtctgtcgacccctgctgggaggtgtctccccgttaggaggcgcggggttcagggacccacttgaggaggcagtctgtcccttagcaaagctcgagcactgtgctgggagatctgttgctctcttcggagccagcaggcagaaatgtttaagtctgctgaagctgtgcccacagccatcccttccgccaggtgctctctcctagggagaagggagtttatctataagcccctgactggaactgctgcctttctttcagagatgccctgcccagagtggaggaatctagagaggcagtctggctaccatggcttttccacactgtggtgggttccgcacccagttcaaacttccgactggctttgtttacactgtgaggggaaaactgcccactcaagcctcaataatggtggatgcccctccccccaccaagctggaacatcccaggttgacttcagactgctgtgctggcagtgagaatttcaagccagtggatcttagcttgttgggctccgttgggggtgggatccacagagcaagaccactcagctccctggcttcagccctctttccaggggagtgaatggttctgtcttgctggcattccaagtaccactcagttggaaatgcagaaatcacccgtcttctttctgcattggtcttgctgggagctgcagaccagagctgttcctattcagccatcttgcccgggaatcccacattttctttatctactcattaattgatgggcatttgggctggttttacatttttgcagttggaaattatgttgctataaacatgtgtgtgcaagtatctttttcatataatgacttcttttcctctgggtatatacctagttgtaggattgctggtcaaatggtagttctacttttagttctttaaggcatctccacactgttttccatagtggttgtactagtttacatttccaccagcagtgtaaaagtgttcccttttcaccacatccgtgccaacaatatatttagaacaagtatttggtcaactaacacatcattctctatactgggcaataagtaaatttcacagaccatcagcactggggaacacactttgcgaagccctcatggtggactatagttaaaggaacatagatctacctttcagcccttccagatctgcagtcacagccctacacttgtactttgccaatcttaataaagcttaaagcctggagtacaaatgaggctgaggactacaaccaggtacttgttacagaagaaacacagaatacagaatccttgcttaggatgaatccctgtaattatattcctagaaatataagaaattgaaattcatattcaaaatataattgaaacatataaatgattacgtgaaatgactttataaagtagctatataagtgtttaaacatacctgttacatatgacgaaaaactgacttttttacttgctttattattacttataggttgtaaatttaaagatgttagaagaaatgtccaaaaagatacaggtaggtataatatcacgcaaccacactcatgggttttttaaatgaatagcattgaaaaactctctgtcaaaaagaacaaatcagtttttttttaatataaaaataagttttcaatattgtgtgaagttccaaactatagacttattctgatatgtaaagaggtatttgtgaagaccatcatttacctaaccatggagttgcttttcactgattgttgtagttatattatacatataaactacatttgaggttagaatgtagaagttggcatgaaaaaaagtatgtaaataggaaactgacatattgctccccccaggtctttactgttccttgcagacttgactgtggtagtagaaattaaacatgagctgggaactccaagttagcagtgaaattgtgaatcctggatggaaaattttgagagccagcatctagatggaaaagacagaatgggaactggttgttgcctgctcaaggatgttcataccattatagccacaagtctaataatcctcataatctgccccaatttggaatttacatattgcatgatactaacaaatgtggattttcaaaagattttattctgattggcctggaatgtctcaaacctactagtcctaccgatatccttatagtatggcaaattaaaatgtatatattgcttgattctaactagtatagattttctgaatcttaaaaacttttcgtggttattctagaacatcagtttgctaatgtacttttaaaaatttattcctggtcaggtgcagtggttcacacctgtaatcccagcattttggtaggccgaggcgggttgatcgcttgagctcaggagttcgagaccagcctgggcaacaaggcaaaaccctgtctctgcaaaaaatacaaaaattaactgggcatgatggcgcgtgcttgtagtcccagcaacttgggaggctgagatgggaggatcacttgagcccaggaggtcaaagctgcagtgagctgagatggtgctgagatcacaaggtcttgctctgtcatccaggctggagtgcaatgagctgagattgcattactgcactccaacctggtggcagagcaagaccctgcctcaaaaaaaaaaaaaaagtattccttacctaccaaaaaaagacttaaagacagtaatagatagttgacccttatagtatttataaaacttttctgctttagacacacccaccatgctaggaaatttctatttggagaacatttaggtcataagcaaaatatatgtaatttaaatcattggttcaaagtcagtcttgtacattttggaatgtcatattcatttagcattttctataaaaacagtttccaatttttttcaaaatacttttttttctgcaatgaaatcttaaatggaatccagtacataaaacaggtcaatatgtttgattggagacctagaatctccctgcagcagttcctgagatactttcttagccctttctcagaaagttggaaaatcactggataataaaaattaccaaatgtgtacaaaaggcaaatagatgtatagtactgtacatctcagggattagttcatgagaaggtactttgtacttaaatagctacatgtccttggatttaagggacagggagagggctggagttgggagcacttagatcatccagttatttattttaaaccaaatgctcaatagttaatattgccataaagaagtcctagtgtatagaatgcctatagtattcatatcattataatgagaatagctaggtcacagaagtttaatacaggtaatgttttatttactggcgacctagtctataaaattaaatacacaaggatgtgttacagtgcagatatgagggagaatactagcacctctgacaccatggccatgctggagattttatatacaatactcagagtcaagcaaacagctaagtgatgaagtagcagacatggttgattttgtgagaaaaagaaaaaaagtgctatcatccttaattgaacatagatctatcataccttaattgatagcactttttttctttttctcacaaaatcaaccatatttgctactcaattttaagtgttttaagagttattttatgccaggcatggtggctcatgcctgtaatcccagcactttgggaggcggaggcgggcagatcaactgaggtcgggagttcaagaccagcctgacaaacatggtgaaaccccgtctctactaaaaatacaaaattagctgggcgtggtgacacatgcttgtaatcccagctacttgagaggctgaggcaggagaatcacttgaacctgggaggcagaggttgcagtgagctgagatcgtgccattgcactccggcctggtgacagagcaagactccatctcaaaaaaaaaaaaaaaaaaaaagagggggggttattttaaagcagtattcattgcaaaaaaaaattttttgcaagaacagcaattgacttattttgaaattcagtaaaaggcattttgacttgtaatatgaggtttaattctagaccccttttgattcagacatatcaataggcacttcagatttatagattgtcatttggtattagtttggcttaagaaatttaatttcatattctccctcttgatggtatttaaatgtgtgatgttttctatgtgtgtgtgtctgtgtatcctggtctattggcagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacagtacgttcttttctccatacactatgtgagaaatgtctcagtcaaaatgatttctggaattatggtagccctattcagttatcacctacttcatagtttgttgtaaggattaaaaggtaataatgcactaggaaagcactggcacaatgtctggtacagggtaagtagtcaaatacgtgctgttattacttttcaagagtagggacaataaatgagtagatttggaaattgttagaacaaggttacaagcttttcttttttatttctttcctttagtcttagacctttagttgcaattttgggaccctcctttcccctcatcaccatcactgcctcacttattagcttttcaattgcttagttgctttcaatagcaagaaaatcaattttttggccaggtgcagtggctcgcgcctgtaatcccagcattttgggagactgtggtgggtggctcacttgagctcaggagttcaagaccagcctgggcaacatggcaaaaccccatctccgcaaaaagtatacaaaagaacatgccaggcatggtggtacgtgcctgtagtcccagctactcaggaggatgaggtgggggaactgcttgagcctgggagacagaggttgcagtgagccaaggtgacagtactgcactccagcctgggtgacagggagaccccatctagaaaaaaaaaaataaagaaagtcgattttttcaaaattagctaccaaaaaagttacctctaagcaataagcaatcctaaaaatatgacttgaaaattacatttgatgatatgactgctaacagattgaaagagggcctctcattgtgtgtcagtggctataaaaacacaagctgctggtgtgaaagtttaaaacaaaagaagatgggttaaggaaaggggacaaaatgaggaggaaagaaaagcagcttggaggaaggccagagagagtggcaatgggcagtagatagtagcatggcaaagattcaaaggggcgatgtggataaaaaacaagagatgctctgccggaagtgaaacacacaaagcaacagagagccagccatggggaggaaactggactttgccgtgcataatgtatatttcatattctaataacctgcttaatcctttctcgaataaggtagggtattaaatagtttacgacctcaaaagccccaagttccttaaggacattgctttgagctagaagtatagaaattatatcaaatagccatggggttctcagggcacctagtcataggacaagcccagccaacttctcctcttaaacctatagcccaggggcctcatgccaacagtgtcagttctgaaggcaaaccaactagtacgagggtctttggggacacacacctgtttgtggccaaactgaactctgacatacagagaaatatagtttgcagaatatgcagtagagaactagaagccattctacatcctattgtttcccatcttcctctatggaaaaagcatagtcacttaaccagtactaattataaaagctaaatttcaaatagatccagttgatgatgtgaaagtttctgatacatataggtaaaatagtattagatagttaaatgtagctggggaaaaatattttccaacatagggccctatttttcaaaccattttgagatcttttttttttttttcaaataaatttttgaaagcagcctctactgaaaagtttccagaaatcaaactagctctgtttagtgaagtgaagcttaacaaattctactgtagctggttctggcaacccaaatgctctgatgtttgtgcagagtacaaacaggatagacagtagatgggtgactttgcatatgctgaatgtttcagtctcccataaaataaagcatctgacaactggcatttttcattgtcctagagctttcgaaggtgtcctacggtgactagtttattttctatccattctgccatctttgaggacccacacttctagacagctatagagcttatccttcagcaacaggatctggtaaacctttttcactgacctgttgtctaccagtgctgtctcactggttctgcctggacatttgcagccctttataaaattagtgaacaacactgcttgcctactgtattttgtagtttcttggggctattgtaacaaagtaccacaaaccaggtagctgaaaacaacagaaatttcttctttcccatttctagaggatgtaagtccaaaattaagatgagagcagagccatgccctctgagactgaggagagtccttccatgcctcttcctagcttctggtggtggccatcaatccatggcaggccttggcttgcagctgaatccctccagtctgcctctgtcatcacacacttcctcggatgtctgtgtctttgcatggtgttgtccttgtgtaaggacactagtcatctaggatgagggcctgctctaattcgtcttaacttgaatatacctgcaaagactcaaattctgaataaggtcccactcacaggtacaggataaggacttcagcatgtcttttggggggacataattcaaccagtaacacctaccgtgtaccacacgccaagactaccaaacgaggcacagtccccaccttcgaggaacctataactaacactaccatttaactgcaataagacaggagaggcagcacacaggaaaatgatcctttctgtaggagcacaaaggcattttaggaaatgaaatttgaggttttaaaagataagtaggaattcatcaaatagaagaaaaaagatgaaaatagcaaaaggtataaaatagtattaatcttgcaaaaagacactgaagtgttctatcttgatctttttttttttttttaataaggcagttgtctcttctctgtcacccaggctggagtgcagtggcactgtcatagctcactgtagccttgaactgccgggctcaagcgatcctcccacctcaggctcccgagtagctaggacttcaggtgtgcgccaccgtgccaggcttttttttttttttttttttggagagacagggtctcactttattgccaaagctggtcttaaactactggactcaagcagtcctcccaccttggcctcccaaagtgctgggattataggcctgagccatcatgcccagcctctccctttatatggtagatccagatctctgaaacagttctatgtctggaacactttgtggaaagcaagttcacgagtaagactaggggtcaatacctattcagtcctctatttcacatcctaaagcaaaatatatatctacagctttacctacaatacaatacaatacaatacagtaattgatgtccataacgataagtcatccacactaaattaggctcagtataccctctaagtacattaggaagcatgtaatacattttttaggatctttgaaaatgacttaaatgaatagttttgctactgaggattaatctccatttttctggaaaatccagttatacaaaactgctaatttctttacagtgctagataacagcagctaatgttcatttacttcttactctgcacaaagctgtgttctaagtccttggcaaatgctcactcatttgtgagcctcatttaatcctcactctgatgtacatactattgctatcaccattttaaaggtgaaaaggctgagtcccagagagattaaataacttgcttagctttacacatctaataagtggcagagccaggactgaagcccaggcagtggtgctccagagcccatgctccagacttcggtgataccctatctctggactcctttagatacatgaatggttattatctacatggcatttgtgcagtaaccactcagattttgtttagacagaggaataatcaaagtgacagttggtaaaagtctgatttctatctattggtaacatgctccatttctcagatgtggatcttggaacctaaagaggtcaataagaagactctgcctatcttgatgcttagaggtgttcagaattcctcccaacaaagaaataagcacaccttgctctcagttgattaaatcaaaaatatttattaatcttcgtgtgcaaggcactgtgctaggcattagagttgtaaatagaaggcagaaagagcaagtctttagttgtaactagggatggaatgaaatgtacaaacttcaaaactgtatttccctttcagctgctatggaggacttgggagatcttgtcttggtaagaaatatatttctattatttttttaaccgccaaatagacaaacttctgtttccagaccatatgttcattttgtattaaaatggaaccaagcaaaatataagtttgctaagactcaaaggattacttaaggccctaaacatggtgttccctggaaagcttgggtgggagtgggaggtattttcagcattgttctggaggattctggcaaaacatcatttacaagtcttaacacctgcattcttattttttaacattttttgatgttcttcctgtggaggtgttataatagagtaacttccaaatagtttccatgggtaactatttatgaataccaaagttaattactatatgttaatttaaaaaatgttttaatgtactaagaaaaacaaaaaagagttcgtgaaatgccacactggagtagtagttatttttttagtgttggatgatatcaaaattgaaagcttttgtgtttcaaagaatactatcaaaatgacaagactacccatagaatgggaaaaaatatttgcaatctatatatttgataagggatttgtatccagaatataaaaagaactcttacaactcagtaataaagataggccgggcgtcgtggctcatgcctgtaatctcagcactttgggaggccaaggcagaaagatcacctgagtttaggagtttgagaacagcatgagcaacatggtgaaaccccatctctacaagaaatacaaaaattagccaggcatagtggtgcatgcctgtagtcccagctccttgtgggactgaggctggaggactgcctgggcccaggaggtcaaggcaccagtgaaccgagtttacaccactgcactccagcctagatgacaaagtgagatcgtctctctcaaaagaaaaaataataataataaacaaacaacataactgaaaaatgggcaaagtatccgaataaacctttctacatgcaagatacacatatagtcagtaagcacatgagaagatgctcaacatcatcagtcatcaggaaatgcaaatcagaaccacagtggataccacttgacaccaattaggaagggtattataaaaacatgaaaaataacaagtattggcaaggatgtagagaaattcgaaccctcatacactgttggtgggaatgtaaaatggtgcagcggctttggaaaatagtctagcagtagttcttcaaacaagtaaacattaacatatgacccagcaatttcactccaaagtatatacccaaagacttgtatacaaatgtttatagcagcattaatcataatagccaaaaaatggaaacagcctaaatgtccatcagttgacgaacagataaacacaatgtggcatatctatacaatggaatattatttgatcataaaaaggaattaaatacagacatatgctacaatatgtatgaaccctgaacacattatgctaagagaagtcagacacacacaaaaaaatattgtatgtttccgtttatgtgattgctcagaataggcagatctacagagacaaagtacactagtggttgcctatggcaggggttgatggggaatagaggatgacagcaaaagggtacacttctttctgaggtgatgaagtgctttaaaattgactgtggtgatggttgcacatatctgtaaatatactaaatcactgaatggatgaacactttaaatggatgaaagaatgaagccagtgttaaactctaattcaaccatacggtcatttaagatcataatttaactgtcaaaaacacacactaaaagtctcagtcttttaattcatttggaacaattacaccagtcttctgtatcaacagaagtcttattaaatataaaatgctgtaccctgtcactagttatttaataacatattatttttctgtcatgttccattagtagctgcttgtctcctactatacctgtctgacacaatatcaccagagcaagccatagacagcctgcgagacctaagaggatccggggcaatacagaccatcaaggtgaggaggtgggcggtgcttgcttggttgtggttggggtcgttgttacaaatacagattcatgtgtaaccaaaaggttacatatgaaaatccaaaagggcagtgaaatgaaaatccaaagcactctgttattcaaataccacttgcttatgcttttagtttttaaaaatttacaagtaaatataatccaggtagtctaaaaaagcacacaggatttcaaacaagataatgaaaatttgaacttcctggtttacttttccaggatctacctacttctcagtttttgccccagtccgttttgggaatggatcctctcacctaggacaatgagatggttattgttaatacaaacttggtacgttcttgggtagattcttggccaaaaaaaatctatggaagatcttgttatatcaccaaaacatttaataaagacagatgaatgactataatacaaaaaatggaaagcagtgctaattatcctttgcagtagataactggggacatcttccacatgtacattcccctaacacttcaaaacactgcactagcaatgccaaggatattgcattaatcatgttactgaaaagattctgcagatgtcacttcattttgtagatctgtaaagctaatgtgccttcttttcagaagcgtgccctctcagcattagaatccgctcatcagaggagtgggcaccaaagaatcctggctgttaggcagctccctagacttgagagcccatcttcccagggttggaggtctaatccagtgtcattaacagtgaattatcataattactgataaattcaccaagcaacctgattcttagggcttaaataaggtcattaacgggacaatccatacaagatccactccactgtacaggtctgaaacagacaactctctttatgttaaaaatcaaacgatgcggccaggcgcggtggctcatgcctatatcctagcactttgggaggctgagctgggtggatcacttaaggccaggagttggagaccagcctggccaacataacgaaaccttgtccctactaaaaatacaaaaattagccagggtggttatgtgtgcctgtagtcccagctacttgggagcctgaggcacaaaaatcacttgaacctgggaggcagaggttgcagtgaaccgagatcacaccactgcactccagcctgggcgacaaagtgagaccctgtctcaaaaaaaaaaaaaaatcaaatgatgcttcaaatccaaaaagttcacctctcttctcttgaaaacaaactacatggccatggccagatgtatatatgaatatccatatgttttacatctttaacattgcagataattaagtccatattactacagactcagtttatcacctcagcattctgtggcaaacaggcttgctggtgttagcaatgcagtttccacatctcaataaggatatgaaatgagatgattggcagagtaagaatatcttttgggaggctattaaaactccaaataaattatttaaagcttttattttgcttatctgctgagattagcaatacagtttgtttttaaaaaatattgtctatgaaaattatccctagtgcattatgtcatcacaaaaaagcagaagactagggcttctataaattgagaaatggattttgttaaatataccagttacttgctacagaaagtgctctgtccttcttaccaggggggaaaaatgttagcaaaaataatgccattatgtactgttttaatcttatttggtcctgtaagtaaagagagaaagaattttagacttaaaacatatccatctacatttcatttcaccttctgatttttagagacttgtagaacaatagtttttcacactatatggctttactaaaagataaaacttccccatgatgcaaatgcttccttacccaaaaagatgtagaattgtgcttagcaagtatttttttttattcctgatacctgctaatattgtgcccacactgataactagttttctacagtgtattccaatgtatctttacttttttcagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgacaaaa

SEQ ID NO: 425 - DNA, 121114 bp, Homo sapiens
aatttacctaatcccacgtccctaacggtcttcggaagcgaagcagtgtcaacagtccctggtaaacacaagtagtattacaagtcgggagctcttcaagtcttggatgagactgtagagcggtcttgtgcggcaatgtgctaccttaaaataaataaataaataaacccctgttatgtccggagtttgtttccacccggagaggaatggaagagcaccagagagcgcttagctttctggttggatgttttgggtgagtttcttggcgcgcatgcgtgttgtgtctcaagggcgggtttgaagggaagtgggtgttgacctgcgggcaactgacgctgttgtcagattacacccacgacggtgcgggtctcgggcgttctggagatacgtaggggtgaatttatgtttccgacgattgcatctggaggggtgtgtaagactctgtggctgaagaaagctattacgcttcttatgtgggtcattattttaaaaatagcatttcgcttttatttgcttgactgcctcttctcaacaaattttaagcccgccactacatgtgtttggttttgccctaccagctctggggttggggagtgcactgttatggttattgttgctcctgtggccattctcttgtcatccccactttcacattttggcgtggtgtattaatagactgagtgggattaatgggtaaatatgactttatagtcagctctaatcctggattcaatatcagaatttagattttcagctttgtggatgttcgacattttaaaaacagttattgcaaagaggtgaaaattttgttctgaagtcttaaggaaacagagaaagtttttccgtccttaagtgtgggacttgttttgtgaccaacaatatgaaaggctctgaggtcagcttggagaagaaaaaaaagattaagatgccagtgaagagacttcgtgaggtagtttctcaaaatcatggagatcatttggttttgctgaaagatgagttgccctgtgttcctccggcattgtctgcaaataaacgtcttcctgttggaacggggactagtttgaatggaacatcacgtggtatgtgattccatgtagtttttcaaccagttttagtttagtaaatctttagtccttatttgtttaaattcccaaacgtaagatataagtctagtttgtacagatgtttgaaaactgaccctgtttcccgggaaaatggccaggaagcctataaaatgtttgaatagatggaatgaatgaaactttaacgtcccctgttgtgctttttttttttttttttgcattgacttttgcatatttttttttttatatttatggtggatacacttaacttgtataatgtgctttattttcccccacgtagtgttttttatagttttcccccaaagtagtgctttttacctaattcactactttcttttcatagtgggaaaagcaggacttctgccaattgatggcttctatattccaattcacttaatctgtctagagctcagtgaaaataaggataacatatgctttacccacttcgctgctaattgtgaggattaaattaatgaatatgtgagcaaaaacagcaaaacgcttttgtaatgctgttctttgggggatacagcggtgacactcaaatagtactgctgttaaattagacctttacatcgtatacatatttctacccatagtttgtccacatccaatagtgtatggttatattttaaaatgtttcgtgcttaatctcactttattgtcagtaccgaaccttattttcccaaatatcaactgtaaaaactttcattcagatatgtttaaatacattttcttaactttttttgcatgcaaattgtctttccaacttctgcgttatatggagtttatagatcttgaatcatgcatatacagtttctaaagctaaggatctgattttaaaatcactaaaatctattcctttgttttgttaggttcatcagacttaacttctgctagaaattgttaccagcctctattagaaaatcccatggtgtcagaaagtgtaagcaaaaggattcttaattatgctcacgttaaaattttcagtattgtcaaataatgcattcttaaattatgtttgattagcagcatgccttgtttttatttaaatatcacttaccaaaacaaatgttttatatactacaattgtgactttgaatggtgtttgagacattaaacaaaaggccttccctagaatcaaaaatacctattagtaagataatggccgctgaaagagataggataactgaaaagaaactctcttactattcagggaaaaggtgttcttgcccagagacttaacatgttcttaggtaaaagaaaaggaacaactaacagtacaatttttctttaatgtgaggtgtgcttgcatgtcattctaacacttgtgagaatggttttggttttcttagaagggaggttctttaagaataacatgaaattatcatcttaactttataatgccgaaagtatttgataaatacaatgttttggttatgagatctaatcagactttgacggctaatcatagtgttgacctatgtattgtcagtttaataagtctgtataatgagagtttcacaatatgctattttgaaaattgaagctggcaaactaataattcaattgagactatatgacaattttgtcaaaagctcacaataaaatgtataattatttgctgtacttgatccctaagtaaatgcctagactttggagtgtttttttgttgttttgtcttttttttttttaagcaggccttatttaatgatatctaaacttctcaaatgtatggatacactgttattgtataattgagaataaatgggtgatcttcgtgatgttgtgccatccttatctactccatttgactcacagtgagtcagattttcacatttcactgaagcaactgagatgttaaatgacttgctctgctacaagtggcaaactggtttgagtctgaatctcagtgctacatttgcttgctggttcatttactcattcattcacttgtctgatagtgtattactcacccattcaacaaatctttgagtagctttaaggtacatcagaattgcatgatgatggaaatgaagaatatgaaatacacagtcctgccctcccagaacacagtagtcacatagctagtaaacggttcttgataaataataaatcatgaagtttatttagcctatttcttcctttcatatcccaaaggatttttctaaagacgttgcagtgcaagtgttgcctttggataaaatagaagagaacaacaagcaaaaaggtaaaagaataatattgatttttttaaattgtgacaacatatacataacataaagtttactactttaaaatgtacagttctgtgacagtaagtacattcacattgttgtacaatcatcatcacctttcatatccagagctttgtcatctctcccaactctacccattaaacactaactgctcatttttcatcccctcagccctgggcatcctactttttgtctctatgaatttgactaccctaggtacgttatataagtagaatcatatagtatttgaccttttgtgactggcttatttcacttagcataatgttttaaaggttcatccatgttgtagtatgtgtcagaattttcttcttaagggtagaatttatttttaaacatttattacgtagtcttatagtttttattattttcattttaaattagtttttcttcccaaattaagctatcactagaagctataaaatccagaataaggtttgcaatggtgaaggttatcttgttattaccaacctattgcagaggtttagtattagatatgtttataaattttttttttgagacggagtctccctctgttgtccaggctggggtgcagtggcgtaatctcagctcactgcaacctccagctcccgggttcaagcaattgtcctgcctcagcctcctgagtagctgggattacaggtgcacaccaccacacccagctaatttttctattttttttttgtagagacagggtttcaccatcttgaccagactggtctcaaactcctgacctcaagtgatctgcctacctcagcctcctaaagtgttgggattacaggcgtgagccaccgtgtctggctccatatgaattttaaaatagttttttctaattctgtgaaaaatgatgttggtaattgaataggaattgcattgaatctgtagatggctttgggcagtatggtcattttaacgatattgatttttctaattcatgagcatggaatgttttccacttatttgtgtcatctgtgatttttttcatcagtgttttatagttctccttgtagagatctttcaccttcttgattaaatgtattcctaggaattttattttttgtgtgccgctgttgtaaatggcattgagttcttgatttcattctcagcttgaatgttattagtgtatagaaacgctactgatttttgtacgttgattttgtatcctgaaactttacttaagtcatttatcagatctaggggcattttgtaggaatctttagggttttctaggtataggaccatgtcatcagtgaacagaggtaattggacttccttttactttttggatgccttttctttctttctctgtctgattgctctggctgggacttccactactgtattgaaaagagtggtaagagtgggcatccttgtcttgttctagttcttagggggaatgtgttcaacttttgcccgttcagtatgatgttggctgtgggtttgggattatgaggattatattattacttaatcacttaatttgttccttgtccttttcgatcgtggaatgctatggctgagttcctaaacattcttttagttaaaaaagatttttttagtagcttattaaagtttaataaatattcaggaatttaatatatatttttgtgtcttgattttgcagcaaatgacatcttcatttctcagtatacaatgggacagaaagatgctctaagaacagttttaaagcaaaagtaagtttcatttacagaaaataattggaccatttcttatgtaaatcagcttcatttgtactttggacatatgaaaaaccttttcactatgtgaaatatatattgtgtgatatgtataaagcatttctcatggtgctagacacgtataaaatactcagtagcagttagcagttattattatggaagtgctatagtattaactcatttaacacacttataaaatagatttactatcccaattttatagaatccccattttcttttatttatttatttatttagagatggagtctcgcgtcgcccaggctggagtgcagtggcacaatctcggctcactgcaacctctgcctcccaggttcaagcaatctcctgcctcagtctcccaagtagctgggattacaggcacctgccatcatgcccagctaatttttgtatatttgtagagatggggtttcactatgttggccaggctggtcttgaactcctggcctcaggtgatctacctgcttcggccctgcaaagtgctggggttacaggcgtgagccagtgcgccctgtggttaatttaattttgcgttagaatctaaggaagagccacactttacatttgaatgatatgtctcttaagtttgtttttgtttttgttttttttaagacagggtctcgctctgttgcctaggctggactgcaacctccacctcctgggttcaaacaattctcctgcctcagcctcctgagtagctgggattacaggcacacactaccacgcctggctattatttgtatttttagtagagatgaggtttcaccatgttggttaggctggtctcaaactcctgacctcaggtgatccgcccaccttggtctcccacagtgctgggattacaggtgtgagccaccatgatcagccttcagtttgttttaatctacagatttacccttatttcgtttttcttataatttgtttgtcttaagaaattttctaccttctggattttgctgaatgtatccttttgttgtctttaacatgtttctttcaaccttgaatttctgtcaagtggcaagaatgcttgataggtgatattatatacttcctgtgtaatacatcgggatacatagatatctgattttatctcttattgtgaaattaggattgatctgttaatacaccacctttttgtatcaaattacagcatatggaaatttgaggacaaagagtctaaacagtcaattttagaaatttagcaggaaaataatttcttataaaagctgaaggaagctgggcatggtggctcatgcctgtagtcctagcactttgggagtccaagacaggaggatcacttgagcccaagagtttgagaccagtctgggcaatatagctaatttttttaaattagccagatatggtggtgtgtgcctgtagtcccaggtacttgggaggctgaggtggaaggatcacttgggcctaggagtttgaggatgccatgagccatgttcatgccactgcactccagcctgggtgacagaatgagaccccgtctcatcagaaaaatagggagacagacagacagacagatgctgaatgataggaaaaaagcagggaaagcagaagaaatcaagtataccagataaaagaaaacataaacacagtagaatgttttcaactagttctagaagtacgtcagtgtaataagcaaatcttggacaagtctaagtcagaaaactggtgagagaatgcatgttagaagtaaaaagaggacataatgatagacttagaaggtattaagaatacagtgtattaagaatactgtgtacatgaatgctacaaattaagaaatctagatgaaagaaataactcaccaaaaataaccatataactaagaagattttaataggccagttactgggaaataaatttaaaaaaaaccttcaaagagcaatctccaaaagcagtcatgattttgtttgagttcttgaaaaattttaagaaacagattatgatcatgctatatattctgctccagagcaatgaaaagcaaagaatgcccctcatgtcattttatgatgctaacctagcccaagtatcaacacctaacaattagtttcatcagagatattttcatcatgctattgtaatttaaacaaacctagttctttaaataagttatgagtaaattatattttatcatatgttaaaagattaatacacagtgattggaatgcagcaatgttttaaaaatggtaatagcaaattctgatgtaacacttatgcaccagccactgtcctctgcacttctttatttttgttttactttctgttttttattttgttgagacaggatctcgctctgtcacccaggctggagttcatgggtaggttcacggctcactgcagccttgacctcccaggctcaagtaatcctacaacctgaggtccccctaaccgcccccccgccagagtagctgggactacaggcatgtgccaccacatccagctaacttttttactttttgtagatatagggtctcactatattgcccaggctggtctcaaactcctgggcacaagaagtcctcccgtctcagcctttgaaagtgcttgaattacaggcatgagccaacatacctggctgcacttcttacatactacttgatctttacaaaagcctagcacgtctaataatgtttcaagcttaaggaatagaagggtttaagtcacccaggcagtctctctccagagacagtgctcttaaccattgcgccactacaataattcatgatctattaatacatttatatcatttgatcaaataagaaaatatatgtggcaagcactacagtcacatttaatgacattttatgcccatatcttcttaatttttttattttttaaattgacaaataattgtacctatttgtagggtacgtagtgttgtacttataatgtgtagtgatcagatcatggtaattagcatatccatcatctgaaacatttatcatttctttgtgttaggaaccttcaatatcctccttttaaccgtgtaacacattattgttaactatactcatcctactatagtcattcctcctatctagctgtaacgtattcctgacttattcctcctatgtagctgtaattttgtatcctttaacaaatctctccctatgccccccttccatacccattttatactcagtcaccacatacacacataatacccacaaacttctttaagaatagaatgatacattccttttttgtttttttaagatggagtttcactcttgtcacccaggctggaatgcaacggtgtgatcttggctcactgcaacctccgcctccccagttcaagtgattctcctccctcagcctcctgagtaactgggattacaggcatgtgccaccatgcccggctgattttttgtatttttagtagagacggggttttgccatgttagccaggctggtctcaaactcctgaccttaggcgatctgcccaccttggccttctaaagtgctgggattacaggcttgacccatcgtgcccagccagaatgatacattcttaacatgaaggacaatgtttattggaaacctgcagtcaataccctgtttaacagtaaaattgggaacaagacaagatgtccattattttttaaacttaatttggaagccttagttgtagcagttagataagaaaatgaaatcagttatggatattgaaaaagaggaggcaaagttataatttgtagaaaatattgtgtattcagaatatccaagagaccactaactcagaaatttttacactaatggaagttcaggaaggtgaccagatactcagcatattattcaataataaaatgaaataacaattaccatagcaatgtccccaccgaaaaaaaaaaagttgggaatactcataaccagaagtctatagaatctgtctgaagaagtatgaaattttgtcaagggaaataaccaaaggctaagataaattaagagactcaacatgttcttggatgggaagactaagcgctgtaaaaatacaagttattacaaaattagcatatgtttggctgtggtcagtcttaaaattttttgttattttgagaataagtggtagatgtaaattggaaatgtaattctaacacttacctagaagaacatactgttgagaaaaaaaaagtatgtgcctgtgtgtatactgtatgtatatatttatactgtatatgtgtgtatatacatacacacagaattaaggatacatccatatagaatacattcagtttggaatagctaagataaatttggaaaagcaaaaacaaaaatgggatgatggagaacttgccttaattgatattataatgtactctaaagccttagaggaatgaagaatctggctagagtgtctagaacaacgggagaactcccttgtgtgtgactggagagataagcaagggactaggttatgaactcccctaaaggaatttggtctttaatataagataaatggcaaatcattgaaaagttttaaagaattagatatatttcttaaaatactcactctggtagccatatgaagaaatggattggaagagggctagactatagtccagcaaatgaattggctctggagttttcagggaggagtgagttagattggtcctgaatacactgggcagtggtggtatggtaatgggaatcatgctcagttggagaggaagagacaaatttggaagatgattaggagattgaattgacaggaatcattaattagatatgagggtaaggaaggcactaaggttgaatcccagatttttggctttcacaaatacatggtgagtagtattactcattgagaaaggaaatccttgtgggggataacttattctgggcatgggcaagggtttgaggttcctgtgagaaatgtgggtaagaagtgttcaggagaaaatggaatataaaggtcaagttgccagacagtggctcatgcctataatctcagcactttgggaggtcaagctgggaggatggcttgaacctaggagtttgagatcagcctgggcaacatagcaagaccccatctctaaaaacaataaattagccaggtggggtggcatgtgcttgtactcctcattacttgagaggctgaggcaggaggatcacttgagcccaagaggttgaggctgcagtgagccatggttatgctaatacactccagcctgggtgacagtgagatcctgtctcaaaaaaaaaaaaaaaaaaaaaaaaaggccaagttcacaaaagggatccaagctggaaattaagatgcagaagtcatcattatgtaagtggtagtctaagtctaagctctgggaatagttgaagtgattcaatgaggttatgatagtgaaagagagatggctagggctggatgcattctgagaaaaccaaacatttaaggagtatgtggagaaagcaagctagcttctaaatgctgctcagaaagtttggccagagatgtagggggtatggtgttaacaaagccaaggggaattaggttccaagtgtgatatgctgctccgaggtaatggaagctaagtactgaaaaatacactgaattgagcaagcaggattcttagtggctttggtgagaatagttgcagcatagcattgggatgttcagtgggtttaagaataaagaaaaactggctaaaaaagaagactagaatgaaataattgcttcttaatgggagggttatgtgcatttttttgacatttatatgtcgtagctctttacatttgccacattgagcatttattaatgtaataattggaaaaaataaaatttaaaagcctataaagaaatttatgtctagccttataatgtttctcttattgggcaaaggtaagtcactttcagacttcaggcagaaaccttaaaaataaggaattcctgaattatattttcatactctacccctcaattggttaaatatatatattgagcacttactacatacctaaccctttgttacttgctgtttggtatgaaagaagtcctgctaccattcccaaccccaggttgcttacagcttaattggggagataatatgtatatatatggaagaattagtgattaattacattcaatatattattaaattgtcccatacagatatttaaaccctgggatggctaagtagcaagcctccgttgataggtagtaaatgcaaaaggagttaatgaagggagagatcaagaggaagtgctagaagaacaggcttcttgaagaaggtagtacttgcattgcaccttaaaggaggagaaggatgtaataagttgggtggaagaagggtgagagagcagagtgaggcaaagtgtggagtcacttgtgggcatggcatggtatatgtagttagtgaggagtgcctcgtgtatggaaagccaaacagaggaaattagccaattcagttgtttataaggaataattttagatttttgaatggtgacgtgtaggaagtttctaagcaagtagaaactggaagaatggaatagttagtaataggtgatgaaaccttacggttgagagagagaagtgagaagggaaatgtgccaaactgagagaaaaagccctggtgtcatggtaagacctctgggaattgggccctaactctaccacttaataaatagttctatgacagtgatcaagtaaatcctgttacctctgtggactgccattgctttttttctttctttttttttgagacggagtctcgctctattgcccacgctggagtgcagtggcgtgatctcggttcactgcaagctccaactcctgggttcacgccattctccttcctcagcctccgtagtagctgtgactacaggcgcctgccaccacgcccggctacttttttgtattttttagtagagatggggtttcaccgtgttagccaggatggtctcgatctcctgacctcgtgatccgcccgcctcagcctcccaaagtgctgggattacaggcgtgagccaccgcgcctggccagactgccatttcttcatctgtaaaattaggaaattaggatatcctgtgacctctgtggactgcaatttcttcatctataaaattaggaaattaggatggatgtcctataagtttctctcagctctataattctatgacactcttcatgcaattgtgatgaaataattgacaactctttatgattcaattgggtatgagacggtaagcaagtagagaagtcaagatgacttcaacattttgagactgagagaaaaatgttattcttagtagaaatggggaaatatcaaagaggagtaagtttaagagttctgtgatgcccttaaaagtcgacggggaagtccagcagctggagatggaatgtattcctgccaattttacttagactctcttagggactcttcagttttgtcagtggttcctttcattgttttctttgaggccaaataccgagcaaattggctagccttcttttttctttcagtatttaattaaatgccttattgcaagtatgtatctatttgctggacttgttttcatttcagggtctttttttaatttttaattttttttttttttttctagagacagggtttgccatgttgcccagctggtcttgaactcctgggctcaagcagtcttcctgcctcagcctcccacagtgctaggattacaggcatgtagcactacacccacctaattcaggcttcttaataatgtattttgtgaacattttaataaactgagtgaccttcctttctttctgtcttgctttgctctgctctgcttttctcttttcttctttctctctctctctctcttcctccctccctccctctttcctgtcctgtcctgtcctttctttagactgagtttcgctcttgtcgcccaggctggaatgcaatggtgtgatctctgctcactgcaacctccgtctcctgggttcaagcgattctcctgcctcagcctcctgagtagctggtattacaggctcccgccatcacgcctggctaattttttgtatttttagtagagacagggttcaccatgttggtcaggctggtctcaaactcctgacctcaggtgatccacccgccttagcctcccaaagagctgggattacaggcgtgagccactgtgcctggcctacctgagtgatatttgttaagtaaatctaaatgacctagaattcagaaaattcttttcagtggtgttatcaatccctcttggggacattatgctaagtgaaataagccaggcacagaaagatgaatatcatgtattctcatttacatgtggaatctgaaaaagtcagacttatagaagcagaaagtagaatggtggttgccaggggctgggggtggggagaaagtgggggatagaggtcaaaaggtataatttctcttagacagggttaatacattctagagatctattgtacagcatgtaactatggttaataataatgaattgtatacttgaaaattgctaagacagtagatcttaaatgttctcatcacataaaaagataattatgtgaagtgatgggtatgctaatagcttgactataatcgttttacaatgtatacatatatcaaaatatcacactgtaaatatatacaattttttttcaattatacctcagtaaagtgggataaaaaatagtcacaaagtgtacatcaatagtgctgtaattcttacaattctttttttttttttttttttttctgggacagtgtctcactttgtctcacaggctggagtgatcacagtggggtgatcacaactcactgcagtctctacctcctcaggctcatgagatcctcccacctcagcctcccgagtagctgggactacaggtgtgtgccaccacacctggctaatttttgtattttttgtagagtcaggattttgccatgttgcccaggctggtctcgaactcctggccttaagctgtctgcccaccttggcctcccaaagtgctgggataacatgtgctagccactgcacctggccgataatgttataattcttatataaatatttggaggatgaaattatcaataatggaaaaaccacagcagcttgtctgaaggtaataagttatctcaattgattgttcacagtcagttacagaccaaactttttgttttattttatttttctggagacagagtctcgctgtgtcacccaggctagagtgcagtggtgccatctaggctcactgcaacctccgctgcccagattcaagtgattctcctgcctcagcctcgtgagtagctgggattacaggcatacaccaccatgcccagcgaattttttgtattttagtagagatggggtttcaccatgttgcctaggctagtctcaaactcctgagctccagcgatccacctgccttggcctcccaaagtgctagcgttataggcctgagccaccacacccggcacagaccagacttactccactttttctccccttctcactactgtacttgactagtctttaaaaaaataataaaagaaaaaagaaaacaatagtgtttcttgggttgtctgcctttaggagtaaagcttggtactttaattcttggagctttttctgagtagttttttttgtttgtttgttttgtttgtttgttttgagacagagtctcactgtgtcacccaggctggagtgcagtggcgcaatcctggctcactgcaaccttcgcctcctgggttctagtaattctcctgcctcagcctcctgagtggctaggactacaggcgcatgccaccacgcccggctaatttttgtatttttagtagagacggggtttcgccacgttagccaggctggcctctaactcctgacctggtgatccacctgccttggcctcccaaattgggattacaggcataatcccaccgtgccaccttgtgagtgttttaaatttgtacttcttgaaaatgtctttataattgtgctatgcctttttcatatgtttaattcttattttccaaaataatattgctaccttcaaggaattatcttcttatttctttagcccttagtgacctggaccttgataaattttgttaaccaaatgaccttgtttgataggtgatttaattaaaaaaaatcaaaaccaccttcggcagattaccatttgttaagtatttcttgaaatgtttcaatgtagtttactgaatacatttttattgcttttttatttatagagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtatatttttcttcccagataatcataactactttgtgaaatatagaagtacttactaagaactgattctataaatggttgtgtccagttatagactaggaacattgtagttgctctcaatttgaaagaattttcccatttgtggttgtgtgttacttctcaggaaatgtgaaaattaccctctaatactgtgatggcactggtgaatttagaactttcccagttttagcactgagagtcctacatcctgggaaacaccttggtcctggcaacctggataatcggttattcttatttgagagctagaggaaccttagagataatctatgccttagctgtcgctttgtaaatagggaagcagagaaacaggtcagagtaggcctatgagtctagaacgagtaagtgacagagccaaaactagaactcaaggctgctgacctaactcagccttatgttagtaaaatatcaaaagctactttgctttgctgttttcttctttttaatttccatttaagtgtcttgttttaggcatcataaaattatttgtggcagatttgtttgagacggagtctcactctgttgcccaggctgaagtgcagtggtgcgatctcagctcactgcaacctccgcctcctgggttcacgtgattcctctgcctcagcctcccgagtagctgggactacaggccgcacgccaccatgcctggctaattttttgtattttagtagagatgggggtttcaccgtgttggtcaggatggtctcgatctcctgacctcgtgatctgcctgccttggcctcccaaagtgctgggattagaggtgtgagccaccgcgcctggccaatttttttttcttttgtttgagaggaaacatttacctaaggatagctatcttctgcctttcatttctgtgactctaaaaataaaggcattaaatcattagacatttagtgggtaaaggctcaaattagatcacttatcaatgccaattgatttaaataacatttctagtaattagacatatttttggtatcctataatgtgaatttttaaaaatgtttttattgttttaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcaggtatctgtaataaatccagtacagattccataatcttttatcacttggatctctcagccagtattcattgataattacagtagctcattagattgtaacagttttagttctgaaatcatgatttgcttatctttcttctcctgtaatgcgggtaactctgaatgttatatctcaaatgtcactagttgtgtgagacctctccctctagttggcttttcctccttttacactatttttgttcatatcatttttattatttattttttgagatggagtttgctatggttgcccaggctgaagtacagtagtagaatctccagtcactacaacctccacctcctgggttcaggagattttcctgcctcagcctcccatatagttgggattacaggcgcacaccaccacgcccagctaatttttgtatttttagtagaggtggggtttcaccatgttggtcaggctggtctctaactcctgacctcaagtgatctgccttcctcggcctcccaaagtgctagagttacctgcgtgagctgccatgcccagccatatttttaagtgcttatatcatattgcaactattggtttacgtcagcagttttcagtctgggaatgtgcactagaattacttgaacagctttataaaaatatttgtgcttggcaggccaagctaagaggattgcttgaggccgagagttcaagataagcctggttgatgtagcaagacctcatctcttaggaaaaaaaaaaaaaaaaaaaaaaaaaaatttagcctggcatggtggcatgtgcctgtagtcccagatacttgagaggctgagactgccggagaccttgagtccaggagtttgcagttacagtgaactatgataatacaactgcacttcatcctagatgacagagtgagaccctatctcaaaaaaaaagaactatatacacacacacatacatacacacacacacacacacacacatatacacatacacaaacacacatgcttaggcctttcagtgattttgagccagcgattctgaggtagtgcctggcaatcattgaaagcttcataatgattctgatgcacaccgttggataagaactacctggtgtacatgtttgcttttgcatttaattaattaaaataatgaacatttttaatgccttttgagagtaaggcactgggctattataaaaagcattatcctcacaaggagctgtagcatactttcttatttattttggaatttctttttctttctttttcttttttttttttttgagacggagtctaactctgttgcccaggctggagtgcagtggtgtgttttcggctcactgcaacctccacctcccagattcaagtgattttcatgcttcagctacccgagtagctgggattgccagcctgcgccaccatgcccagctaatttttgtattttcagtagagacagggttctaccatgttggccagaccagtctcgaactcttggcctcaagtgatccacccatcatggcctcccaaagtgctggaattacagacgtgagccactgtgctcggcctattttggaatttctaactcctagaacacgacttagcactcagtaaactcttttttttttttttttttgagtgagtgagggaatgatcagcattgtaaatgtgttggttttaatttccttttttttctaatatgaaatttatttatttttttgagacagagttttgctcttatcgcccaaactggagtgcagtggcgcaatctcagttcactgcagcctccgcctcccatgttcaagcgattctcctgccacagcctcccaagtagctgggattacagacgcccaccaccatgcccagctaactttttatatttttagtagagatggggtttcaccatgttggccaggttggtctcaaactcctgacctcaggtgatccgcctgccttggcctcccaaagtgttgggattacagaagtgagtaaccgcgcctggcctactgtgcatttaaaaacttaaaaaaattaaaatataacattcaggctgggcacagtggctcatccctataatcccagcactttgggaggccgaggtgggtggatcacttgaggtcaggagttcaagaccagcctggccaacatggtgaaacctcatctctaccaaagatacaaaaaattagctgggcatggtggcacatgcctgtagtcccagctactcaggaggctgaggcaggggaatcacttgaatccggaaggcagaggttgcagtgagttgagattgggccactgtactccagcctgggtgacagagcaagactctatcttaacaacaacaacaaatgtatatatatgtgtgtgtgtatatatatacacacacatatatgtatatatctataacttaatgactttctaaattatatattttttaagacaaaaattcagaagaatgtactaaaataagtttattatacttaatatatcatcataaagtagacattaatttgctataattttcaagacttaacagggtttatcttgagcttttcatgtggttgaagataatattttattggaatgattatatgcataccaagtaaagtttagtaagtactccctgcatgactaaaattgagcacgcagcaaattatctagtgagagaccaggaatgagtctataaactattagtttatagataactttacttctttaagcctcaatttctttacctagaaaatattttctgttgttcaggataaaatgagatgacacatttgaaaagcacattgattccttaaggagtggctcctacttagtcctaagtacttacctgccatcatccatccttccataactaaatctgtaacttaatgactttctaattttggaagaatgaaatctgctaatttagatgtcttacttataaagcttataattacagagagagttgaagttttgtttacatactggatatattagttgttcagtaaatgcttaatgaaatgaaattagttgagtctgtttcatctgttttatgtagagggatctcaacacacttttagaaattctgtaaaactataaatttttttaggtttttcttggcctggcataaaactctattttgattattactcattgcatgcctgtatcaaagtatttcatgtgctccataaatatatacacctactgtgtactcacaaaaattaaaacaaaacaataaaaccctcttttttgaaaccagttttattagttaagatacttgctcatttcagatattttattttattttattttattttattttattttgttttattttattttgtttttgagatagagtcctgctctgtcacccaggctggagtgtagtggcaccatttcggctcactgccacctccgtgtcccgggttcaagtgattctcctgcctcagcctcctgagtagctgggattacaggctcccaccaccacacccagctaatttttgtatttttaggagagacggggtttcaccatgttggccagactggcctcgaactcctgacctcaggtgatccatttgccttggcctcccaaagtgctgggattacaggcttgagccactgcaccgggccccatttcaggtattttaataaatagtgctgaaaactatgttgtcactctagtttccatttatatacaaatgcatatattattgctgctgctaagcatggatgtttatttgagtactcactatcaatgattttcaaaccttgacctcaaacaaaatcctaccatttaggatataaaagatgggatgttttggtttaaaattctctgattcaagtagaggtttagggtgagggcctctccttcctggtcttctcttagccggctgcaatggcccctgagccatgtctgtggtagaaaggacagcactgaggtttagaatggttaaggaaaatgattaaggtcacacagcagagtcaggcttagtcagatctttgtgcttctacatctttccaatggcatcactgctgctactacagtggatacttgcaatgtaatacatatttttcattgtttattaaatgcagtaaattatgtttaactcctctaatatttcaatgtattttatcatctaactctttcaaatgatatttgaaaataataaaataatcttatttcttctagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaaggtaaaaatatgtagttctctatgaataaaaaatgtcagctgtgaattttctttgtgctacataagctgaaaacatatttcctgagcagtaggagtttttgttttataaaatttatttataggagtttttgttttataaaacaatttttttaaatgttctttttttaaaattgtgtttctcaggctaccttgtcttagataaaatgagttctttttttgcgtcaagtaatttttagtttattttgaaattttttaaattatggattatgttcttaactgattttaattaatctcataaattatcagaagcacttataaatttagaaaaaatttacttatttactacaaaaatgcttgtaaataaatcagttctcctgttctctgacaaactgcatatttgctctttcttgattctgtcagagcaactacctgagtacatttttaaaccatttctaaatattttcagaattagtaatgcaagtctgcttatcttgattgaattttaaaactctataataacaaaggaatacatggcttacttgttaaaactttagtatttaaaataaatgaataaatgtttttctaagttattgatatttgaataatgaactaaagaaaatcgagctactatccctttaatgatatacagatctatatagtacaatattttcagcacttgatttgttagaacagtgttgttttacagtcattaaagattgctcatgcttttaaggtgctttacattttgcaacaaatgagtggtccttacaaaactgttgtgcccagcactttgagaggccaaggtgagaggatcacttgagtccaggaattcgagaccaacctgggacatatagtgagatcctgtctctagaaataaaaataaaaaattatccaggtgtggtggcacatgcctatagtcccagttactttggaggctgaggtcggaggattgcctgagcccaggaggtagaagcttcagtgagctgtgatcatgcagctgtactccagcctgggtgacagagcaagaccctgtttcaaaaacaaaaaaacaaacaacaacaacaaagaactgttgtgaagtaatatgagtccatttttaagttatgaagagaggacagtgaagcacagaatggtgtgacttgcctgctcaaggttacctgacttgggagggaggatgtcagagctagggccagaactcagctttcagtatgacccagctgagtgccttctatagcagtggacacttttttcataactcaattccagagaatttcttgctgataattttgtttttcttaaacttgagttttcatgaaaaaggtgtctattttgttgattgtaaattgaatttttctttgtatatataaattacagtaacaaataaaagaaaataaagagtaaaaattcagtaaattaaacttttaatttttctatgctttttcttgggcaaatatcatgtttacatatttgtaattgtagcattttatacaacttttttactagcacataaaaagatttgccatattttatatagttgtcttcataattttaacttgtaatgactaaagggtggcctattgaataactattttacaatctacttgaccattatcctgtttcggatactcaggcagtttttaggttttcatcttcataaataatactgtaataaacatcatatttaaagcacattttctttcttttatgttatttccttagaataatttcataagagtaagattactaggttaaagtatataaaactttaattcttcctatacttattgccagatggtttatcagttttcactgccatgaaaagtatctgggcctgccagtttcaccgcagcttcagtagttctgaatattatcatatagattcgtatttactagatgtaagtgtacaatgtttgtagtcttcatttcttttgatttttaatggggtgaagttatttctctacacttaataatttgttcatcatttataattttgaatttatttttaaagtataggcaagagtaatatgctataatttttaaagctttttaaaagcaagttaagtttttaaaaaattttctgttaaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcgtgtcacagaggtaatagagacttttactagacctatcccaaattaggaaattgtcatgagattttctgtgcctagtagtaactgaagtgggatctctatttgtaatattttactttaaatgacccttgctgggaaaatcaagcttctttagattctttgtaaaagggtttggaggtatacatttataattattttatcttttacaggttattattacttaaacctttaatgaacaagttttgttaactttttttttttttttttttttctgagacggagtctcgctctgttgcccaggctggagtgcagtggtgcgatctcggctcactgcaagctccgcctcccgggttcaccccattctcctgcctcagcctccggattagctgggactatgggcgcccaccaccatacctggttaaattttttgtatttttagtaaaggcggggtttcaccgtgttagccaggatggtctcgataagttttgttaatttttatttattttttatgagacaaggtctcactctgtcacccagactggagtacaatggcgtgatcatggctcactgcagcctttacctcctcaggctcagttgatcttcccacttcagcctcctgagtagctgggactacaggtgcacgccaccacaccaggctaatttttgtatttttcatagagatggggtttcactatgtttcccaggctggtcacaaactcctgggctcaagcgatctgcccgcctcagcctcccaaagtgctgggattacagatgtgagccactgtgcctgggcaagttttgttattaataaataaaaaacaatgctttgctgaaggtaaggctgatcatttttagagcatgcttcctcatattgtttttaggtgtgaatttcaataataaaacgtagagaaacttaacattcatcaccatgttcacttggaaaaagtgctaatatatgaactttttttgagatgaagtctcgctctgtcacccgggctggagtgcagtggcaccatctcagctcactgcaacctccgcctcctaggttcaagcgattctcctgcgtcagcctcccgagtagctgggactacaggcgcccgccaccacgcctggctaattttttgtatttttagtagagacggggtttcaccatgttagccaggatggtctcgatctcctgacctcgtgatccacccaccttgggctctcaaagtgctgtgattacaggcgtgagctactgcgcccggccatatatgaactttttaacacagagcaagaacttttataagggacatgtattaaccaaacatcatatgttctcactcataaatgggagctaagctatgataatgcaaagccataagaatgacacaatggactttggggacttgtggggaaagggtgggaagcgggtgagggataaaagactacaaattgggttcagtgtatactgcttggatgatgggtgcaccaaaatcgcacaaatcaccaataaagaacttattcatgtaaccaaataccacctgttccccaaaaatctatggaaataaaaaaaattaaaagaaaaatagtatattacagagtcttaaaatgtaccccttctaacaaaagtaagtgaaatattaaactaaacactttaattcttggaatcatttaaatgcatgcaggtcttatcttagacacatttaaagaattttaagaaagtcacaagataataaaatctttaataaagaaggcaacctcacaccaaaaattattatgtagtcttactacatacaaacaaggctaaaggatagatccacttattggtactttgaagaaatagataaatctcttctttactaatttataaaagtcgtctattttactggacttcgtgatgatgacacttatcaaattccttttttctgtgatggaaataaatgtaggggtttttctatgaattcaaccttttacttacttgtttatgtatttttttgtagagacagggtcttgctttgttgcccaggctggtctcaaactcctggcctcaaacagtcctgctgccttggcctcccagagtgctgggattgcaggcatgagccattgcgcctggttgtggtatagtttttatgaggtgtaaatatttagttttatttgatgagtgtatttatggcctaaattgtaggctactttgtaggctataaattttttttttttttgagatggagtttcactcttgtcgcccaggctggagtgcgatggtgtgattttggcttgttgcaacctccgtgtcccaggttcaagcaattctcctgcctcagcctcccaagcagctgagattacaggcacgcaccaccatacccagctaattttttctatttttagtagagacggggtttctccatgttggtcaggctggtctcgaacttccgacctcagatgatccacccacctcagcctcccaatgtgctgggattacaggcatgagccactgcgcctggcttttaggctataaattgagtagataatcatcataagaagctaacttaggccagaatacaaatatgtgagatattatatacaagagaaatgaattagtatttggaaaatgatactatatctcttctatttcaggaaatgtaagactattggaacaaattttgaataataatgattctttgacaagaaaaagtgaatcatcaaacaccacctcactaactaggtcaaaaataggatggactcctgagaaaacaaacaggtaaaaacaagagattggaatgaaaactagattgaaaagagttttgttaagatttttcaaatttctttgggacttttaataaattatagcattgcttcttaaatttatcttagatttagttactattttttgatgctaatatatcttccccctttctataatatagctatgaaatgaatatctcattttttcaaaatgcaggttattaatttctaacgtatggattattcatttctgattaaatgatatctaggatttgtttcaaaaataatccaagataggttaggggcaagtaagttgggagtatagataaaatgaggctagccaaaagttaatgattgttgtagttaaatattgggtgtatggggttcattttagtattttctctatttttgtgtatatttgaaattttacataataaaaagttttaaaaaaatcaaatctgggccatgataattatatttatcttcaacatcttaaaaactacagtaataagaactagaggagccatatgttgagtaattttatgtggagatattgtatagtctatttacatgtaatgtaattactgataaggtaggatttgtgtctaccatgttgctttctatatgccttaggtcttagttcactgttcctcccttagtgccttcttttgtattagacattttctggttgcaccattttaattcttttgtcattttctctactattattttttgagttattttcttcgtggtcactccaggaattacaattaacatattaatttaaagcaatctaatttggattaatagtgatttaatttcaatattattcagaaactttgctccagtaaagccttgttccctccccttttcttctattattatcatacaaattacatctttatacattataagctcatctatgtagtctgataattattacttgatgcagctcttttaaatcagataggaaaagaaaagagatatgaacaaaaatacatatactggcttttatattcaactatatagttcatctttaacagtactctatttcttcatatggattcaagttagcccagtgtccttttattccaccctgaaggactcctgatagtatttcttatagggtaggtctgttagcagtgaattttctcagtttttgtttatctggtactgtcttaatttctttctcactttttcgttgtcatttaaacagacatttggtttctcatagttgtggaagctggaagttcaagatcaaggtgctggccgggttggtttcttttgaggcctttcttcttgacttgcaggtggcctccctcttgctgtctcttcacatggtcatccctctctgcacacacacccctggtgtcccctccttcacttttgaacaataattttgctacatacagaatttttggtagatgttctttttctttcagcattttgaatatgtcacctgactgccttttggactctgtggtttctgatgaggagttgtatgttggtgtgcttgatggtgtcccacaggtctctaagacttaatttttcttcatccatttttctttccccaattatcctcatattcctttcctcataatctcaattagcctgtcttaaagtttgttgattcttctgccaactcaaatatgatgctgagcccctctagtgaattatacatttcagttgttatatttttcaactgcagaatttctgtttgtcttttaaaaaaatgttttctatctctattgatcattctatatttggcaagacttcattcttatactttcctttaattttaaaactggtttcttttagtaatagctgatttatagtctttgcctagtaagtctaatatctgggattcctcaacagcagtttcttttgactgtgcttttttctgtgtttgggctctactttccagtttctttgtatgtctcataaatttttgttgaaaactgggcattttaaataatacagtgtggcaactctggaaattagattctttcacctcccagagtttattgttgctagttattgttgttgttgctgtttgtttagtgactttcctggactaattctgtgaagtctgtattctttgtcatgtgctcccactgaagtctctgttttgttagcttagtctgccagtgattggaaagagatttccttaactgccttgaactgataagtctccctctctttgccatggattacgtgtgtgtgtgtgtgtgtgtgtatgtgtgtgtgcgagtgcatgcacatgcatgtgctagagcatgcctccagtgcctggcagattatgagtctgttttagcctttcacttcctacttgcacagagcctcaaggtcggaagtgagtgattaggaccttcccaggtctctcttgggcatgtacatagccctgtatgtggactagaaggcatgaccttctagattcctaggaatatgttggagcttttcaaaactccactttggacatttcattgcctagatttttaacatttgttgaccacaatcttgtttgccccaactagtgtcactacctcacgctgctgagatgttaaacaattgccaccgttttttgaaaaatgccctggggatactttctcgctgagctagcagtgagtcagttcaaataaagacaaacactatgaatgagacttttaggagagcttgaaaccattctactgtctttagtggttgtgaggctgttggttttcgaggccgccacagagttgggaatagggtcccgagaatgaggcaagttaaaaaaattccataaagcttgctcttcttacctagagtcagccatttttcttgaataaatgctcctggggttcttgcaagtctttaatttccagaggttagaaaaacttgattttgatgatttttgctagggttctcattgtgcttatggagaagcagattttcagaatttcttactccaccaatctggaagtgcttctggatgttagcttcttgaaagcataaccttttcctgctccttttctgctacatctaaacttttctggttagataattttgtctcttgtgattttctgtgtttcatttgtttaatcacataactgattaattccatagttcaattttaataggataccatttagtaatatagctaagactgtatcaaagatttgtgtaatgaaatgtttactgaatttacaacaatttaggaaactttttcaaaaatcttctgtagcgttgaaactctaccttctcaaagatttccttcctgtgaagagctagaaacaactaaagtgactatgcagaagtctgatgatgttcttcatgaccttggccaaaaagagaaagaaacaaatagcatggtccaggtaaagtgggaatggtcttaaaattgatgattagttaagataaaaattaaaaaggaataaaagagttataaagatagaaattaggaggaaggatgaagaaaaagcactgaaaaagatatgtcagccacatctgttccatttataaagtatttccagaggccttcaccaagtgatttctacttatcgctccttgaccaggactgagccatatagccacctctggcttcccagcttctgttggaaagggaggaaggggaaaagagacctgtgagtgaatggacttcatttatccaatccacaatgtctgccatttcttccatacataaagagccaacttgcttatattttactttattttgctttcttcagcagagagagagagctattattggtcgctggactgcttagcactgctatggatttctcacctctattttatttaacactcacattagttttttttcttttctttttttgagtcagagtcttgctctgtcacccaggctggagtgcaagggtgcaatctcggcttactgcaacctccacctcccggttcaagcaattcttctacctcagcctcctgagcagctgggattacaagggtgtgccaccacacctggctaatttttgtatttttagtagagacagggtttcaccatgttggccaggctggtcttgaactcctgacctcaggtgatccacctgcctcggcctcccaaagtgttgggattacaggcgtgagccaccatgcctggcccacattagtatttctaaatggaggaaaaacactttgattgccaagtattcttttgtaagtcttcagtttgacaaattgagtccttagaatatattggtataatgtatggcctcaacaatagtgatagctgttattttgattaaaggaatcgttgtgagtttagtaactttctggtctttttttcttttaagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacaggtaagaggatgttggcatccagggttatttatgagtctgtcagttccactttcttcataatttttttctaagcactgtattttcctattagttttcatatttttaaaaggttctttattgactttgaagatgtggaacttataaagttggaatttggatatatatatatggtggtactacttttttctggtggaaatttttcttttaattttttctttctttggtacatatcttcttggatccacatgtgcttttcaaacatttatccttcaaatatttgatgaaaactaataccatgaaaacaaatagcaaaggtttttccttttcagatgaaggatattaggcccccattctactatcctaatatcctttccttttcagatgaaagatattaggatagcaggttcacaactagataagagttagatctgatccaagtcctgctcaggacagtaagtgctaatttaagaaaattcctttttctcttttatagagagatgtcagagaaaattaggatcagaaagacagtggatgaatggattaaaactatttctgcagaaattcaggtatgtcttggaaaaaaactgaaaattaagtgaattctcagaagataatattgattccaatttacaggcattacatttgttttcaaaatatttcttatataaaaatccacttatttttaatttaattgtcactctttatatttacttagtaataagtttagctttgtttaacaagtatattatctccacttatattctggctcttatttggcaaattgttggacaaaaactaaaacatgaataatctgaaagaaaatttagcaaaagtgtttggaaaaagaattatacttgcaaagatatttgaagacagtggatttaggagcattgacccgccaaagtaaaaataccagagtaatgcaaagagaaaaaaaccaacgagatttactaagtttacggaagtcagttccagatggaaaaacagcctctttctcacaaccacaatgggcatggtacatcttcaaacatccagcattggaaaagtctgggagttatctttcttagagggtccataatttaaaggaaatttaaaaattttatatatttgagtgagcggaactaggcaggctaaggtgttattttgtcctggggtgcaaggtgtgtttttttgactgtagatgtgcttatatgctacttacaagggtagcaaggtgaagcatcagtactgtttccatagcaataaacacagaaatatattttaaaactttgttgttgaagaatatatatttctaatgaagttatgaaaaatttattttaggtactatatggtacacacacaaaaaaaaattgaactaagagtcagaagatttggagtctagttttcgctctacagctaactggcaatgtatcttactcttttgcaatgaatcccatgtaaagtatatttgtttaaactttcacataattttaatttatatttatctcagttttgttacaaaagtgtttgctttttttgaaatgtatttttaattttttaaactgttagcaaaattcatatggttcaaacatcaaaaagtataagaaggtttgtcatgcaaagttgtcctgctacccctgcaacccttctattatttcccattccccactccaaaagatactagtctttttagggttttgtttatttttccagagatttttgatttttatatatccaataaagccaatatcctttatttttaatgcatttaaaactgctaaactgtatttatatagcagcaaaaaataaattctaatactttctgatgtgaaagcattactatttgtagacattttaagtaattttaactttggttatgttaaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagtaagatcctaatctgttcttttaacataattgttgtgttataattgatcatttcctttaagagataaataatgaagcgaatgtgaaggtgttttaaaaatatgaaggactatacaaatgtaagctatctttacactattgatacttagggttttggatttataatgtgaaaagcactgaacaaaatagatagttcctttcttatgagatctcacaccctggcatcatgattttgtagttatagcaggtataaaggtatatctagagatcatctagtccaaaaactagattctctagtttatggtactcaaaattttcatttgcgtgtgtgtatatagtttatttttcagtttaacaaatgcatgtttagtgcctagtatatgcaaggcgtggtactagatggtatggaggaaatttttttgactgctgtaactaggctataagtttctaagtgccaaacatggattgttgagcagatcagtaaagcatctaattcaatgcttatacttagtagattctcagtaaatgctccctttctgtgacatttagattatggttgaaggtgggttcagaaatatataaaattatttaaaggttaaggttgttgtatttttattgtactggagtataataaatatgtaaaatgtgtttaaatgtttcttgttggtgctgaaaatatacttagtaatgtaaaaattttcatgtttcttaggtggatgatttttatatttaaagcttttcaaactaatgcttgaaacctgttatctagaatttaagggctgttgaaaacagaggttattttttacttaatcattcttgttataatacttaagctagcaaaaggaggctttagaaaaatgagataagtgtttgatgactgttttcatggtgagttgaataactttgtacacacaggggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggtaaggaatctcatttttaatgtttaatctcatttcttaatagtatcagtttaatatgtaaagtttctttttgctttttatttattgcttatacgtgccattcaagttatatgatgcttggggatggaaaaataattcctcttaggagaggtaggaagaaatagaccaacattttaaaaaagacacaagataggaataattgggaagaaatgtaggattaaatggcatcttcagataaagcatcataaaatttttatttaggagaaaatgattttttttttaattttttttttagacaaggtctcaccctatcccccaggctggaatgcagtggcacaatcatggttcactgcagcctcgacctactgggctcaagtgatcctcccctctcagcctcccaagtagctgggatgacaggtgcacactaccacgcctggctaatttttttgtatgttttatagagacagggtttcaccacattgcccacagtgggtgatgatgaatcttgagcatctaaattataatctaggaaagtagacattttcctgaagacctaggtgcattatgaacagaaagatcagccatttgctgtttattataaaagtgttgatgagcacttttgcagtttggttttcaaagagacttaggtagaaaggtgaaaacttttttgttgcttttgtgcacaactgaaaacatcttcatgtatcactgtgtattttgagtcacatctactgtttcactggtactgtgtatttaaatacaacttttggttatatactgagtctgttgactttggttatgtattatagtttctcagcttctgcttagcaatcagtaagctacagctgacaatatgtgataactagtagatacaaacccattttcctctcttatcctttctagaagttggagctatggtggttactttggttccctttgctttctaaaggttatgcaatcatatacagtgtcaggttatatagaaattttactaatttaaaatagaaagcatatagcttatgggtgatatttatcctaatggatggtatttaccctgaagttttctcttatttagtgtagttttgctttttttttttttttttttgagacggagtcttgctctgtcatccaggctggagtgcagtggcacagtcttggctcactgcaacctccacctcccgggttcaaacgattctcctgcctcagcctcccgagtagctgggattacaggcatgcgccacaatgcccagctaattttttttttgtatttttagtagagacagggttttgccacattggccaggctcgtcttgaactcctgacctcaggtgatccacccgcctcagcctcccagagagctgggattacaggcgtgagccactgtgcccggcctagtgtagctttgctattaatttatatggggggttttgaaagtctttgcaaaaaataatttgaggctttaaaatgctttcaaatccaaaaataactttattcaataacgcttttaatgatcagaagtgattaagagcctgtattagttcattttcacactgctataaaaaactacctgagactgagtaatctataaagacaagaaggtgtaattgactcacagctccacatctctggggaggcctcagaaaacttagagtcatggcgaagggaagcaaggcatgtcttatatggcagcaggagagagggagcaaagaaagccatgcccttttaaagcatcagatctcatgagaactcattcactatcacaagaacaaattaggggaaactgcccccatgatccagtcatctcccaccaggtctctcccgtgacgcatggggatcaatttgagatgagatttgggtagggacacagagccaagccatatcagaacctaaggacttatgcttatcctagggcctcagtacctgccacttcctctgtctggagagctcttcgttcagacacttgcatggttctctctctcaattcttccgtctccgctcttagatgatagctccttagagtgctctaccctgaccattctattcaaagaattatctcctgttcctctccatctcctcactctgccatattgttcttcatggcacttcacatttcctgtgttatatttttatttgtttgttttattatttatttgtcactactggactgtaagctccatgagtacagttggtttagtcacctctgtattccttgtgccagaaacaatgtttaacacatattaaatgctgaacaaacattttaaataaacacttaagaaaaatattcattcaatagaatgactatcagagaacaagatgaaagaatatagacatggtattacaatttttcttcctggggtcataaacaaaaagaaactatatttaaaagtctggatgtgtaggttgggcacagtggctcatgcctgtaatcccagcactttgggaggctgaggcaagaggattgcttgagaccagcctcagcaacatagctagatcctgtctctacaataaattaaaaaaattagcagggcatgcctgtagtcccagctacttgggaggctgaggtgggaggatcacttcagcacttgagcttaggaattcaaggttgcagtgagctatgatagtgccactgcactccagcctgggtaactgagcaagaccctgtctctaaaaaaaaaaaaattagatacattaaaaaattagatacatagaaacacccacatgtgaagtggaagtgtaggtgacggtctgagacatcaccaccaacctgggcactggggagatggccaagactgaccccaagaccttgcaggacctcacctcggtggtgtagacacccctgcagcagatgcaagataaatttcagactatgaccagataattgggagaattgatgatatgagtagtcacattgatgatctggagaagaacatcacagaccccatgacacaggctgggctggaagaactggaaggtgaaaacaagatacctgccacacaaaagagttgagggttgctaataatttatataatggaatctggaacatcatttttctgagccaagagaagactgaatggcttttttcagctaactactgtgtgtagacaggttttatattataaagtgtgcattcttatcacatactatatagttagtttataaaggtttatcccccagtttcttgaatgtggtatcttcacatcttggaccttggtcagttgtactattaattattaaaaactaaaactttggcagttcctgcatttaaaaaaaaaaaagcacccacatgttaaaagtaaaaatgtaatgtcaggaaattattaagaaaatattttagcctcttcctttgcccgcttactttattctttacttttttgtgtgtgtgttccatagacatttattcacttctccaaagagacataaagtcaaatttttaatattttaagatttaggatataatggctatatgtgtatgtatacatcataggaacagaaaaaaatgtacagcagtccccccttattcatgggggatgtgtcccaataccctcaatggatgcctgaaactgtggatagtaccaagccctaacatgtactatgttcttttaatctgataactgagatggtaactaagttattaatgggcaggtagtgtctacagtgtagagaccccagacaaagggatgattcatgtcctgggcaggatggagcaggacggcatgagattttatcgcgctactcagaacagcgtacattgtaaaacttatgacagccgggcatggtggcatgcgtctgtggtcttggctactcgggaggctagggtgggaggatcacttgagcctgggaggcagaggttgcattgagctaagatcgcaccactgcactccagcctgggtagagtgagactccatctaaaaaaaattaatgaataatttttaaatacttatgaattgtttatttctcaaactttccattaatattttccagccaaggttgatcctgggtaattgagacagggaaagagaaaccacagataaggagagactactgtataatgatattaattagtaaggtttaagtaagtatagaatttgattgtctgtacataatttaaaaagataaagctggttattcagaattatgttgtgtgtaaaggtgtaatgagaaaatgaaaatcatcaattccaaaaatgatcattaactttttcgtacctatggaaaaaaatttaaagaattcaaacattgttggaatattcttcagaatctttatttaacatttttttctagttattatatctattttgtcacagtagctgtacaagttgtatgtctattcaggggctggcaactgtggcctacacgtgagctgcctgtttttataaagtttcatttgcctctaactgtgttcattcatgtatatattgtccatggcttctttcatgacacaacagcagaactgagtcattacagctgagatcacgtggcctgccagacaaatatttactgtctggccatttaagaagtttgctacctctggtctatatattacttctgttttggggccttgtaaccttatatagaattaagatttttctgtgaagagctgttgtatttctagatgtctggatagtagatattctaacaatattttaaaatatctgccattggtgattattataggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggtaagaatcaacaaaatatgtgggatggattttattttatttatttatttgtttgtttgtgtgtttattagagacggggtttcactgtgtggctcagagtggtctggaactcctggactcaagcagtccacccacctcaacctctcaaagtgctgggattacaggcgtgaggcaccgtgcccagccattgaattttaaattcttatcagcagtagcagaacttacaaaatggtactaacatgatagtcatctaccttttcttgtaaatgttatttgtttttgtggggaaggcctcacaatgtattttatgctgtgtaatagcaatctctgaaatgatgggttcctgctgtagtttcaccaataggaaaaattcttttggtatgttatattattgtagatgaaatgaaattttaaacaatattttggctgggcacagtggctcatgcctttaatcacagtactttgggaagccgagatgggaggattgcttgagaccaagagtttgagaccagcctgggcaacatagcaagaccttgtctcaaaaaaaaaaattagctgggcttgatggctaacacctgtagtcctagctactctggaggctgaagcaggagaatcccttcagtccaggagtttgaggctgcagtgagcaatgattatgccactgtactccagcctggacaacacagcaagaccctgtctcttaaaaaagaaagtttaaatatgtcatggacattcataataattcaataagtttgattatcttgttaatatcattatgtctttggggaagtattaaggtacttttttttgtacttttgaactaggctatcataagtgaaagctgtgtgggtgtgtaatctaagccaatagttgtttatttacttatttgccttctctctgagtcttcatgttaaaaattgaacagatcatttttgtcctcacaccagctgttcaagtctaattagctcttttttccctttagtgtcattgctgttcttttgttttgattaacaatttaagtatgaatattttttaatgtaagagacttttttatttttgatattatgggttaatttcatgtcaacataatagctctctgtttaaacatatctcctagtaataaaatagctcacacttttaaagttcttactgtgtgcccggtacagttctgagcactttacatatattctctcatttaatccaccctataaagcacatggtaatatacaaattgtatagctaagaaaactgaagcacaaaagggttacataatttgtcaaaggctacacagctagaatggtgccaggattcaaacccaggcagaggcagtctggctttatagtctgtgttttcaacaagtacactgtactacccctctttactttgatatgtagaagtcaagtgggactttggaagtgaaagtttttgacattttaaaatgtggatagtattaatagctttctattagcctttattttgaggtttaaattagatagtgatgtgaagcgttgagtacatataagtgcttaataaaagtcactgggtatggtgagtatgtcgacagtgctgatgatggagggaggggtgattgtcagatagggcttttttaaatatgagaatatagccattaagatccagatggtatattagacttttccctttttttctgaactagttgacttattttttctcctaaacttcttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtatgccagggtgcatgagtagaaaattttaaggaagaaaaaatttttttgcttaacgttagtacggaaatccattatattgcttcataaaaatattgcttttgatcatgactcttttttttaaatttatttttattttttagacagagttttgctcttgtcgcccagtctggagggcaatggcgcaatctcggctcactgcaacctctgcctcttgggttcaagtgattctcctgcctcagcctcctgagtagctgggattacaggcgcccgccaccatgcccagctaattttttgtatttttttttagtagagatggggtttcatatgttggccaggcttgtctcaaactcctgacctcaggtgaatccacctgcattggcctcccaaagtgctgggattacaggcatgagccaccatgccccgctggctctgttatttttaaaactgtgatattaatatgatgtttctgtcctgttttgcatgatttaagctgctcttctaggccaatgacttatatacaagtggcttggtgatattccaaggggaacaattgaactgtgtattataattaattttaaaaagttaatatatgtgacttatataattaatacttcaaactttacactaacatatgttagaagacttgaatgaatacaagacttcaacaggctcatgtgggaagaaaccctttgacatttcacaaacatctacccttcggcctgggatccagctgtagaagctgaggtcttcactaggtctggacaaaggtgaacatgagtatttacatgcgactttctattgaccagtcaggaggcaactgtaggaaagcattcatgaactgtggtaaactttttggctgatttactccaactcctgtattcgtcttaccatccttgcttacttacaaataattagaacactccagtccttagactgctccaaggttcctcttttgattgagccaggacaaatgagttttcttgggcaacttagtatgccctctgggaagagagaagacttgcctcattcttggatcctgatcactgaggagaagataatcctggagctgtcggatgccaccacatgaacagtcaacaggctcttagtactgatttttgactggacactcctccctgaacaaacgaactatccatttcttctgcacaaatttatacagaacagcctcaacccaccagcctgagagattcccagggacttagaaatcacccatgtagctccacaaacacttcgttctcatagattgacttccaccctgcagctaaaattgatagtgtgttttcacagccaagttgttagggctgaggcagtcaatggatctcaggaatattcccggccctgtgcttgataggagcaaatgcacaataaagccctggctgcagaatctttcaacttccagtcattcttgcagggcagggaactcccaacatgaacccaagtgtgttcctctcttatagcagtctttgggcatccttctgacagcgtaggcccactaacccagtggtgcagcagctatggaggcttcgggagacctggggacacttcagcctggacagctccctgagccaagtacaaacccggtcaatgtgtattgaacgaatgagcatcactagcacagtcagtccatggaggaaattagaggatctagatcagggggcaaagaatcctgaattaaaaggcaaacaacacacagtaagaacatatgaaacgaagatgctagtaaagcattaatttttaaatataaagatctctataaattaataagaaaacacagatccaagtctagaaatgttcaaaggacatgaataagactctacaaaagaggaagtacagtttatcagcaagcaaactaaataagttttgccagtaaccaagataatgcaaattgaaataacaataagatgcatccatttaaaaactattattgctgaaacaatcatattatctaattttggtgagggttgggtaaaacttagacttaattatgtttttgatgatgtaaatagaggttgttaggattacatttcaccagtacttccaagaatcttaagtattcgtgtcctgtggcccagaaagttaatccaatatctggctatctagtatagtgaattaatttagggtttaggaagaaaatgtgtgtgtgtgtgtgtgtgtttatgtgtgtgtaagttttttttgtagtgatatatatataatagtggaaaaattggaaatttcctaaatttttccaattgaaacataattaaataattaagacatgtttgttgaaatgttatatagtcatttaaaaatataattatgaagtctatacaaaagcatgataagtgtttatggttcttgtaatcaaaatgaaaaatcaagaatgaaaactattttaaattttagttatgtataagtagatagtaaaagacaaagggaatagtgaaaatgaagtcatcttaagatagaattttgtgtgttttcctctttatttttcatattttataaaatatgctttcataattaaaaaattttgttatccattgggttcacaataaaaacttaaagggcatgctttgtttttatgtatatgtgtatacacacacacatatacatgtatatacacatactcataaaaatatttgagtaaaaatgataaacagaaagctgaatgttgtattctgttttaggtattacccagtgtagatattgacagcatttcaaatagtagtgctgatgtcctttcacctctgtctagccccaaagaagcatctcttcctcctgtgcaaacttggataaaggtatatttcagaattttatcatattattttgagtaatgtctgactgtagattttaactaattactccatttaaagccttttatcataatgataacttataataatttagattttgaagaaaagattgaaaacaattttttttttttcagtcagagtcttgctctgtcgcccaggctggagtgcagtggtgtgatctcagctcactgcaacctccgcctcccgggttcaaccaattctcctgcctcagcctcctgagtagctgggattacaggtgcctgccaccacgcccggctaatttttgtatttttagtagagatggggtttcaccatgctggccaggctgatcttgaactcctgactccaagtgatccctctacctcggcctcccaagttcgggaattacaggcgtgagccaccacgccagcccaaaacaaattttgaattgtttatgaacttgaaagtttgtttcagatccttacatttataactatttggaaagtgataatctttagtgtaactttttggtaatttaagttgtgaaactctcatgtgaagaaagaatttctgtcactttggtgatgaatctttgatttacatgggaattatagatatcctaaatgaattttatagtgacagttgggagtttatattttggaatgttaccttgttatcccactgttgacatgatacaaaaatatgcatttcttcctggcatttatttgcttttgaataatgaagttatggctttactacacagcaaaatagcactgtaacttaccccaggttttgtttattgtaagcaaacttggccaagggtacagttttaaaaggagagagaataccagcaatctttcatgatcataagtaatgaaatagaactgtccgtaagtgacatttgtgcttaattgaattttttcatcagtatttttttttaaccttctgtttattgaaacttctgtgataacaagcaataaatttttggactgtttatcattctgctgtcagtaagaggctattgcatgactacattttatataatgaggcctaatgattagatttgtaaaatgactattttgttttttttcctgaattatttgattctgtatccatcttcatgtgagttcatatatgtttatacttagagatctacacatgtaaacactttcctttatcttaattctggaagagaagtctcaattatatcaacctgttgatcaattaagtgatattgctgatggagtcctttacagaaaaacagctgattaattttttaaagctattgaaatgttgacctaatggcttggggactagcttggatttcatttactaattaaatcaattctgaatagggtattaaaatgattaaaaaggaccatgtaattataagcttatactataggtggaaatatgataaattacttataaattttaaaagtgttaagcacaacaaaaactttctgaaaatgctttcttagactccagaaattatgaaggtagatgaagaagaggtgaagtttccaggaactaactttgatgaaataatcgatgtcatacaggtaacaaagcttagaaaccatgagaaattatttttctaccggtatttttccaggttgttgactatctttggactatcaatattatgttacagtgctttgagatactttcttttacttttgagttaaatatacttttaaaaattataaagttgttattctagaatgtctttaatctatatcacctatctgccttcatgaagcttcatgattatctgccgttccccacctagattttgtctatctgtttcctgctttcttctttctttccacttcctttggcttcttttcctccaatttgtctttttttctttctgttaattttggtttttggattcatggtgaggtgactagttaattgatattgagaaaaaagttgtgagaaatctataatccaaaggaatatcccatatggaaggaagagttatagaaatgatagaaataatgaaatagagggaaaaataggtggaagtaaattataaaggatgggacaaaagatcatagaacattgaaactacttgaccattatgtcattagactttaaagaacacatttgatcaagtttctttgacttttagagctaagatcagttttgttaatcataaaatgaaatccaattttagaatatacagaggtgtgcagtatattaatgttattcgctcacagatatgtcttttctcatgtgagtgccacatgagaattttgaagacagggaccttatttatttttatattcctaatgcctagcaaaggtacttggtaattgtttatgcaatatacaagcgaaagaaatggttatagaagtagcagagaatttagcattcaaagacaagtgttcctgtattagctctgccatttataagctgtggacttcatttttcaatggaataatattactgagttgtactatttagagagacccaaagtgtttttgattgaattatttatagataaaatgatgtgatatctgtgatttgcttcaaaatgatatgtgaaggggaaagtggctagatgagacaagattgaccataagttgataattgttaaagctggggagcggataaatgcaattcatgttatttatgtaacagatacagtacaaggacactatttgtttacttttaaacacatatgatttttttgtaataaaaactttaacaattccagaaataactctattggttatgatgtggtaatgcaaataatttgtaagatgactgaccttattgcatatttaaatgtaaattataagttgtataagagcaaaaagtgattttggaagtgtattagtgtattttgcattgttataaaggaattactgggtaatttataaagaaaagagacttaaggccaggtacagtggctcatgcctgtaatcccagcactttgggaggctgaggcaggtggattacctgaggtcaggagttcaggaccagcctggccaagatggtgaaaccccatctctaccaaaaatacaaaaattagctaggcatagtggtgggcgcctgtaatgccagcatctcgggaggctgagacaggagaattgcttgaacccaggaggtggaggttgcagtgagctgagatcgcaccattggactccagcctgggtgacaagagtgaaactctgtcttaaagaaaaaaaaaaagtaaagagatttaattggctcgtggctctgcaggctgtacaagaagcatggtgccagcaactacttctggtcaggacctcaggaagttttactcagatagaaggctgtgagggtccagatgtgtcacaaagcaagggagggagcaagagagagaggaggatgtgccagtctcctttaaacaatcagctctcatatgaactaacttattaccatggggagggcaccaagccattcatgagggatctgcccccaagacccaagcaccgcccaccaggccccatctccaacactggggatcacacttcaacatgagatttggaggggacaaatatccaaaccatatcaggaagcatcaattttttaacgataattattaagcatacatttctagagagaaataatagtgttttatgtaggaataattatgttttctagtttattttgtgattgcataaaatgaatattgggttctaaaaagacaaactgattgtgtaattaagggttcctcaatatgatatgtctgactaatgtgtatattataattaatgtgataccacctaattagaaatgctgttggttaatttagaagggtttcttaattcacctagttccttgcctatagttggtactcagtaaatgttgaacaaatacatgaatataatagttttgtttttgttactaccaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatggtaagtttataatgtttttggtatgaatagaaccatagtagaaaatataaatggaaagtattaaaatgtggctgaaaatattccttgtcttcttttgtttattaaactttctttgctttagtcactggaaagtgtttgatataatgctgagggcttaactattgttggaggttattgtttttgtccttgaatatttgtactcaatctgtctactctggcacaagtagactattaggaagccttaaaaatgtacatgttctttaatccagtgattcatttccagaaacttatcctaaagaagtaattatggtttgctgctaggccagggccacgaaccagtaccagtctgtggcctgttaggaaccagggaactaagctgcacagcaggaggtgagcagcgggtgagtgagcattactgcctgagctccacctcctgtcagatcagctgtggcattagatttcatagaagcacaaaccctattgtaaactgtgcatgtgagggatctaggttgcacgctccctatgagaatctaatgcttgatgatctgaggtgaaacagtttcctcccgaatctatccccccaccccctaccccaccacccctgccctggtctgtggaaaaattgtctaccacaaaaccaatccctgatgccaaaaaggttgggactgctatactaggccatataatacctagcactacaaagagggcactgttctaggtttgttacatactgataacaacaagctgtaatatgttattattgttacatattacaataacaattgtaacttgttacatatgaatatgaaatgaacgctattatttgtatttttacttgtaagaaaccttaaggaagttatggaataagtgaaatggctgaatattaatatagtcatgaaaattaggtttagaagaaatttaatgatataaaaagatattaataatgtactggcatataaacaaagcaggatactaacaatgtaaccccagtttacaagatcttactcaaaagtaagtaggcagctagcacagtggctcatgcctgtaatcccagcactttgagaggccaaggtgagtggatcacctgaggtcaggagttcgagaccagcctgaccaacatgatgaaaccccgtcactactgaaaaaatacaaaaattaggtgcgatggtgcacacctgtggtccctgccactcgggagactgagacaggagaatcgcttgaacctgggaggtggatgttgcagtgagctgagactgtgccactgcactccagactgggcgaaagagtgagattctgtctcaaaacaaaacaaaacaaaaaactgtgcataaaacaaaagtttgaaaaagcatacataccaaattaactgtgtttattgctgaacctaggattataggtgagctttatcaattttttaaactcttacatttttttctaaattttctacaatgaacacctattatttatataataatttttaagaagtctattaactgcactaaagaaatgttctagaagtctcctgttcccctttcccttcctgaagatgactttggaaataaattttttctttacattttaagaggaaaactacctataatacagcctatatgtgtattaccgtgaagaaagggcagctggacatcttttctagctctgatctgatatggtttttatgtgtgcactcagagtggaaatcaaacagtttaggtacatgatatgccagatagtcattggcccaagtcttattttgagtttaggagttcttttaagcttttcattagactaatctgaaagattttaatttgatttcataaactatctcccacaaggagattctgtttagtgtgttttatcttcttcagaggtactttttttttttttttttgagacagggtctcactctattgcctaggctgtagtgcagtggtgtgatcacagctcactgcagcctcaacctcgtgggctcaagccatcctcccacctcagcctcttgagtagctgggactacaggcacgtaccacctaatttttgtattttttgtagagacagtgttttgccctgtttgccagaatggtcttgaactcctgagctcaagcaatctgcccaacgtggcctcccaaagtgttgagattacagatgcaccatgatgcccagcccattttattttttttcttctagatttaactttcagaatgactgctttcacaccaacatgtttgtggcattggtaaaggttatttttaggggtggtatgtctaacattttttacatttcaatcaaattgaggaatcttaacttttatctgccccaccatcctctcagggtagagcaagaaataatgtcaagaattatctctgggctctttccagtccagcaacagattgcacctagtatcagtgtttcagtcagtgagacaagtgaaccactgacttctgacattggtaagtgaaatagaatttttttttgtttttattaaaagacaaaagctttagttcatcgtggatttatatattccagaggtcaagtaaattctccagtaacaaaaggtaagctcttctaaccttacttcttagtacttctttggtgatggttagttctctctcaccctcttatttcatattgcagctttcagattattaaaccactcttcatacctcccaccccaaatctctttgttatccccatagtactttgtacatatttttgttatagtaattatcagattatattaaggttggtttccatatgtacctcactctttatactataaattactcaggatttaaggatgtttctccttttgtgcctagtccttgcctgatacccaacaagagtttaagtattcattgaatggttaaaatgagcctctttctttatggagcctatgccattcttttctccatttttttcttttcttcctttctttatggtgcctatgcccttctcttctccatttttttcttttcttcctcttctttttctccttcccccttttccttttcttctcctgcttctcttcccgattttttcttttcttcctcttctttttctcttttcccctttcgctcttctccccattctcttccccattttttccttctcttcctcttcctcctgtttttcttcctttccacctcctccttgtttttttgaggtaagtttacttgccataaaagtcaccacttctaagtgtacagtttgacaagttttttgtttgtttgttttaattagagccagggtctccctctgtcatctaggctagaggctggactgcagcgacatgatcataactcactgtaacctctaactcccgggctcaagcaactctcctgccttagcctcccaagtagttaggaccataggtgtgcaccaccatgcccagctaaaaatcattttgggtccaggcacacagtggctcacgcctgtaatcgcagcactttgggaggccaaggagggcagatcacctgaggtgaggagtttgagatcgtcctggccaacatagtgaaaccccgtctctatgaaaaatataaaaattagctgggtatggtgacacacacttgtaattgcagctactccggaggctgagacaggagaattgcttgaacccaggaggcggaggttgcagtgagccaaggtcacgtcactgcactccagcctgggcaatagagcgagactctgtttcaatcagtcaatcaatcagtcaatcaatttggtagagatggggtcttgctatattgcccaggctaatctcaaactcctggcctcaagtgatcctcctccctcagcctcccaaagcactgggattacaggagtgagtcaccgcacctggcccagtttcacaagttcacacagctatatattagccacataatcatgagatagaaaaacatttctgtcttctccaaaagcttccttatgccattttgcagtcaattcctaaacctcactcgtgcccactggcccctaacaacactgatctgctttctattactgtatttttaccttttctagaatttcatacatatgtaatcatgcaatatgtagcccgttgttagctggcttcttttattagcataatattttgacaatcatgctattgcatgtagtaatagtataatgtatagatataccataatttgtcaatccatttaccagttgatggacattcatagtctttcagtttttggctattatgaataaagctgctatgaacatttgtaagcaaatctttgtgtagaaaccttttaattttggttggtcatatgataagtaaatgtttaactttataagaaactgctaaacatttccaaaagtgggtgtactattttgcattccacccagcagtgtatgtgactttagttgctccacatcctccccaacacttggtgttgtcagtgtttataattctagccatttctgaacatatgtggaggtatttccctaactatactaatacctgagtagtataattattaatgatgtacaactttttaatgtgtttatttgccatctgtatatttactttggtgaaatctctttaaatcatttgaccatttttaagttcgagtcgtgtcttcatattactgagtatgaagttttttatctattctggatacaagtcctttattggatatatgttttgtaaatattttcttctactttgtgttttgcctttttgttttctcagcattattttttgaagacaaaaagattgattttgaagaagtctaatttatcaggttttttctagtagtttgtagggatttttgcatgctgcttttaaaaaaatctttgctaacccaagatcattaagatagtttcctatgttttcttctagaagatgtatggttttagattacacatttaggcctatagtatattttgagttaagttttatggtgtgaagtaaggatcaagttcttttttgtttggggttttttggcatatggatatccagctgttctaataccatttgttgaaaagattatcattattccattgaactaccttaacaccttggttgaaaatcaattggttatatatgtgtgcatcttgtttttggactttgtatcctgtctcattcacctgtaagttatactaataccatacttcttgattactgtaatttaatagtaacacttgaaattggatagtgaaagtttttctaactttgttctttttttcttttttattcctgtttatcattatctctactttttttcttctttccagcctcaggataagctattctttctccctcatagactatcctttaacagcccgaatcctagacttcagagtctatattcaccactttaatttctcattacctacttcctctttggtccttataggttggccttcttttgccctccccctcaagaaactcctttctcacagcatttgcttgtcaaaaatgtttccctttttcaaatccttgttttactgtatggctcaagcataggcactattgaccatctctgatgcttaaactcttctcctggtgttggctgcttagacttcattctgttaattcttcctcttttaaaaaaaaaaaaaaaaaacttctttaagaccttcattttctcattttattttctgctacttgaataaaattatttccctagttcccatgctttgccctcttttctgttttcttccagtttcctcctgacattagttatcctgtgtcagttgatgaaccctaagccatgtatttgggccgacaacttgcagttctgctggttgatgaatattgtgcttgatgctcccctggcatctcatctttagtatgtctaaaattcttctcatttttgagatcacagttctcccagcacccaatctctaaagccttggagttattatttgttctattttctttgctttgctcttcttcattccccactcagccataccctatatcccagcttcatagagtttattgttgcatttggctaatttgtcctatttagcatagctcacatgcctccttctgttgttactatcccagttttctctcgtcatctcatctttgaagggaggacaaaaataaacaacaaatttatgagaaaatttttttcctggtgaaaatctgacattttacaaattgggtatttagatcctgttttcttccctgtcaaagatttgtgtttgcttttgttttgccagtgtctgggtagggatttgggaccttataaaaacgatgttctgattttgggccatgctcaaagaatgaattatggaaactaaaaaggagatgtatcaacatatattgttgaatatgaatttgggattgggatagtctctgctatggtaactcaagagcaaattgctgttacttaccccgtcaacaagtgatcccactagacgtctacccactttttagggaattctggatattgttactatagttgtgttacttaagcagtactctttggtgaggtcacatctccatcaggttgtacaaatgagtatccacttattttccgcatggagctttataaatatcactactttaagtcaagtaaagtctctccaggagattttacttaatttgatgtacattcatgtaagtgagaagtacaacccattcagatattaatatacctataggacatctgataacaagcacctcaactgcagtagatgttaataactgatgtatctgaaactagaaggaagggaggtttgcctttatatttagtgcattcttttgttgtagtcaagatctatcacagagtttcctgttgttatactcttggaaatgtgagttgtattcagatgagggcatttaatgtgcccatttttatcactaaattctgtagtagtagagaagaggccatctgagtaaattttcatctcccttttttttatttacagagaatatttgttatgtaagttgtcctcttagtctttttcataataagtagatacatttgtattttcatttttattcctctttccaccctcccccacccacccccatacacgtatattggcatctctaaactttgttttgttttgttttgtttttgacagagtctcactctgttgcccaggctggagtgcagtggtgcgatctcagctcactgcaagctccacctcctgggttcacgccatcctcctgcctcagcctcccgagtagctgggactacaggcgcctgccaccacacctggctaatttttatatttttagtagagacggggtttcaccatgttagccaggatggtctcaatctcctgacctcatgatccaccagccttggcctcccaaagtgctgggattacaggcgtgagccaccgtgcccggccggcatctctgaacttttaagaatgaaagttcggcccaggcgcagtggctgtcgcccgtaataccagcactttgggaggctgaggcaggtgtatcacctgatgtcaggagttcaagaccagcctggccaacatggtgaaaccccatctctactaaaaatacaaaaattagccaggcatggtgacgcgtgcctgtagtcccagctattcaggaggctaaggcaggagaatcgcttgaatctgggaggtggcagttgcagtgagccaagatcacatcattgcactccagcctgggtgacagagtgacactacgtctcgagaaaaataataataataataatgaaagtttgaattgcaagcatgtttcttgcccacttattctgattttttttttttacttttagtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggtatggggaatttttgagacatttattgaagaatagtaaaatagatgaattttaagctgcataccataagatcattgtttgtggtagaagtattattatcatttttagagacatggtctttatttattgccctggctggtcttgaagttctgggcttaagtgatcctcctgcctcagcctcctgagtagctgggattacaggcaccagccaccatgcccagcttgtggtagaattttattccttgttgctatgattaaagtaacgtttcccccagcattttattttaaaaacttaaatctatagaatagttgaaagtgtgataaaatgaacatctgtacaccctttacctatacagttgtccattggtgtacgtggagaattggccaatccttgcatactcgactctcacagttggccctgtaaaaccaaagaatatgaaaagtcagccctctatatatatatggatttcttatctcatgaatactgttcttgatccacatttggttgaaaaaaccaaatttgtatgattggcctcttgcagttcaaacctatgtttttatttagttatttattcaagggtcattcatatttattgattgataatattttggcacatttataaaaatctgtctttatatctgctatatattatatatcctttaaaaaccatttgaaagttacagacatctttacctcagaagcatcagcagtatctccacagaacaagttgctttcttacataaccagaataccattatcacacccccccagatttaacattggcgtgttaataatatagaatatagagaccatatttagatttccttaattgtttcaaaagcatcctttacagtttttttttaaatcaagatatagccaaggatcatacattgctttgcgttattatatgaactgatatttttaatctttaaaagaaaatacatttcaggaacttttattgcttgtttaatcaaccttacttgtgttaaaaagaatttataatctattatagcaatatgaaattatacaaagccaaaatttactctgtattaccagctgtttaaaactatagttacttctgatcctatagatcacaaggacatcattttatatacatgaaacatttaaacatcatttgatgtataaagttatatactgtattttatttttgtagagattgttgtggtataatgtgattagtgtgccaaagatttgatctgtagttttgatctgtgctttattagctcattgggaatatatgcagtacagatgtggtcagggttatggttttttctatgccaattactttggtttgctttctgcctatatatattgtatatattttcatgagggtgattggatgagaaaatgtgggaaaaccagtgtaaagagcttggattttggggttggtaaaagttgaatttgaattccaagctccactactttagttttatgtctataataaagatagaatacttagtttaaatgaccatggctttgctgaaatctgcttcctaaatatgtagtagggcaagcactactcgcagcctgcaacttatcattctttatcttcagaagtgtcatggcttttcttggccttttaatctctcacatatattttaaagttagttcttaagttccataaaaaatattgttgagatttcagtgggaattaaaccaattttgactggtttcatttaagaaggattgacatctttatggtactgtgttctctttgccaaagttttgtggaagattaagtgagatgatatatggacagagcttaatctagtgcctagaacttggtaaataaacactcagttactaatagtttatcatttttattatccattaccaatactagaagaataccttcagatcctttcatcatgatgagttatatatataaaatatagtgttatatttgaaaataacacttatatgctatatgtttatgcagtcaagaagaaaaaaagacatagtgtacttctttcattttaaaatgaagactaagagtacattaattattaagcaatgctatagaaattctaatatgcttcatggttttaaattgcatcttaatttgcaacccataatacagaataaagggtaatcaccttatataaagactttagaatgaagaaaaagtcaaattttatatatattatatatatatttatatatatatatatatatatatatatatatatatttttttttttttttttttttttttttgagatggagttttgctcatgtcgcccaggctggagtgcagtggcgtgatcttggctcactgcaacaggttcaaatgattctcctgcctcagcctcctaagtagctgggattacaggcgcccgccaccacacccagctaatttttgcatttttagtagaaacggggtttcaccatgttggccaggctggtctcgaactcctgacctcgtgatctgcccatctcagcctcccaaagtgctggaattacaggcatgagccaccgcacctggcccaaataatatatttttaaaatggtcagaggacagacagttcatatacatagaagaaatacagatcacccatgtacatataaaaagatgaagatgatcaacctcatagataataagaaaaaaagttattgaaattgcatttttactgatcagatcggcaaaactctaaaagtttgataaatctgggggaaattgtcattttcctaccttctggtggtagtataatatagtaaaatcttgtagtaggaaatctggcaatatctattcaaattaaaaacataattagtcctttaatagagcagtcccacttctgggaacttattccatagatatatccatatatcatacatatgaaatgactgaagtcaagattatttgataactctgaggaagggctctaggtagaaaggacaagagtaggagagagacttaattttcactatccttttgtaccttttgaattttgaaccatttgaatgattacctattcaacaaattaatattaaattgttacatttttccttctccagtactttccatctccctgctgtcttcatctttccctaactcccaattcttcttatccttccattactttttatatactcagtttgtgtgtgtgtgcaaaaaggctgattttttggtatgttgtcaatcacttaaaatgcttcctttctgttctatgcctttccttcatgtctgtaactgggtttgatcatcagctttatctatttaatctttcagtcttctttatttttaaaatttcagcttttatttaggtatagggggtacatgtgtgggattgttatatggatatactggacccaggtagtaagtgtagtacccaaaagtagtttttcaactcattcccctttcttccctcctgccccctgccatcatagtccacagtgtctgtttttctcatgtttatgtctatgtgtgctcaatgtttagctctcacttataaatgagaacatgtggtatttgtttttttcttcctctgtttgtttgttcagaattatggcctccagctccatccatgttgctgcaaacgacatgatttttgttcttttttatggctgtgtagtattccatggtttatgtgtaccacattttctttattcagtccaccattgatgggcacctaggttgactccatgtctttgctgttgtgaatagtgtggcaatgaacatatgagtgcatgtgtctttttggtataatgatccttagggtatatacccagtaatggtctcaaaagaagacatacaagcagtcaacaaacatgaaaaaatgctcatcatcactaatcatcagaaaaatgcaaattaaaaccacagtgagataccatttcagtcagaatggctattattaaaaagtaaaaaaaagattgccataaatatatacacttgctatgtacccacaaaaattaaaaataaaaattttaaaaacaaacaactacaaaatacaaacccacagatgctagtgaggctgcagagtaaacagaacacttatacactgttggtaggaacgtaaattacttcttctctattttaaaagagggtgccttagaattctgtggggaccacttcagaggcagagttatttcaattgcctgagacttgctgcaggccaatcgtagactaacaggtagaggttcaagaggtagggtacttaaccctgccatcaatttaaattatatatagtctatgaatgagttcatattattttcaaattacttttatttgggtgattataaacacagtttatcttgttttatttattttaggcaagagtgtgcaccccactgcctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggtagaaactttatttctataactcggttttaattttagcaactattaaatttcatgatttgtatatgtacttgttgcttactaggttttagtaaatcattttttctcacaaggaaatttaggaattgattgcgacttcttaaaagtctataattgaggccaggcaggcatggtggctcacgcctgtaatcccagcactttgggaggctgaggcgggtgaatcacgaggtcaggagtttgagaccagcctgaccaacatggtgaaacccctctctactaaaagtacaaaaattagccaggtgtgttggcacgtgcctgtaatcccagctactcaggaggctgaggtagaagaattgcttgaacccgggaggcagaggttgcagtgagccgagatcgcaccattgcactccaccctgggcaagggagtgagactccgtctcacaaaaaaaaaaaaagtatacaattgaatagatgcttagactactttaagtatatggtggtattaacaatgatgtcttctcaaggtattttttaacgcttcactaaatttaggaattatcacattaatggctaccaccattgtcattattattattaattataattgccattatttgtgtgctaaaatggtaagggatatctgaagcaatgtatcatgccatcctatggagttctttactgactactatctttttctgtccttttaaaaaaaaacctttaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctatgtaaatgagaacatactcactagtaactgtacatttcaacttatgtttgacttatgtgatccattgaaaacatagaaatattatacaaagctttataaaccacagactaccttatactttgaaagaaagaactttcataagtgttgagttttgaaaaattatcaaattataccttcaccttttttcttaaaaggtttgaaatagctagaaataaaggtatctattatattgttaataaaatagaaaacaatttctccctattgtggatcattatttactatgatcagttaacttttatattattttatatctctctgtatggaagagctttcaagatggcctatgattaaagcatgaaaacaacttttaaaaatcttgttaattatagtagtgcagatttaaaaaaatattttgctaaaggagacatagtcttcgagtctgttttttatatcaaaatgaatacaggccttcagtgacctaacaagctccaaatatgtctttattttcttagtgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagagtaagttaatttgtattagttgattttacttgttagattatgctaattccctaagtaatacttttctatttaaagtgtttttacttaactttcaagatttaacatggtatagtagaaagaataggggactcaatgcaatttagttaacttttctgggtcttaacttcagaaagtaaaatcttcctcataatcccaccctccagaaataatatcactattaatggtttggggtaggcctttccagtcttttttgtctatgcatatatagacacataaatacatacgtatgtggatgtatgtttacctttaaaaataggatcttactatgcatattgttttgaaacctgaattttttttttttttttgagacaggttctcactgtcatgcaagctagagtgaggtggcatgatcatggttcactgcagcctcaacttcctgggctcaagtgatactcccacctcagccttctgagtaactgggactacaggcatgtgccaccacgcccggctaacttttatattttttgtagagatgaagtttcaccattttgcccaggttggtctcagacttctgagctcaagtgatccacccgtcttggcctcccaaagggctgggattataggcctgaaccacctcacccagcctgaaacctgaatttttttttttaccaaataatatattgtggatatcttttaatataactccatatttttcttatttttcttttctggctgtgtagtctgtttaatcccttaatagagggcatttagattgttttcaatgctttcagtctatacacaactctctaattaccatcctttcatgtatatatgtctttgtgcacttatctggtctcttccttagaatacatgcctaaaagcgaaattgctgagtctactttaaagatgcatcaccaacatgctttctagaaaggattttttttttctttgctctaagttctagaaaggatttttagctcttaatcagttttaattatatcaacagtatatgagaatacccgtttctcaatttcataactacaattgatatttatagtttttaatttctaacaaactggtaggttaaacaaaattctcatctttgttataaattgtacttcaaaaaaactggtaagattgagtagtttgtgaattacttgtttataaactttgccagtatttccattgcagtataattttgaatctaatatgctatggctttatggtcagattatttactaagtttgtgtttcttttttttttctaaacttttatattttaatttctagttttagaagatataggactgtacctgacaaaccttaatgatagcttatccagcactctgcatgatgccgttgaaatggtaagtaacgattgactccaacactgaattctgacaggaagaatatctgtatgaattggttgccactgatcaggttttttctcaattttttgagttatagacacaaaatttagtaaaataaccatgaaataatttagagtttcttgcacatttcattatgtaatcttataattatgagaatgaaaaaaagttattattaaccctcgtggctctagtagtaaaaaaatatacatttaatgtaattaggtaatgaaatctagctgattgcaaattgttacctctgtatgttgtctttacaatatttaagcaggatcttacctgtttaaaccaactctcttgtaatacatttgttatttttccctaaccatgattataattctttgtgctaataaatatttaaacttaatggcttaaaaagaaaaatgaggtccagggatgttaaccctttctagtttttatctagctctgtagaagcaaaagttggtatttaaaaatatcacattatatataaatatatagaagtgatagtaagaattttcttttgaaaaaaccgttaaggaatagaaatctttactttttatatatttttaaacaacctaagcaaggaaaggtaattgtactcaactatcatctatgtttattcacatctttttaaagcattgttgctgtttttttaagttatttcacataggcctatgaaaatacttcattaagaagttttttgataagattttaatgaaacaatttttaaacagtaattatttattgcaagtaattggttgagctaattgtgaagagagcatagcaatcacttttatgaaataatatgggaagaaggcataaatgagatatctttattttcagagaagcattactaacattcggcctattagtgtacaattatagcatttttctcctctctttgaactttttcaagtggcaaagcatgtttaaatttatttaaagtaaatagctaaaccaaaccaagactaaattataacttgtttctctttttctacatttgaaactaaattctaatgttgatatttttactatgcctaaatcacatatgctacaaattcataataaagtcaaatacaatagtacaatctggaaaaaccccaaataacttgaaatcatgtaccagtgggcattttatctatacatagctaggggatagggacttataatctggagttaataaactttatttcatgaaaaataaatacaaatactttcaatgaatttaaagtcatgttaatatctgtatttacaagataatctactttgttggactctgaggcccacactgttcctcattgttgggatgggcctattttgaggcatgaggaagcctatacagggtgctccagtgagggtcttcaataccaatgccctcgccaagtaagccagatgtcagcccaaaggcaaagggacattgaggtctatagctgccataccatacttctgcagtttttcatttttgcttgtggtccaagttgcagcattacagtgctttgcccccattgccacactgtggcattactttactgcagaaatatgaggaggaggctgtgacccaaaaacaatgatatcatataaaacatttatgattcatagtagctcaactgtgtgggacagactgtttgatttttatgtttttataatctccagtttatgttgtaccaaattatactgtggtttatatttgaggcaaagatagagggcttttattatagacaaatggaaatgagaactagatgaaaataaagagttcatctcctttccaaaaatgctaatatcatcatctcatgactgataagtttttattaatcttaaattgagaaaaatgcaattgttcgaaataatttatttttattaattgtctttatgtttcttttaggaggatgatcctcctagtgaagggcaagtgattaggatgtcccataaaaaatttcatgcagatgcaattctttcttttgctaaacaaaaccaggagtcagcagtttcccagcaagcagtctatcattcagaggtactttttaactttaatgacttttttttggttagatctaaatacaggaaaaaattaaaatattcttactactagttaaagcatgctagtattttggttttttcaagggtcagtgttacagcaactttaacttggaatcatggaactgtagagttttataacagaaaggaatttagaccatctgttccaaccaccttgttctactgctaaaaaagctgaagctttgtgaggattcattatgcaattatttattaagtatccattatatgccagacacaaccttggaaaagatacaaagataagtaagacatgacccctacctttaagcagcttacagtcatgtaggaagataagggcttacacaagtaattattcaacagtgcaataactaatcaaatagctgtatttacaagtactatatgaacacacaggagaaaagactctgcctgaagttagatgacacttcatacacaatattacattgatgtcagtctttaaagatggagtaggactttgcaggcagcaacgaaagggaaggacatttcagaagcagaaataccatttgttaagggatgacagccaagaaatattaaagcatatttggaaagtattgaaaatctctgtgtggctagaactttagatgaagaatcagatacatctggagaaggagattgaaccagatgatcataaagaacattttatttaggccatggtaaggcttgggcactgtggagcccatgaaggtttttggacaagggagttgccttaggaaggagtatgaagccataaacaaatgagggagacatgggggatctgtcagaacaccactggagtagtcccagcaagagagaatgagaacaaagacagttacagcagaaatagagaggagagagatttaaatttaagggcataggattgacagtaattggtcattggttgagagaggtaaagaagcttttttttaaggataatcttgaggttcctaccttaggagcttggatgggtgattatagagttgttggcttagaagtgcagacagaagagtgccagattttgtggggaaactaatgagtttgatatacacattatatttaaggtgcttaaggaaattccaggtagaaatatacaacattgtcattcagactggttaatgatggagctgggactaggattcttgatctatagtgctgtttctatcatatctggttgtcttcgcatgaacaaatgtcaactggctttagatgagctggagatctgaagactatatagggcccaaggagatggttggttttattttctgtttttatttttaaaactttaaatgattaggaaaggtaggagaagatataaaatttagtaatgggaaaaaatgaaggcttaacatattccttctgaatttaaaataattaaattttctgcaactttagttagcaatagatcatttcactggaaaaatcttagttgtgatatctgtgttgctaaattcaaaaacatactctcatagctgcagaaattaagatgattagtatcgaaaccattaagctgagagagagaaaggagggagaggagagagagaaagcgcatgtgcgggtggaaaggagagagaaagagggagagggaagaagggagagagaatgagacaagcaaatggtacaaaaagaggtggcaaatagcagaagtgtctgcataaatttataaattccactgactaatcctagttttctttctttttggaaatcactaatatcagtgtatttattcgtgcaattgtatcagacgtttttatcttttagatgctgggaaatttatcttcattctttctttctcttttttttttcttcctttcatttttcccccctctctctagaactcttatttccagatattgacacttctacttctgtttttcttatcccttaaattttctgtctttcttttcttctccattctgggagaactccccaatctgatctgctaactattaatttgttctctgctatactgtttatcccgtttattgtgtttttcatacttgacattcttgttttttgttgtttttttttttgctttgcattttaatatcttttcttatcgcctactctgtgtctgtctgtctgattaatatcattcactttgttgtctgttttttttttcttttttaaacttattgactcctcaggtatctggttcttttgacctgtgagttcttatttcactgatgggatcaactattctgtctgagaatttgggtaaggataaaaccatggtctgtttcagagagttaaagaagaggggaggagagagccctagggaggagagccttaggcagcacagaaccacccttggtcactgtccctgctgtttgctgttactccactatatggctctcctggtgattattgtgtctttaagcccttaggaagacgttgctttgggagggtttgtaatccactagtcctggggcttggaggggaagaaggtgaaggaatgatgcccacggatgggcttctggacagatttcatctatagttgtcaccatagctaggccttcatgttccctgatattactctggggcgccagcatttgcagctggggttgttaataagaagacttttatggttgaggggcaagcagtaatctcaaattaatggaggaagaaacaatgacttttctccattcattcctctcacaaagcccctccacacagcctcctcgctaggatgcagcccctttctttccacgcgttccagtttgagttaactgtctgtctttccaggggcttttcacaacttttactttagttctcagaatctatgggttctttttcacctctgtagttactccagtgttgattttgagagctggcagcctttgttactgtgctgtcctggctagaccagcaatgcagaagttagaattctatcttctccagatctttttctaagcattaagcatttatatatgtataaaaatatatttgtgtatatgtatatgtgtgtatgtgtgtgtgtgtgtgtatatatatatatgtgtgtgaatctttttgagacagagtttcagtctgttgttcaggctggagtgcagtggctcagtcagctcactgcagcctcgaactcttggactcaagcaatcctcccatctcagcccccagagtagctgggactataggcgtgtaccatacctagctaattttttattttttgcagagacggggtctcactatgttggctaggctgatctccaacttctgaccgcaagtgatcctcctgcctcagccttccaaagtcctgggattataggcatgagccaccatttctggcttagtatataattttgaggtgtgtgtatatattgttgtgcaattttaaattttaaaaagcaggttgcaaggctttttaaaatttaacataaatcctgaagatctactatattctttttacctactatgtagtataccatagtttaattattctcctattgaaggatttttagattggttccaagtattctctaatcaaactatactaggtataaaatcctttttttgtactcatgagaaattatttttctagatttagatactaaggcatggaattgctggctcaaagatataagcattcataatttaaataggcactgaaaaattgcccctagctgtatgagatccctttcccatgtcacacataatgcttttaatcttaaatttttgccagtctgattaacagtgacattttgcatattttcttgtctaaagggctatgtaataagaactagtaatattgatacattataagttaaaatattgctttgctaagttgtggcttttctttgtgcttgaaacttcttgcttagaggggcatttggtcagtgaaagctcactgatggcaaaactgtaatttgtacatatatgtagatgggctaggtatattactctgcattataggcaacctgacttaaattggcatgaacttaagcattgagtataatccaaaactcagagatacttatgagtatgagaccattttgtaaataggcaagataagtcttcagtagggtcatagagtattcttaaggtgttaaatagttcagcagttgcaaatatcctagaaaacagattcacaacagagaagttactgtagactgtcagagtaatataggcattgtgaaatatttctcattaatttctggggaaaacataattgccatcattctaaacactgcccaagagtctccaagggatttcatattaattatgaacagtattttttaatttaaaggatgttgaggcaatcagtattcctaaagaagagtcaggctaagggaataaggagagatagagatgtacataggagaatgaaggcaaattgaagagaatcttgaatgttgagctaagaagtttagattttattttatagtcaatggaatcatcaaaggtgtttcagcagtgatttcttcatatagtctagttaaaaaaaacacttgttggttgaaattaaaccccttttaaatgagaaacatgggagctttcagataattggaattttgcttcagttcttaattagtaaattcattaattagaatatctcaagtcataaaatgtactagtgattaggatatataattttttaatacagaaagaaaataggagtcttatattttttcatttgttcatttatttcatagatttcatttaaaacaattttttttttttttttgagacggagtttcgcttttgttgcccaggcaggaatgcagtggcgggatctcggctcaccacaacctccacctcctgggttcaagtgattcttctgcttcagcctctcgagtagctggggttacaggcatgcactaccatgcccgctaattttgtatttttagtagagatgggtttttgccatgttgatcaggattgtctggaactcctgacttcaggtgatccacccacctcggcctcccaaagtgctgagattacaggcgtgacccaccatgcccagccaacgatttttgtgctttttgtattttttatttttcccaaggaaaataacattattaaatatgactaaagtattcttctataatctgtatacttttttttttttttgagacagagtatcactctgtcgcccaggctggagttcagtggctcagtctcggctcactgcagcctctgcctcctggtttcaagtgattttcctgcctcagcctcccaggtagctgggactacaggcacccgccaccacgcctggctaatttttgtactttttttttagtagagacggggtttcaccatattggccaggctggtctcaaactcctgaccttgcgatctgcccgccttgacctcccaaagtgctgggtggtgtgagccaccacgccaggcctctatacttttataaaaatcttattattgatatatggggtaacctttatgctgtttaaagtatattattctcctcatcaattgtttattgtaaagtttacactaacaaactttaggcaatttttattcatgaagaatgagagaaattttctgttattcccattttaagctgtatgaacaatgtgtaatgcataccagcatttagtggttttgatttttttttttttttttttttttttgagacagagtctcgctctgtcacccaggctggagtgcagtggtgcaatctcagctcactgcaagctccacctcccgggttcacaccattctcctgcctcagcctcccgagtagctgggactacaggtgcctgccaccatgcccagctaattttttgtatttttagtacagacggggtttcaccatgttggcctggatggtcttgatctcctgaccttgtgatccgccgcctcggcctcccaaagtgctggtattacaggcatgagccaccgtgcccagctgattttttgtgttttttttgacacagggtctcactgtatcacccatgctggagtacagtcgtgcagtctcgctcactgcagcctctgcctcctgggttcaagctagcctcctgcctcagccccttaagtaaatgggactacaggtgtgtgctgtgatgcccagctaatttttgtattttttgtcgagacagggtttcgccatgttgcctaggctggtcttgaactcctgagttcaagtgatccacctgcctcggcctcctaaagtgctaggattataggcatgagccaccgtgctggccccattgagtgttttaaattgtaatataatttttcttatgtattttattgctatttaattggtgcttgaaaaactggttaatttcataaaatatatgaaattattatattgaaaacaaagcctatcacgaggcttattagactaacttcttgaacttttcttgcatgtaatgtatatgtggcatagaaggcagtttgtaaaataccttccaaggagtcaaagggtattgttcatgatatttggcaaagatttcctgttttgacttgattttaatataatggttttaacaattgtttctgctttttaaaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagacaccaaaatattttttcttgatgtgtcatagtagtatccctaatctgagttgaggaaagtatacctattttcagataggggcttgcaaaatttctttattaaaagggattttaataattggaaagtttggtgataactttttttatagtatatatagcagtgtttccccaaatgtgattcatatatcagtgttggtacatgaacctttgggtggtatgtgaattaattttggtaatacacatacatacacttaaaactttttaactgtgatacttttattttatttcattctatttatttatttagagacggagtcttgctctgtcactcaggctggagtgcagtgacacaatctcggcccactgcaagctctgcctcccgagttcaccccattctcctgcctcagcctcccgagcagctgggactacaggagcccaccaccacgcctggctaattttttgtatttttagtagagatggggtttcaccatgttagtcaggatggtctcgatctcctgacctcgtgatccgccctccatggcctcccaaagtgctggaattacaggtgtgagccaccgcgcctagcctattttattttattttatttttttggagacggagtcttgctttgtcgcccagggtggaatgcaatggcacaatctcggctcactgcaacccctgcctcctgggttcaagctattctcctgcctcagcctcccgagtagctgggattacaggcgcctgccaccatgcccagctaatttttgtatttttattagagacagggtttcactatgttggccaggctggtctcgaactcctgacctcaggtgatctgcccaccttggcctcccaaagtgctgggattacaggcatgagccaccatgcccagccgatgcatttattgtaatatgtactagaaaaatataacgaatccatgaaaattgacataacagatctttaggacaaggttaaattagataatactgtagacatttattctttatgctatatgaatttcagtagcactctgcattcaggactattttagaatttaaataaactttctgttgtgacacactggaaataaggatagaatagagaataccaatcactagcatatatagttgactctcatctatggaccattgttatattctgtggtcaccacaaacatattaacaagtattgaaccattactcctaggggaaatacaggattaggtttctgtgagcctctggtcataacatttttatcaactgatcaatacataatctggttttatttatgtttctgtttaaagaagtcttatttaatatatattttggattcattaatattgaactcacagccattgaactatccagcagtataacttgtgcctgaaggaagcctatctaacatgtatattttctccataagacacagcggagcctttttgtgcttagaaacactagacaggccagatgcagtggctcacgcctgtaatccagcactttgggaggccaaggtggcagatcacctgaggtcaggagtttaagaccagcctggccaacatggtgaaacctcatctctactaaaaatgcaaaaattagccgggcatagtggcagatgcctgtaatctcagctacttgggaagctgaggcagaagaattgcttgaacccgggaggctcagagggcagagggcagaggttgcagtgagccgaaatcacgccactgcactccagcctgggcagcaagagcgagtctctgcctcaaaaaaaaaaaaaagaaaagaaacactagacagtacttcagcactaaggggccattttaaacagtgaaatcaccaaaaaaaaggggatgaaatctgaaaaacagctttacgtatactgtgaaaaggtcacttgtttacagtatgagagctggaataaggtggaatgtatcgttgttcagcatcaactggaaaaatgcatgttaggtaatttaagtttttcaccactctgtacatgtccacaaatgaccacaaaggtgctgcaagtattgatttggggggttataaatacgttttagcgagtagataaatttgcaaatatgtaatttacaaataaatgaggatctgctatattcttattattgatttttaaatgcccattgtttctttctcttaagtgaaaagaaacttctggaggcatgcagatttgccagaaatcagaaaaggaaaagcctgaagtatttagtttcatattgagtgaacaccttgtatcattcagaattgggagaattccgagactgaatttcccatgtgaataaatgtaaagattggccttatttctcattttgtacacataatgagagtattaaatgttttacattctttaaaatttgtaggattcaaatggcatgaaatgtgacttacatttatgtccagctaaatttgcagaatgcagttaaacagagttaacactaggtggctctcgcagatcacttgaactgctaggtacttaagagctactaggtatctgagagcaactaggtacttagttgaaatgttacagaataaactccctgaggagatagcctcttcagtcctttttaaatatctggtaaccctagcagattacctatagtacagtgcatttttaatcttaggtacattgtaggtatttaattggaaaaaataagtaatatggtataacataagattgaacacatatgtaaggcagtatagcagaatagctaagagtttaggctttgagagtttcagaaatgggtttgaattccagctctatgtatctttggtcaaataacttaatgttcctgaacccaaatttctttatgtgtcaagtggggataatattgctatgtacgaaattaccccacatttaacagctgaaggcagcaaacatttattatttcacagaactctgaaagtcacaaatccggtagtggcttacctgggtggttttcaggatctctcctgatgtggcagtcaaggtgatggcttggactgaggtcatctgaaggcttgactagggttgaaggatccactttccaagttcactcacatggatttagcaagaggcttcacttcctcaccatgttaaccagtccatagggccgtgaatgatgtggtagcagacatctcccaagagaaagtaagcaatcaagatggaaaccataatgtctttttttttttcttttcttttgagacagagtctcgctctgttgcccaggctggagtgcagtggtgcgatctcagctcactgcaacctctgcctcctgggttcaagtgattctcctacctcagcctcctgagtagctgggactacagatgcacgccgccacctcgcctggctgatttttgtatgtttttgtagagacggggttttgccatgttggccaggcaggtctcaaacttctgacctcaagtgatccacccgccacagcctcccaaagtgctgggattacacgtgtgagccactgcgcccagctgataatgtcttttataacctaatctccaaagtgacatgccatcacttctgtcatattccattgataacacagaccaatcatggaacaacttaagaggtgacttttaaaaggtgtagataccaggagggcagggatcactgggggctatcttggaggtaatagtgtctatctcattatggttattaggtacatgtatttgacaatgcatgtaaagtactaagctcagtgcttggcacatggtgttgttctctttaataatgcttggagtatgaaaagtactatcttatatgtacttaatagaatcagaaactatcaacagttgactaaaaggactttgcctatagaaaactaatttgttcctcttgtttcaagattttctcctggtgaccacagactataactgtggtccatagatgagaatcaactatatatgctagtgattggtattgcttttcgtcttgatttttaataactttgcttacagagggtcatctcttcttactttgcccctccccacccctgctaattttcaggaagtgtcctattttctgtagtcctctatcactgtctccattcctgaggctctcaggttgggttgagtaactgaaagttgcaaaattggctttgaggagttgtcttgggaaacctaaaatgtaagctgtaatttgagtgaattatttgtggaccctgggatatactaccaactacagctttttatttactcaaaaaacctgtattgaatacccactgtatacctagaactatgtaagtactacattaagcactcaagattcaaagatgatagatatctgctctcaagatatttactaactagtgtgggagaaataaataacaattataatattgtgtgactagtacaacacagacggctgtgggagtgcagaggaggaacttaactcatttgtgagggcttagaaaaggttttctgcaagatccaatgtgaaattgaatcttaagggaattagccagatggtaaattatgataagaatattccagtttgttcatttacttattcagaagatatttttgagtgcctgctatgtgctgagcatgtgctaggtgctaggaatatgaaacttggtaaggccctgttcacaatgattttttttctctagtagacatagtagataagaaagcaaaaacatgcaataaattactgtagttattgtgaagaagcccgtataggatggaggtacaggtcaattgtagttgaagggattcaggaaagacttcatagatgagggaagtcttgcttgaagtgactcctcaaagatgaataaatgcttgccatgtggtgagtgaggagggacctttcagacagaatatgcaatgagacaggggacaaaggcaaaaaaaaaaaaaaagcaagggttaatcgtggaaatgcagtgtttttgtcaaagaattagagcttaagatgcagtgaaattgcagcagggagcagaaaccaggtcatgaaaagccctggattatctattaaggagtacagtaaggatcgctttgtatacaaaatgggaaataataacagtcttactttttactttatacttattcccatgaacaattcagccttaagtttctgtcagttctgaatgttgtgtgatattcatcagtctgttaaagattgtaagtaaatgagtgatgtgatcatatttaccttttatttagcaagatcatctgagatgcaatgtgatggatagattggaagagttaagactggaggcaaggagcctgattagacaaccattaaagttgacctgatgagacattattcagtaatgaggatatataaaaagggagatttgagagagaattaaggagatggacaggaattcatttgaatgtgagcagtacaaaagaagcagaaagtctaagaaatccctaggtttctgtctagaattattggatagatggtcatctcagtcactgagagagagcgaatatggaggaaggacagaattaggaggaaagagattgaatggggtttatacatactgaatttgtgatgcctttgactttcatacaaatgaaaaaaatccattagatatgccggaccaaaaactcttgctggactggcaattttaggcaaacttagtcttctctaaaagtctgccatggttgctttccactataacaaaattctaggaaagtaaaattagggatttctagttatgattaattaaattaaatttgacttgaatgaaataatattttaaatatccctcttttaaaggtctaacttgcattatacaggtaagacacccacactcaatgagcctgcttgttagaagacacagcaaattcagcactgttatgattgctgtcagggaatcctttcctgacccttatcactgggttaaatacctgtcatgtgtactctctataattctctaatgtcacctgcctaatgttgctcttatcacactgatattaatctcatgtgagggtacggactttatcttgtgtactctcatatccctgtcacctagcaggttatatagtatacagaacatagtaaatatctgttaaattataggatggtgtattatgtgaaagctattacgcactttttgagtgctccccaccaccacttttttcctgtcccatgtatgccttatcccaagtaacccatgttaagattctggcatataaccttcctgttttttacctcacacatataattatatgcacacatgcatgtacaatatatatggtatgtgtgattgccattattttacaacttaagatcatatcttgcacacttgcctgcattttgtgttttacccagtaaacccttagattattccaggtcaaccggtattacttaaatttattcattttaatgattacgtaaaacttcatagtgttgatttccaataatttatttagttgtttctctattgatggatgtttattaacatgtccctgcactataaacaatgctagagtaagtatccacacacacatcctaccagattgttgtgttttatatactcctccttactccagtgtatgtactcctgggaagctcttctatacacgagcaaatgtatctttagtttagaaatagataatgccaagttgctttcttgaaagtttaaaccaatttatttttatcggcaatttattagtgccctttccttacatcccctcctgaaattgtgttgattagtttttttacatacctcagtagaaatatgaagatatgtttctgactcctggtgagtttatatgtcttttcattcatatgtttgttggccatttgtatgtgctcctataaagttcttttcccatctgggaggttctcagtttttcttgttagttttaaagctgtttctatagtttagatgttttctactatttgtattgtaaatatctttatccaaatttatattttgctcattgacattgttgatgatctttttgccatataatttaaaaatttatatgtagatatttctaacttttatactttccgtgctttcatggcttgattatgttgctatactgtaggaaaaagctaatcacttttatctatttatctgttatccagtcacattaccaattctcttattagttctaatagagttcttttgttttcattaaagtctcttgggttttctaggcatataccatatatcagcaaaagagttttcaatatcttctttttttaacattatatgtaattcttttctcttaattcatttgccactcttagaaaaatgttgaacaagtcacataggaatagaaaaaggcgtatcagaatataaagagacaaataaagcctgaaacattagttactctaaattataagtattattaccattatttaaattaatcttatgttagataattaaatgagaatcaggtaataattttgataaattgttttatacagatttaataccataatagtaaaaatcaaaactcaatgcggctggacatggtggctcatgcctgtaatcccagcactttgggagaacgaggtgagcggatcacttgagcacttgaggtcaggagttcaagaccagcctggccaatatggtgaaacgctgcctctactaaaaatacaaaaattagacaggtgtggtggcgcgtgcctgtggtctcagctcctagggaggctgaggcagaagaatcgcttgaacccgggaggtggaggttgcagtgagctgagattgcaccactgcactccagcctgggtgagtgagtctccgtctcaaaaaaaaaaaaaaaaattaaaactcaatagatgtatttcgctttatgtaaaagcccattgaaaacctagattaacataaaagatcaatcagagtgattatttgctatatctaggaaattgtcaacagaatgcctttaaatggaaaatatctatggcgtctttgaaatattttttcaggctgggtgcagtgcagtggctcatgcctgtaatcccagcactttgggaggctgaggcaggaagatcactttagcccaggggtttcagaccagccttggcaacatggcgaaaccctgtctctactaaaaatacaaaaaattatccaagtgtggtagcgcacacctgtagtcccagctactcaggatgctgaggtagaagaatcacctgagcctgggaagtcaaggatgcagggggccatgatcatgccattgcactccagcctgggcaacaggagtgagactctgtctttaaaaaaaaaaaaagtgtatatatatatatgtgtatgtatgatttttatatatatgtatgatttatatatataaatcatctatatgtatgatttatatataaatcatgtatgatttatatatatgtatgatttatatatatatcatgtgtatgatttatatatcatatatatttatatatgatatataaatatataatatcatatataatatatcatatatatgaattatatatatgatttatgtatataaattttaaatatatatatttaaaacttaatttgcatataactcttcaggtctatttctattgattatattttaaaaggttgtctagcaagactgtgaaacagagagcagtgacttaattcctctgtgcttcttgctagctctttgattttggacagttagttaacttctctgaaccttagtaatgtcagtgagagacagttacaatgatgtctaacctatcttacagaatgattgtaaagttcaaatgtaataagataatgtactcatatatgaaagtgcttggagtatatagtgcaatacaaaggtacagtggttagatacatagatatctctgctcttgtcttctttttactgatttgactgaggtgccatttatttatttatttatttatttatttatttagagacgaggtctcattttgttacccagactggagtgcagtgatgcgatctcagctcagtgcaacctccgcctcctgggttcaagcgattctcctgcctcagcttcctgagtagctgggattacaggtgccatgccaccacacccagctaatttttgtatttttagtagagacaggtttcaccgtgttggccaggctggtctcaaactcctgaccttaggcatccacccacctcagcttcccaaagtgctggattacaggcatgagctactgcactcagccagaggtgccatttagataagaaaataagagcttgatcacttgaagaacaaaatctacagaatagagctaggcaataccaacattttccaggcaggaaattgccctttgctttaagattacattttagatagaaagtattctattgactcttagagataggaaaggtaagcaggagtattaagagttcgtatgtgggaaggaggctgcagatgaactgcatgggcaacttgttgactggaactttacatagaatattccatggatttgtttgaacataggtactttttgcattctctctgagttttggttttaattgcagtgaaggcttggtccaggtgtttttgtttgaagtacactgctagttctaattcagcaggtgagaaatattggtggttttagtcaactacttgttcatttttgaagataaatttaacactttattttaactttttatttacatttttgataacaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccaggtaccaaattaatagcacttgtattttacttaaaatgagaattgaaacactgttgccttagcgtggtaccccgtcaagagccaagcctctggagtcagatagcttcaaatcatgcctcctttatttcctaactcaagtctgaatataaatctagttcacccaagctgtgccctagaacacattacttagcctcttttaagccttaattccctatctttaaattaaagaataaaataatggccaggtgcaatggctcacacctgtaatcccagcactctgggaggttgagacagtggatcgcttgagtccaggagtttcagaccagcctgggcaatgtggcaaaatgccatctctacaaaaaatacaaaaattagctcggctcctgtagttccagctacttgagaggctgatgtgggcagcagattgcttgtgcccgggaggcagaagttgcagtgagcccagattacaccactgcactccagctggtgacagagtgagactcttgtctcaaaaaaaatgaataagtaaataaaacataaaaataatatatataaaagtaaggtagcgatttcatttacatctctgtatctgcatgcaatacctagctcagtaatttacatatagtaggtgcttgataagtgtttattacattgaaatttgtaaaaagtgtttcataagaaatgtattgcataagaaatttaatgctgaggtaagccaatggcccatgcaatcttgtgtactgaaaaaataggttaattactcaccaagatgttaatctaaaaaagttcaatattaagtagttttttatttgtgtattggcaattcgttcaaaattacccattttgaactaatttatgaataagtattcatggtattatgcagcaggacatgttacggatgaaaccaaaaaatacgtaagataaagattgtttatggaacacatgattatgtggggttcagtattaccaatctgtgaccaagcaatgatcaggaaaaactagttaataatgaaaaagtatctgttaataacttcgatataaaaaaaatttttgtgaccatgattaggcaaacatttctgggatatgataccaaaggtactatctatgaataataattttttaaattggtcttatcaaaaataagaacttctgttcttcaaaacacagttaagagaattaaaaggcaagccactgactgggagaaaatatttacaaatcacttatcttatcaaagacttctgttcagaatatataaggagctcacataactcaatattaagaaaacaaacaatccagttgaaaaatgaacaatagatttggaacagtcctttacccagagaagataatataaatggcaaataagcacataaaaagattcttagctgggcgtggtggctcacgcctgtaatcccagcactttgggaggctgaggcaggtggatcacgaggtcaagagatcgagaccatcttggccaacatggtgaaaccccatctctactaaaaatacaaaaattagctgggtgtggtggtgtgcacctgtagtcccagctactcaggaggctgaggcaggagaatcacttgaacccagaaggtggagtttgcagtgagccaagatctcgccactgcactccaccctggtgacagagcaaaactccttcttgaaaaaagaaaaaaagattctcagcagagttagtcattaggaaaatgcaaaataaaaccacaatgagctaccaccacacatccattagaatatctaaaatctaaaaggcggtcatgccaagtgtcggcaaggatgtggagcaactgaactctcatactttgttgattgggaatgtaaaacgatccaacccctatggaaaagagcttggccatttaaaaatatacacccaccatatgaaccatgcatttcactcctagtttctcaagagaaactaaaacatatatttacacaaagacatgtacgtgaatgttcatacaaccttatatttgtagtaaccaaaaactgaaaacaacacaaatgtcaatcaactggtaaatggacaaattgtggtgtatcctgtacagtgaaatacttagcaaccaaaaggcatgaactatgaatacaaacaataacatggatggttcttacaaaagttatgttgagtaaagaagccataccaaaaaaaaaaaacactgattttatttatataaaattttagaaaatgcaaactaatttatagtaatagcatttcagttattttggggtgatggtaggagttagaggtggaaagggcaagaaggagaagataaaagggtgtgagaaaacttttgagattgatggatatgtttattgtattatcttgattgtggtgatggtttcatgggtttataggtaggtcaaaacagcaaattggacactttaaatatgtgcagtttattgtctgttacatgtatctcaataaaactttaacaataaaagaaagattacttccttttaattgatggcttgttttagaataaaactataaagtgttaccagaagaaagggcctcaaaaaattcccttgttagatttctttagctagcagggacttatggttagtaataatagcacacatttatagtgctagatgctgttctaagttttttacgtattttaacttatttaatcattataacagcctaatgaggtagttgttactattatccccatttcatgaatgaggaaattgaggtattgagcagttaaataacttgcccaaggtcaaagctagaaaatgccttacccagatttgaacacaggcagtttagctcctgtggtcacagctcttattcgctgtgagtaagtaaggaaaccaatagaaacgttcaaagtctcagcagccagagccagaggtagtcctagtacccatcttagaaatacacaccaagataatatttccttcgaggcagaaacatacatgactaacggctctaaacttggaagaccagagttaaggctagttattattactgcagcttagagctactaatttttacccctagataaagaggatgcctgtcagaggtgcagtgattacattgtgtccatgtggacagatgttttagattcttctatggttgtatttattgataagggtccagggatttctttttaagttcctgttaaagctattttcaggggctcatttataattaagcgcataaaataggaaagagaagaaagaaaatcacacaatttgtgatgtgtgattacgaagagatttatgactactgtaaatttcaaatttggttatgttatatgagagatgatagtgcttatggtggagcgtatgtttcttgaatagcaaatggaagataacaatacctactcacacttctgagaattaaatgatgttactatatataaaagctcttcgaaaattgcagtgcattatgcagattttcattttatgcaaaaagtggttatatggaagagtttgctgccaaattaagttcttatcctgtctaaatccattatatgtatataaagtagtttgattcataagtagctctgaattctctaatgaaaatagacagaaatgacttgaatatttgaaatctgtatatatgatccaaatctttttaaaggtttttttttgcaacgtcttttcttttgtaataggtacctcatcacctatttattggtagaagtgcgaataaataaaaagcaataaaaagcaactagaaagcaagcatattattaaaattttataaacacttgaataatttgacttctcagatttttttaagtaactaaaaaataatattatgacttcatatcttaaattatttagtaccaactaaagcaaaatcaggatgttaagcaagttgaacacaaaccatcacaaagttacctacgtgttagaaataaatctgatattgcaccttcacagcaacaaggtaagacttgtttttatgtaataatacaatagtttgatacttgtctgaatattgaacaaatatgagaattctttactttttatacatcccactgctctctaggtttttgttttcttttgttttctctcatttagtccatttacatgaagaatcggtattgtatttgactatgttagttctttttaccagtaaacactatttctagtggattttttaaactcttagctggtgtctttcctttacccttgccttttagttcttgttcaattgaataccaaggtctttttatctgtatataggtctgtttgacattacaatatgttaaagacagggattatggctgtatttaatatgctttgtaaagcacattatttagtgcgtggtggtgctgaccaagtataacttaaaagcaattgcctctcatattacatactgtgatatggatgaccatatcatagttctttatcaaactcgtgtggttacctttaattccacagtcagcgttcaagcattttgatgttgtctctatgtttctacaaggctgttggccttgtgttttgtttgccatcttgcttcttagtcatttacattttctataacctaaaatctgaaatttggcagtagaaattaagatctcttctgtttaaaaactttctgcccacaattctggaagaagtattagaaatattttgagaagtggaatttttcttttttgcttttataactgtgatttttatttaattttcaaataatatttaattgagcaaatgcatattattgaatgccggtataattgcgaatgtaactatgcatttggtgttttgggaaggacctaaatgaggaagtgctcaagatagtaagattatgccacttaaggtttaggttttcactcttccatttgttgtctgttcccctcttgctccaagttttcagaactttgtcctcctgaccctttttttttttaacctcaccatagtacgttaatattaatgtactatggaaaatacctataaaactcttcttctggtgatttaagaattaatcatgatagtatatcgatatgggcagataaatgtttctaagataatgtcagaatttacttcatgttcttctactgagttctcatttatgaactgtccttcgcagtcaatgatagtttctttaatgtttttaaaaatcaatcatttttggcattacaaatgaatttcattttcttgaggatgttgtatgtaatgaaataattatttttctcagctgataggaaaatgtctctggtaagatgttagctggtagaaggaagttttatgtggaaagggtttacaacagttggatttaatacatttgaaatgttttacatttaattttacatctaatacaaaaggtaggagagcagacctataccagccttgactaaaacaaataaataccagtgggctataaagagaacattttaaatacaggcgaagtctttcactctataattggtacatatctttatactagaaaatttcttgaatgaatatgattgccttggcaaatataatcagttatgacttttttccccatagattttgtgggttttattattttttttctctgatgaaactctgagacattgccaaatgttgcagaaaatagaagtcagagtgccaaaataattctctggagctctcaggactttgggtgaccttgaaggaattcaatcctctcatacatagaaaccttgaagataatgaaggaaattcaccttatcacaggggaattaaaaccacatcttttctagcagataaatgcttccaagaatactagaaccccaaattttggctatttcagggggaagtatcatgtatttcacttgaaatgtgtagtagtttaatatatgtctataaagaaaggagcagtagcagctgttttaatgatcatccattaaaaattaactgaagaatggtaggacacagattccagcaccatattgctaggaacttagtaaagtacttagtttttttccaccttgattattactttcagattttaatataaaagagaggaattcattgttctgacaaatggtatctttggagcctttaagagtaaaaccttttaatttggtattgaatttattgggtctatctttgaccacgtgataccacttacctgattctatgtactgattaatgtatctaacagttttatagtgaaagtactttttaaaaaagtatttgaatggtcatttctatttttccccctttgctgtacaagttaatttttactcatcttttgctgtacaaattaactttcatcaatacaaataagaggctagttttaagtcaatttatttgtcatgagcccaggaacaattaaattctataaagtaatgtattaaaatagtacactttaaaaattattttccttctttttttctctttaaattttaagaccatcataataaattatcattacaaagtcaaacatactatatactactatcagtcaatggggaaaaaataagtcatatgttttatggtaaaatgctgtaatagattggattgtcaaatttgcttgaaaaaaatcacagcagtttttagtttttcttatttgtagattacacgttactcagaaaataagtatcaaagtgctaaaagtaataggtgtaattgctgttatttgtcaaaatcagtttacatttttgtgggaaatacagaatcacaaatatttctttctggcattatgtcctgagttaaattctagaaaatttagcaccttttatactcatatagctgtgacaataactttaaatatgtgaacattaggaaattcaaagcttatatattcttagaagctaattttgaccacgtgcgcaaattatttttcttttttagtagaatggtgcattttttgcctttgtatttgaaatttagctaaattacaatagctatcagaactacaattgaccttagtaatttcaaaaccatagttataagggttttaagttgatttttaaaaatcttaagatatgatagggatttcaaaactatgtgtgtgtatctctgatagggaggggttggggcacagactaataagtgtgccaaaaatctgtgaatccaaatgtgtaacaagtgttgtctgaataaatgtccacaaatccatgctattattggttaacaaaaaataaattcactttgaaatgttgctgaatttgggagttttgtttctacctaggatgaggaaattggaaagagtgtcactttcaccctaactataataaaatgtcagataaactacaaaatcattaacatttcttgaacccatcagagagcttctgatgcagagcaactaagtagcctaaagtccaaggaaagacagactcctccaaaaagagatgagacacaagcactgtctcacttgtgacagagcatggttacaggaagagacaccaggcaccaatcaagcagataagaagtatttggttaaactttttaagtgggtttctaaaggccaagtatagaaccattggtagtcacagatacaagtggagttcacacccacttgtaggcatcttctgcacagacctctagagaaagattgtggggaaaggcagagagtctctctcactggtgcaggcctgaatgagaggagtggctgtcactgccagaaagacaggatgccccactttgacccttctcctttaagaacaaaagccttaagccactgaggaaggggcaacacatctgttatttccagggtataggtgaaaacctatttggctgggggaagggtaaagaaaaaaaaagaatccactcctggcggagaagaaggaaatagtcttggtcccacaatcttttattagcactattagaagtttcttactgttgggagagtggttggaaactgtcctgcacaaaatttgccaaagggacaaggcagaatttaaaatgtcagttccctccaaattgatctatagattcagtgcaatctcaaaaacattccagcagggatttctgggtagaagttgacaagctgaagctaaaactcttgagaaaatgcagaggacctagaatagccaaaataacttttaaaaagaaaaataaagttggaagattatactatataactctaagacttattataaagctacagtaatcaagacagtggaatattggcataaatatcaatgggatagaatagagaattcaaaaaaaaagtccacacatttatgattagttgatcaattgatttttacaaatgggaaagacgattccatggagaaaggataatcttttcaacaaatggtgtttggacagagctcatctatatacaaaaaaaagaacctcaatctatatttcaccaacacacaaaaatgagctaaaaaatggatcatagatctaaatgtaaagcctaaaactacaaaacttctagaagaaaatataggagaaaatgtttctttgtgacctttggttgggcaaagatttctaagctattgcagaaactaatgataattggacttaatcaaaataaaaatttctgttcttcaaaagacagtgttaagagaatgaaaaaggacaaatcacagactggaagaaaatatttgcaaatttgctttctgatgaagcagttatgtccagaatatatttttaaaccttacaaaactcaacactaggaaaacaacccaatttttaaaatgcataaaagatttgaacagatacttcaccaaaaaagaaatttggatggcaaataagcacatggaaaattgttcaacatcattagtaattgggaagatgcaaattaaaaattaaataccactgaatacccattaggttgactaaaatcaaggaaactgatactaccatgtgttggtgaggatatagatcaattctaattctgatacattgctggtgggaatgcagaatgcaacatgcaccttggaaaactgtttgacagtttcttataaaattaaacataaatttaccctatgactcagcagtccatttcctatgtattcattcaagataaatgaaaacttattttcacacaaaacctgtactcaaaacttttttagcagtttattttataattacccaaaactggaatcaaccaaaatgtccttcaacaagtaaatggataaacaatctgtgtggtacatccatacaatggaatagtactcagcaatgaacagacgtgaactactgatacacacacaacagcacagatgaatctcagttgcattaaatgtagtgaaagaagttaaaaggctacatactgtatgattccatttatatggaaaaggcaaaatttattggaaaaggcaaaactatagatatggagaacaggtcagtggttgccttgaagaagagtttgacaacaaatggcaggagggaacttttttccattttgatggaaatattatatatcttgattggggtagtgtctatataactaagaatttttcaatggttagtcttactggttataaattatacttcaataaaatgatgtacatattactaagtttatgacacttttgcttattatgaattttcttaattagcttatactaaaagcttatcacttgggaaagtataaaaggttttgttgttaaaaggtgtgtaaatgtgatactgtattacatttatttactcttacatctttttcttatattaacactttaggaggagatagtttgatgtattttataatacagtatattttcaatacagttaaattggatttttaggtgtttatttaaaaatacattccatttagactagaaatctgaaacatttatgttttataattaatagtgactaactggaaacaaagaaaaattgtatgtgctaatctacagtggaagtactcttgtttaaaattttcttttttagatttcagaaagggaagaactgtcagctcaaaaacttgtgttttttactggcacatccaatataatgtgtaatcaacacagtttaactcagtaaacattaattgagggccctccacactctacgctactaagcttcaatgcctttttgcattatcttctttccacccagagttaccttctctccccacttctatatgcctacaaattacttattcttcaacattcagctccatctttctgagttcttactgaacctccgattgaaaacgtcttattcattttaacccactctcttcccctagctcttttctgccttgaacataatcataatcttaacaacagttttttgctgggcacagtggcccacacctataatcccaacactttgagaggccgaggcagatggatcacttgaggtcaggagttcgagaccagcctggccaacatggcaaaaccccgtctctactaaaaatacaaaaattagccggacgtggtggcacatgcctgtagtcccagctacttgggaggctgagacatgagaattgcttaagcctaggaggcggaggttgcagtgagctgagatcgcaccactgcactccagcttgggccacaaagtgagactctgtctcaaaaccaaaaccaaaacaaaacaaaacaggggaatacatttaccagaggtttgctaggtgtgttctatgttaatttcatttattcatcacaataccatgccatgcaggtagttttgtttgtttgttttatagagatagagtttcactgtcacccaggctggagagcaggggtatgatagttcattgcatcctcaacctcctgggctcaggaagtcttcctgccccagcttccatgtagctaggactacaggtgtgtgccatcatgcctgactcaggtagttttattcctgttttacaagagagaatgataagattcttgaaggttaactaattttcccaaagcacataatttagaaaatgaagatctggaattccagcccagatcgacttgattgcaaagctgatgctcctttccttgtgtaatactatttattgaataagcatttaataaatatttatcgtgtgacttaacagcttgttgataagagctgcttttatcatctctatatttccaggactgattatttaatattccaaagaaagtgatatatgggatagtgttgtgatttgtttttaagatatgttatctgtttcttatttaagagagcttgtttcccagtgtagcactgtggtgatcagtaaatgttcatggaattgaatttgatgattacatcatttgctattaaccccaaacaacatttaattctgttatttagtaataagacggaagaaggaagggaagagaaaaatgagaatatttcattacaatcatttttccattactgtctctttttaatgtagacagtcgtgcaaacagccacagtggactaatctaaagtgatttttatttgcttttccaaaagattgatttcttttatagtattaacatacatttttattatttgaggacaaaatagttgaacagagggtaggggcagccgagaatatgcccaagggtggggaaaattaaatcagcttagatactagttcatggggaatctttttgaactttagatgagaaagaaaaatcgtgttgacattcattcactctttctttttaaattgagatataattcacatactgtaaaattctccctttaaattctcactggtttttagtatatgcaaaaagttgctgaattaccatccctttctaattccagaacattttcttcaccctaaaaagaaactccatatctattagtaattgttttccattctaccctccccaaccctaaccctgccaaccactaatctactttctgtctctatggatttccctattctggacatttcatataagtggaatcatacaagatgtggttttctttttggcttctttcacttaacataatgttttcttttagttttttggggttttgttgttgttgttgttgttgttgttgttgagacagaattttgctctgtcacccaggctggagtgcagtggcgtgatcatggctcactgcagcctctgacctcccggtctcaagcaattttcccacctcagcctcctgagtagctgggatggcaggcgtgtgccaccatgcccggctaattttgttttcattttttgtagagacaaggtctcactctgttgtccaagctggtcttgaactcctgggttcaagcagtctgcccacctcagcctcccaaagtgcagggattacaagtgtgagccaccgcacctggcaacataatgttttcaaggtccatccatattgtagcaggtatcattactttatttttttttgtagatgaataatattccattgtgcattcattcttaggttaatcttttttagcatccctttacataaagtaccatagaaagtgctgtggccctagagagatggataaaacaaagcatctgctctcccgggataaaaagaagaaaggccattttgtgaagagatgaagactgagcggttgtggccgccttgccgaccttgagcagcagttggcttctccacatagtacccgggaataggagtctcagaatcgaatctcttctgcctgctcacttctgtgagatttttttgatcttcagctacatttttggctttgtgagaagcctcatcatccaacacagtggccagcaacgttgccgacaagacggatcctcactccatgaactcccgtgtgttcattgggaatctcaacactcttgtgctccagaaatctgatgtggaggcagtcttttcaaagtattgcaaaattgtgggctgctctgttcataagggctttgcctttgtttagtatgttaatgagagaaatgcccgggccgctgtaggtggagatgtacagctcctcttttgacttggaccatgactttcaacgggattattatgataggatgtacagttacccagcacatgttcctcctcctcctattgctcgggctgtagtgccctcgaaatgtcagcatgtatcaggaaacatgaaggggaaaaagtggcttcaattctaagagaggacagcggggatcttccaagtctggaaagttgaaaggagatgaccttcaggccattaagaaggaattgacccagataaaacaaaaagtggattctctcttagaaaacctagaagaaaattgaaaaggaacaggggaaacaagcagtagagatgaaggatgataagtcggaagaggagcagagcagtagttccatgaagaaagatgagactaatgtgaaggtggagtcggagcggggtgcagatgactttgctgaggaggacctactagatgatgatgacaatgaagatgggggatgaccagctggagttgatcaaggatgatgaaaaagaggctgaagaaggagaggatgacagagacagcaccaatggcgaagataactcttaagcacatagtggggtttagaaatcttatcccatcatttctttacgtaggtgcttgtctaagatcaaatttttcaccagatcctctcccatggtatcttcagcacatgctcactgttctcccaatccttgtccttcccatgttcattaattcatagtgccctgcgcctagttccattttcacctcctttgatgccctagtagttttgttaagtcttaccttgtaatttttgcttttaattttgatacttctttatgacttaataaaaaggatatgtggtttttattaactgtctccaaaataatcttttgttatgcagggagtacagttcttttcattcatacgtaagttcagtagttgcttccctaactgcaaaggcaatctcctttagttgagtagctcctgaaagcagctttgagttagaagtatgtgtattacacccccacattagtgtgctgtgtgaggcagttcaacacaaatgcaacaacgtagttttgtgaatgagagctggcatgtcaaatgcatcctctagaaaaataattagtgttgtagtcttaagatttgtttctaaagttgatactgtgggttatttttgtgaacagcctgatgtttgggaccttttttcctcaaaataaacaagtccttattaaaccaggaaaaaaacaaaaaaagaggaaaggggtagttgagaagaataatttctttaaaacactgcatctcagaaataatttgttagaatactattaaatatgaaaaggcaaacatctttctataattaaactgtcaacttgtcactgttttcttatagtgctgaaaaataagcgtggcaacaagtgtgttaggtcaacttgcagattgtttttatgtatatacatttcttacattttatgtgaggatgtttggatgagagaggcataatccatatgagaaaaaatatttctctggcacaataatggatttttaaacataggtgattattttaactgttccaatgtgaaaggatttatactttttatttaagaggtagaatatgtatatgcatatctatatataatatctatatctatgtcatatatatatatatagtctaacagacaaatgtgcgtaactaaggatgatccctcagaatgagcaaaatgcataaaggattgacatggaaaatctgttaaataagacattgaatattatgcaaggatttctataacatttttacttgttggtactaaaagtaatttccttttcaatacagaagcattttaattgtggaaattatttgatttcctttttgtggaattaattatatactgtgtatggagagcttgggtttttctcatctttttgacattaaacacatctcaccaaaaccatacacgaggattgttttgaagacttgccaacattccaaaaacctcttcagccccttcattgttcttaaccagatttcctgaaacttgactttaaagtttttattatgatttttaaaatagatatcaaattgatataaaatataatttaaactattagatcaattagtagcctttttattcaacagctattacaaataatttaaccttataatcacagaggtaaatacagatttgataaaaatctttacattttgaaattaatgaggtaaatacttaagacttgggagcagaggaaccgtctccagttcaacagaaccaaaggttgtgattacgattaggagtagcatctgatcttttaattgaatattattattattattattattattattgagatggggtcttgctatattgcctaggctggtcttgagctcttgggcttaagtgatcctcccaccttggcctccgtaagtgctgggattacaggcatgagccaccactcctggcctcagtattatttttattataccacaatgccctccaaattaactgcaagttgatgtattacaaatgctattcttctaatcaacctagtaacgatttactaaaaattttttagtgattttaattttatataaattaggcagactatttcaagcaggtaacagtggattattccactaaaccagttctaccctttttgttcatataatgaaaataaaaagagaagcttgattatttcagttcagaatacattaccctcaaataaatttaggccagagatgtagctacgcagctgtccagtgtcataaaaaagcaattcaccggtgagtgatctctccattcagaagtgtgcagtcttaatgtatggctgtaagaaactgttattttatgatctttttactaaaagcttgactgaaaactaaaataaattaataaattagaacagagaagtgatatagtcttattatgcatataggatgaaccactactagattgttagtctctaatacagtattcctcaaactttaacagacatagaattctccgggagtatttattaataaaatgtagatcctaaagtgattgtttgcctgagacggggcctgggaatgtaaacattaaactagtacccgtggttattcggatgcagaagagggaggaccaccctttgagaaacactgattaaggactccagttgtttttgatgattctgttctatttagaattagaggcactttggagacaaattgcatgagttcaaatcctagctcagctatttaccagctggtgaccctgggtgaaatacttaacctctctgtgctattcttatctgtaatatagtatagatatttcatggtaattaaagacataaaatacacttttactagaacctgacatatattaagagctattaaagtgttagctttgctcattgcaacctctgcctcccaggttcaagtgattttcttgcctcagcctcccaagtagctgggactgcaggtgcgtgccaccacacccagctatttttagtagagatggggtttcaccatgttggccaggatggtctcaatctcttgaccttgtcatctgcctgccttggcctcccaaagtgctaggataacaggcatgagccaccatgcccagccctgaaagtgttagcttttattagcatgactgtttctaggaaatctctcctttttgaatactcatgttataatcagctctcctttaacagataggaaatgaacctatatttgtcctaagctttaaaggatgctggtgaggaaatgctaaagatggtacatgttcaatatagtgttagggagataaattaagtttcaacaaaattgtttctcttcagtgaatatatttaagattatatgtataagatatatcttaggggcctgggcaagatggctgaacaggaacaattccattgtgcagctcccagcgagatcaatgcagaaggtgggtgatttctgcatttccaactgaggtacctggctcatctcattgggactggttagacagtgggtgcagcccacggagagcaagcagaagcagggtggggcgttgcctcacccgtgaagtgcaaggggtcggggaactccctcctctagccaagtgaatccatgagggactgtgccgtgagaaacggtgcattccggcccagatactatgcttttcccatggtctttgcaacctgcagaccaggagattccctcaggtgcctacaccacgagggccctaggtttcaagcacaaaactgggcagccatttgggcagacaccaagctagctgcaggagttttttttcatacttcagtggcacttggaatgccagcaagacagaaccatttgctcccctcgaaacagggctgaagccagggagccaagtggtctacctcagcggattccactgccacggaacccagcaaggtaaagatccactggcttcagattctcactgccagcacagcagtctgaagtcgacctgggatgctcaagcttggtcgggggaggggcgtccgccattactgaggcttgagtaggcggttttcccctcagtgtaaacaaagccgccaggaagttggaactgtgtggaacccaccatgtctcagcaaagccgctgtagccagactgcctctgtagattcctcttctctgggcagggcatctctgaaagaaaggcagcagccccagtcaggagcttatagataaaactcccatctccctgggacagagcacctgtgggaaggggcggctgtgggtgcagcttcagcagacagatgttcctgcctgccagctctgaagagagcagcaaatctcccagcatagcgctcaagctttgctaagggacagactgcctcctcaagggggtcgctgacccccatgcctcctgactgggagacacctcctagcaggggttgacagacacctcatacaggagatctatgactggtatctggtgggtgcccctctgggacaaagcttccagaggaaggaacaggcagcaatctttgctgtttggcagactctgctggtaatacccaagcaaacagggtctagagtggacctctagcaaactccagcagacctgcagcagaggggcgtgaatggtagaaggaaaactaacagaaaggaatagcatcaacatcaacataaaaggacacccacgcagaaaccccatctgaaggtcactaacatcaaagaccaaaggtagataaatccacaaagatgaggaaaaaccagtgcaaaaagcctgaaaattcccaaaaccagaacacctcttcttcaaaggatcacaactcctcgccagcaagggaacaaaactggatggagaatgaatttgatgaattgacagaagtaggcttcaaaaggtgggtaataacaaactcctccgagctaaaggagcatgttctaaccctttctattccttcaaattagctctggaaaggactacagaaagctggactgtaatttccctttgcttactcaggtcatctaaacctaaatagtctgagtatattgccttaatcagaatcacattttcccctctttaattccttcccccataataaaggaagctaagaaccttgaaaaaaggttagacaaattactaactagaatcaccagtttagagaagaacataaatgacctgatggagctgaaaaacacagctccagaactttgtgaagcatactcaagtatcaatagccagattgatcaagcggaagaaaggatatcagagattgaagatcaacttaaagaaataaagcgtgaagacaagaatagagaaaaaagaatgaaaaggaatgaacagtgtctccaagaaatatggggctatgtgaaaagaccaaacctacatctgattggtgtacctgaaagtgacggggagaatggaaccaagttggaaaacactcttcagaatattatccagaagaacttccccaacctagcaagacaggccaacattgaaattcaggaaatatagagcataccacaaagatattccttgagaagagcaacctcaagacacataatcgtcagattcaacaaggttgaaatgaaggaaaaaatgttaagggcagccagagagaaaggttgggttacccacaaaaggaagcccataagactaacagtggctctctctgcggaaaccctacaagccagaagagaatggggggccaatattcagcagtcttaaataaaagaattttcaacccagaattttatatacagccaaactaagcttcataagtgaaggagaaataaaatcctttagggacaagccaatgctgaaagattttgtcaccaccaggcttgccttacaagaactcctgaaggaagcactagacatggcaaggaaaaacttgcaccagccactgcaaaaacatagcaaattgtaaagaccattgacactatgaagaaactgcgtcaactaatgggcaaaataaccagctagcatcctaatgacaggatcaaattcacacataacaatattaaccttaaatgtacatgggttaaatgccccaattaaaagaaatagactagcaaataggataatgagtcaagacccatcggtgtgctgtattcaggagacccatctcacatgcaaaggcacagataggctcaaaataaagggatggaggaatgtttaccatgcaaatggaaagcaaaaaaagcatgggatgcaatcctagtctctgataaaacagactaaaccaacaaagataaaaaaagacaaagaaggttattacgtaatggtaaagggatcaatgcgacaagaagagctaactatcctaaatatatatgcacccaatacaggagcgtccagattcataaaacaagttcttagagacctacaaagagacttagactcccacacaataatagtgggagactttaactccccactgtcaatattagacagaacaatgagacagaaaattaacaaggataatcaggacttgaactcagctgtggaccaagcaggcctaatagacatctacagaactctccaccccaaatcaacagagtatacattcttcttagcaccacatcacacttattctaaaattgaccatataattggaagtaaaacactcctcagcaaatgcaaaagaacagaaatcataataaacagtctctcagaccacagtgcaatcaaactagaactcaggattaacaaactcactcaaaacggcacaactacatggaaactgaacaacctgctcctgagtgactactcggtaaataatgaaattaagacagacataaataagtgctttgaaaccaatgagaacaaagacacaacgtaccagaatttctgggacacatttaaagcagtgtgtagagggaaatttctaacactaaatgcccgcaggagaaagcaggaaagatctaaaattggcaccctaacatctcaattaaaagaactagagaagcaagagcaaacaaattcaaaagctagcggaagacaagaaataactaagatcagagcagaactgaaggagatagagacacacaaaacccttaaaaaaatcaatgaatgcaggagctggttttctgaaaagatcaacaaaatggatagaccactagctagactaataaagaagaaaagagagaagaatctaatagacataataaaaaatgataaaggggacatcaccactgatttcacaaaaatacaaaccaccatcagagaatactataaacacctctacacaaattaactacaaaatctagaagaaatggataaattcctggacacatacaccctcccaagactaaaccaggaagaggtcgaatccctgaatagatcaataacaagttctgaaattgaggcagtaattaatagcctaccaaccaaaaaaagcccaggaccagacaaattcacaggcgaattctaccagaggtacaaagaggagctgctgctattccttctgaaactattccaaagaatagaaaaagagagactgctcccttactcattttatgaagccagcatcatcctgatacgaaaacctggcagagacacaacaaaaaaaagaaaatttcaggccagtatccgtgatgatcatcagtgtaaaaatcctcaataaaatactggcaaaccgaatccagcagcacatgaaaaagcttatctacctcaatcaagtcagcttcatccctggggtgcaaggctggttcaacatatgcaaatcagtaaacatgatccatcacataaacagaaccaataacaaaaaccatgtgattatctcaaaagatgcagaaaaggccttcagtaaaattcaacgccccttcatgctagaaactctcaataaactatctattgatgaaacatatctcaaaatagtaagggctatttatgacaaacccacagccaatatcatactgtatgggcaaaagctggaagcattccctttgtaaaccagcacaagacaaggatgccctctctcaccactccgattcaacacactactggaagttctggccagggcaatcaggcaagagagagaaataaagcatattcaaataggaagggaggaagtcaaattgtctctgtttgcagatgacaagattgtatatttagaaaactccatcatctcagcccaaaatctccttaagctgataagcaacttcagcaaagtctcagggtacaaaatcaatgtgcaaaaatcacaagcattcctatatgccaataatagccaaatcgtgagtgaactcccattcacaactgctataaagagaataagatacttaggaatacaacttacaagaggtttgaaggactttttcaaggagaactacaaaccactgctcaaggaaataaggacacaaacaaatggcaaaacattccatgcttatggataggaagaatcaatattgtgaaaaagaccatactgcccaaagtaatttatagattcagtgctatccccatcaagctaccaatgactttcttcacagaattagaaaaaactactttaaatttcatatggaacctaaaaagagcccatatagccaagacagtcctaagcaaaaagaacaaagctggaggcatcacgctacctgacttcaaactatattacaaggctacagtaaccaaaacagcatggtactggtaccaaaacagatatatagaccaatggaacaaaacagaggcctaataaataacaccacacatctacagccatctgatctttgacagacctgacagaaacaagcaatggggaaaggattccctatttaataaatggtggtgggaaaactggctagccatatgcagaaaactgaaactggacctcttccttacaccttatacaaaaattaattcaagatggattaaagacttaaacataagacctaaaaccataaaaaccctagaagaaaacctaggcagtaccattcaggacataggcatgggcaaagacctcatgactaaaacaccaaaagcaatggcaacaaaagtcaaaatagacaaatgggatctaattaaactaaagagcttctgcacagcaaaagaaactatcatcagatgaacaggcaacctacagaatgggagaaaatttttgcaatctatccatctgacaaagggctaatatctagaatctgtgaggaacttaaacaaatttacaagaaaaaaacaaccccatcaaaaagcgggcaaaggggccgggtgcagtggctcacgcctgtaatcccagcactttgggctttgggaggccaaggcaggtggatcacgaggtcaggagatggagagcgtcctggctaacacagtgaaaccccgtctctactaaaatgtacaaaaaaaaaaaaaaattagccgggcatggtggtgggcacctgtagtcccagctactttggaggctgaggcaggagaatggcctgaacccagaaggcagagcttgcagtgagccgagattgcaccactgcactccagcctgggggacagaccgagactccgtctcaaaaaaaaaaaaaaataaaataaataaaaaataaaaaaaaattgggcaaaggatatcaacagacacttctcaaacgaagacatttatgtggccaacaaagatctgaaaaaaggctcatcatcactgctcattagagaaatacaaatcaaaaccacaatgagataccatctcatgccagttagaatggcgatcattagaaagtcaggaaacaacagatgctgaagaggatgtagagatataggaatgcttttacactgttggtgggaatataaatcaaccattgtagaagacattgtggtgattcctcaaggatctagaaccagaaataccatttgacccagcaatccctttactgggtatatacccaaaggattataaatcattctgctataaagacacatgcacacgtatatttattgcagcactattcacaatagcaaagacttggaaccaccccaaatgcccatcaatgattgactggataaagaaaatgtggtacatacacaccatggaataatatgcagccatgtgtattatgactagttcatgtcctttgcagggacatggatgaagctggaaaccatcattctcagcaaactaacacaggaataggaaatcaaacacctcatgttctcactcataagtgggagttgaacaatgagaacacttggccacagggaagggaatatcacacaccggggcctgtcggggggtgggggataggggagggatagcgttaggagaaatacctaatgtagatgatgggttgatgggtgcagcaaaccaccatggcatgtgtgtacctatgtaacaaacctgcacgttctgcatatgtatcccagaacttaatgtgtaattgaaaaaaaaaaggaaaaaaaaagtatgcctgaacatgtatgtgtatgcagcagacaagaggaggtaaatacctatggctgataagatggcatcaaactacataccaaattgttacttcacttctgtttctctggcttacttcagaattaccttgcataggatgaaagatttaatggaacaggaaagggtatttgtgttcagcctcagcttttaggatgggagtagccaatgggtataatctgggcaatcctgcatgtgcagactgggaaacccaagtcttatatctcatataccatagtaatttttacagttccacagatgaaaatgaaatgaaatcaattccatcattttcagaaaagatatcttttaagaaatctattattattattataagagcaaaataaaacaggatcactcttttatataattacaaaatatttttaaatatgtgcatgacaaatgctgtgtaatacacctcattattttcagtgtccctgatgggctccttatccttgacctaaaaatggtgattccaaatttaagactttcttgggtatattttttaattggaataaatacagaggtcaaaattactcttgggtttctaagtaagaagaaatgcaattacttgtgaattattttaagctcgaatgctatttgctctctgttaaaatggtaaaacaaattactcgttatggaatatatacccacaaaagtctttcagtaaaatgttattgctaaaatgtatcttaaaatctaattgttagtctttgttacacttgtcagctcagaatggtcaggaacctttttttgtgataagcctcacagaggctatggaaaacaggagcacttttttcttgggaatataattgcagtaatactgtaccacctaatggagtcagaaaaaacaatttatgtagaaatatagttctgagagccttgcgattattgccttttgtgtcattctacctacattacacaaagtaggacttaggaagtcctggaaatcatatgttggatattttctaattactgtgtcagcatgatcaatcattttctaaatttgccagtttcctgaaatagcttagcttatgttcatagcactttagaggaagcagcataaaattagtttctattggtgtcacaaaagaaatgaaatatttatctttggcaaaaagacctgtacaccaaacttcaattaatgagtacaagaattagaaatcaaaactttgtttagtctaaggaaaaacagttctttaaactgtaaccacatggctgtttcttgtttgcatcaactctgggtgactgttattgtcttctgtgaattctctggggcaggggcctgactttgttgaatgagccaattgttttcatttgtgttgcccatctagtaagttcccatctggtttgtatcagactgttttcacagccaacaactgctgccttctctatatcctgacacttcagggccccacgctatcaaagcactgctgcgatggccttgctggcagggcctatacagctgtgccttacagcttggaactattacccagagtaatggtaacgtagaacttggactggcccttattcccactggtgtcgtgtgtacagtgagcagaaacccaccctctccctctctcccccttgccccgaaacttgctattcaacagaaaatctttaaagctcttattttaggatgtggaatggtggtgtttttattttctagtggcttcctgtatttgaaagctcatttttcattctttcactctttcaaaagttaccaggtctggccttagggaagtgaactggtcactatgtcacatttaatttttgtttccatatttagttaggaatggctagagatgtcaaaacccactgtcaaggctacacagataatacagtatatttttagtgataaccacaagccataatttgagagaagtcttcatatttaggaagggtttccatctcagaaaatagattttctgtgtatagatacagaggcacttagcttcaaactgcttagtaaatattagggagttactttgccatcagctttggtaattatcaaatgtcatttataagaatgttataatagtgaccttctctaacagtctgtggcctggtataatataggtgtattagaattatgggtgttattattgacaaagatatggttgagtttaagtgtagttatgatattattgcttaatagacataaactgaaacagcaaacttctttcctaccaaagaaaggaattaaatgtgaatttacaatgtattaagattttttaaatgctgaagattagttaaaactggattatagtttgtgctttcaattaaatcaagtggctgattgtcgtagagcacgaagtatcctagatagtaagccctgtgagagttaaactacagcaacaacaaaatctcaccttctgcttctgaataatttcagtgcactggtatttcaaggttttaggaaaaaaaaatagaaaggaattcatctttgtagtcagcagtacggcctatgacttagtgtaactatttatttgatattaaaggttacctagtaatgccagtaatttggcttaattttatcattggaaaaaagtttaaaactacaaaggtatcatcttttaattgctgaaactgccctattggtttcttccattttaacttttttatggaagaataatatacattcagaaaagtacacatattgtaagtgtacagctcaaagaattttcacaaatacagtacacttgtggaagcagtatccagctcaagaaattgaacactgccagacccccaaaggccctcatgctccctttcagccacagtctctactcccacaagcataaagccactactctgacttccaacaacctagattagtttccttgtttgcacttcacataaatgaaatcatacggtatgtatggcttctttcaccaggcaaacctattgtagtttttaagattcttttagtttttaaactattatggcatgcttttataaagaatgatctgagaggaatttgttttagtagctgtttcacaggctgttcaactaacaggaagtgagttgtagataaagttgtctattaaaacatagagtctctcagttctcaaccaaattttaatgctggaatgtccctctagacattcttgcccctaaaaggcaggcactctctctgtcataacaccaacaggaatacagtcaagtacttaaatgctttttaataagctttaataattgaatgtacattactcaagttaattgtgatttgcattcaggataggtgggtcatctattttctgaattaactatcaacttcttggcagtgggatatatacttttatgccgccaggatcctatttctgaaaatgctattatttaagagagttggtatacctactagagccaatgagtaacttaatttggaggatctggccaggttatttaacaagtactaacttctttttatatatttttaagtaccctaataatttattggatttttttttttttttttagtgaactcaaattagtataaaaatgtagctatcctgactgttactaattttagatgtctccttattgagttttgttttaaattctgtacatcgtccctttaaaaatttatgttgttttgtgggttaaaaaattcacattttggggggcttcatctttatatccttattttgcagttaacagccttatagttttatgctgttttcttagataatccataaagaatttgtttaaaataatactataaagatttacaaatgtaagtattactataccagtgactcttactgaaaatagcattgaagagtcagaaagtaagctttgaagcccaaaataatttttttttaaatatgagtataactgttataaagcccaaatttcaattttttaaaaataccaatttttataaatgtcattttattttagatttgggggtacatgtgcatgtttattgcatggatatattggtttattgcatggatatattggtatattgcttaattgtggggattgggcttctaatgtacccattacccaaatagttaacattgtacttgataggttatttttcaaccctgcccccccttcgctggcttttggagttttcatcgtgtattatttctatccgtatgtccatgtgtacccattgtttagctcccacttataagtgagaatatgtggtaatgaatttcctgcttctgagttagttcacttaggttagtggcctatgagctccatctatgttgctggaaaggacatgatttcattcttttttatggctgtgtagtattccttgaaaaataccaatttttgaaaaggatgtacactaactataacatggtttactttcacttggcaccagagatagcaacaatattttgaacgactatttgaaatgaaaagctaaaatattgaaataaggggggtatttggaaaaggcacagtgtgtacaagtagtgcaatcccagtactccctgtgtgccttcaattaaagctttttcagccagtatccctgcttttccaggctggaattctatttccaaatctaagttcacttgttctttattttgtagtatcttcaaacatttaagtaaaagctaacaagtcagctttttgtggtaaagataaaaatataaattatatttatagttaatatataactcaatttctagtcagcattgctcattcaaaatttccatagaaatgttaatagaactttatagatcaaataattccaaaattttccttctcatcttttgacttcaataccagtattatgtttttttttcagttttgatcagcaggataaagaattgtaagaactgacaaacttgagaagcagttttcaagttgtgttgacctagttgtaggccgtgtttgctgttttaatcatcaactgcagagcacaatactcacccttccagtaaacctcgtaaatcaacaagtgagaattatgaagccacttacttgttataagaataaaagtggtcaactctgatactgtgatagtggcttattttttttaactgttaagacgtatcactgcagaagtcaagatcctcccccagttttgactgaggagagttttatgtttacaataacagcaacaaccatatgtcatagtaaccatttatgtacccttcctttaggtggcatactctgctaagatccttgatcaactcaattagggagttaatattctcattacttgctataaacaagtggttcttcaatggaagggatctctgaggtggtattgatacctttgttttcatgtttatactctgtgttctctgtagaatttgaaagggagctctattaaactggagggaccaagcagtaataatttctgtccctctctaactcttggaagtttagaaacaaagtgagaagtgaacacagataacatttaaacattaacatcatagtaagcacttttcttttttttttgagacggagactcgctctgtcacccacgctggagtgcagtggcgtgatcttggctcactgcaagatcagcctcccaggttcacgccattctcctgcctcagcctcccgagtagctgggactacaggtgcctgccaccacgcccggctaattttttgtatttttagtagagatggggtttcaccgtgttagccaggatggtctcgatctcctgacctcctgatcttcccaccttggcctcccaaagtgctgggattacaggcgtgagccaccgcgcctggcccatagtaagcacttttaatacatttaaagattttttaaaattgtatcacagttgagctgggcatggtgacagacacctgtagttctagctactaggaaggctgaggtggcaggatggcaggatcccttgagcccagaaggtcgaggctgcagtgagctatgattgtaccactgcactccagcctgggtgacagaatgagaccccatttctttaaaaaacaaacaaacaaaacctatatcacagttgtatgttcaattttggtctatttgtggatatcaaatatatgtaacttgtatttgtccacactcttgtccttataaaacattaaattttctacagtataacaataatagtttaacatgaatgtttatctccagtgagaatgtattgcccagcataatgaaatatggaatgcttataaacttgctcatttaaatatcttcttataaaaatccacccaaaaatttttttaatttttagtataaattttttttaatttttaatttttgtgagtacacagtaggtatatgtatttacgggttacatgagatattttgatacaggcatgcagtgtgtaataatcacatcagggtaaatggagtatgcatctcctttgtgttacaaacaatccaattatactcagttattttaaaatgtgcaattaaattattttttactatagtcaccctgttgtgctagcaaattactgggcctaattcattctttctattttttttttttttttaacccattaaccattcccacttcccttccgctctcactaccattcccagcctgtggtaaccatccttctactgcctatctccatgagttcaattgttttttcttttcttttccagcctggctctgtcgtccaggctggtaggcagtggcaccatcttggctcactgcaacctctgcctcctggactcaagccatcctcccacctgagcctcccaagtagctgggtctacgggcgcgagccaccacacctggctactttttgtattttttgtagagactaggtctagccattttgcccaggctggtcttgaactcctaagctcaagtgatccacctgtctcaaactcccgaagtgcttggattacaggcatgaaccacctcacccagactgtttttattttttagttcccacaaataaatgagaaccttcaaagtttgtctttctgtgtctggtttatttcacttaatgacctccagttctatccatatcattgcataagacaggatctcatccttttttatggctggataacactccattgtgtacatgtactacctgaaatttttgtgaaataaatgaagcttaagagataactgatttttatcttaaagaaaattagaaaagaaatactgattatacaacgttctaatttttttcatatcaccctaccccaagaatttgtttgaaataagttatagaaggttgttaattgactgtacttcacagcacagattaacagcatcataacggagccatgcccttagtatccagagtgtcttgttggcctgagacctatatgtgctataggtttctctcagttaactttccgattctctggccataaaaaagattttttcctcagcctattttatctcaatactaaaaatttgctttgctataatagtgtattgctcttctgtgctccctgccagctttatgggttgtttcctacggattgtattgagtaatatgctccaggctggcctaggaagaagggagattctaaacctctttttgtaattattaaattcttaggtaagagaatctgtgaaaacttttcacctttgaagaaatggcccattaatttcctttatttgatacaaatttcagattttctcatgaccctttgcttcccccccccatctgtgatgcataaagataataatccgttaaagtatttcctattgatagtcattaaaattcagctgtttaacttccttctttacattcaggccactagatcaaacttctgtttacctggttttatgagaataacggtgggagtgcatttggtttgtgttcttttagtgaataggaatgaatcatgattatttctatgcttaactgattttcttctgaaaaaataaatttttatgtagtttcaccaggtgatatggatcggacacaaattgagcttaatccgtacctcacatgtgtattttcaggtaagatttttactttaaaagttcttgaacttggagctgttcagattttttcatttcctgatgattctttctctcataataatcaacacagtagaaatactaatagcaatttttaattcttctgtaatatctgtaaattcaccccaggttacaaactcagctctccaaaaggcgtaagttaggggacaggaaagaaaacctatcgtttcgctttggaaagtttataaaatgatgaattaaaaggctgcaggtgtggtattcagagcactaaggataagactcgagataattccatctgggggaggttatttgttgggacaggacagtgtttaaactttgaagtcattttaaacaaagtgaagcagctggaacctggcataaaaagaaacagatctttcacattaacgattgctttttagaggaaaaaattggagttgtttttacaggtgtcggaacatttattcttcctataagaactgctttgtttttaccttaaattataaattttaaaataagcatttgtcaactcatttgaaaaataaaaaaagtaataggattcatatgcctaaaagatattttgggataagatcattgtaacattttaagttaccctttctaaaacatgagtaaggaaagaaatgtttaatagtgactaattctggaaagcaaaagtaaataaaatattgcatactatacttaacatcaaatgatgaggcaccttcttcatcaagtctttcatttattctcaaacactggggctatgatgttgcaaatctgtaggactgggttaagtatgtgaggagaattgaatacagcaggatagtttagcagctgcttacacaggaattggagcaagagtggatgagtccagggtgtacaggaaaaatgcttcaagaactcaataaaacacagctgaaatactgtaacattttcacagacagctgggaagcaactgcattgctggaactcagggctgattttaaagacaagatctggtcagtgtgaatctaagcaagctgttagcaaagagaaaccacagactctctaggtaggaacaaatcaatttggttcagcagtcatttcaaggtccactgtttgcccagcatcatgctgaggctttgtagaatgcagaggtaaataagacacagtcactgtcctagtggagcacatctttaatggaaacaacagacttacaagttagtaacaataatacaaggtgataaggtcacagatacttactgtgtacctgctatcctagtcactcagaacacaaagactgtcaattccaaagactgtccatgcccttaaggaatgcattgtctggaagaaatgacagatacataaataattacagtgcagtctggtaagtgctgcaatcagaataagacagccacaattaacaggagaggaactaatatttcaccactatcactggaaaaacaattcagagaattgaatcctaccattcgttacataacttattactcagaataaattatagtttttcttttacttagttttataaatctgacatccaaaaacagaaaacataaaatttctttatgaattttaaatatttttaaagcaaaaaattggaatttcaaatgtcaaaaacgtgtattaaattatgtctcaggaagcttctaacgcatggtctgactccatggcatgccccacttaaatgcatgccaggttaaatgacacactgcaaacccatggaatcaaggaatagtcttttttatagacctgaaaacagctgttgaaacaattacatcatagagtaatgacttgactgtgcaaatttaaaaagtcaaactttaaaagcatcaaactatatttaatagaggtagaagatttatatttgctttcatggtgatttattaaaatgttatgtcttttctttaaaaaaattaatttttttatgaatgttacccttttcgcctgttcacagtaatctaagtgatgctttttttaatgttcccagtctaaagagttctcttacaaagttctaaaactgtgatttagcttgtgtaaatgaatactttaaataaaaagttttcagccgggcgcagtggctcacgcctgtaatcccagcactttgagaggccgaggtgggcagatcacggggtcaggagtttgacatcagcctgaccaacatggtgaaaccccgtctctactaaaaatacaataattagctgggtgcggtggcacacgccagtaatccaagctactcaggaggctgaggcaggagaatcgcttgatcccgggaggtggaggttgcagtgagccaagatcatgccattgcactccagcctgggtgacagagcgatactccgtctcaaaaaaaaaaaaaattcccaaaatatacattaacaaataccttttgataagatggtacattttattgctataacttcttgattaaaacacagttaactagagtttaaactagcataactatttagaggccttccagagtgtactctctctttccccactccctctttttttcttaattgtatttcagtgaaacattcttattcctccttctaaagcagagtaccttttgcagcccaccctgagcctcattgcctcttagatagtggctttccaattacataaaagtaagagctgatatgtttgtgtgctttctatgttccagcactatataaaacactttgtatgtattatctggctgaatcctcataaaaacctctgaagtcagccgggcgtggtggctcacacctgtaatcccagcactttgggaggccgaggcaggtggatcacgagatcaggagattgagaccatggtgaaaccccgtctctactaaaaatacaaaaattagccgggcgtggtggcgggcgcctttagtccctcgcagctacttgggaggctgaggcaggagaatggcgtgaactcaggagatggagcttgcagtgagccaagattgcgccactgcactccagcctgggtgacaaaacgagattacgtctcaaaaaaaaaaaaaaaagaaaagaaacacctctgaagttggtactcatattttttttatagttgagaaaactggggttcagagaagttacgtaactttttcagtctcttattattttctatccctcttaccttttacctatttttctttatagtacttagcacttcctgttatattagatgtttatttccttacttgtcattcatcccctaaacccaacagaatgtgtggccagtgaggttagaccctttgttttcttcactgctgtattctccagagtctagaacagtgccaggcacatagtaggtgcacagttgatatctgttggatggatggatgagctcagctctgccctgttccagaatccattctcttatcccctctgccttttactccttcccatacagaagcctcacatcagcagtctgggtggggccattcctaagtgacctgatttggaccctactcttgatctgtcatgaagagacttgtgcttaaaatttcatcaccgctcccaagtttgttggtgttcttattactgcctagtcagtcaaccaaatctgtcatttcagagtgaaacttggttctttataagtactaagtctccatccaaaatatcttgaccctatttccactgccaaggatcattagttcttctatggactatttttatagatccgtctcccgtctctctattttccacacagctattaggatgatttttacctcttttttttttaacttttattttaggtttgggggtacatgtgaagaaggtttcctgtataggtaaactcgggctgtggaggtttgtcatacagattatttcatcacccaggtattaagcctagtacccaatagttattttttctgctcctcttcttcctctcaccctccagtctcaagtagatcccagtgtttgttgtttccttctttgtgttcatgagttatcatcatttagttcccacttataagtgagaacatgcagtatttggttttctgttcctgcattagtttgcaaaggatgatagcttccagtttcatccatgttcctgcaaaagacatgatcttgttcttttttatggctgcatggtattccttggtatacatgtaccacagtttctttatccaatttgtcatccatgggcatttaggttgattccatacccttcctgttgtgaattgtgccgcagtgaacatttgcatatatgtgtctttatggtagactgatttatattcctctgggtataaacccagtaatggaattgctgggtcgaatggtagttctgcttttagcttctttgaggaatcattatattactttccataatgattgaactaatttaccctcctaccaagtgaataagtgttcccttttctctgcaacctcaccagcatctgttattttttggccttttaataatagccattctgactggtgtgagatggtatctcattgtgattttgatttgcatttctctaatgagcagtgatattgagcttttattcatatacttgctggcctcatgtatgtgttcttttgaaaagtgttcatgtcctttggggttgtttttctctaatacatttgttttaagttccttatagatgctggatattagaccgtagatttgctcaaattattcctgtggtcaaaattttttgtgactccttactgctttcacaggacttggccctggccttgcttatctcaccatttctcctatccaaacaatatttgatatcagaatactcagagttcccttaacacattaactttatcttgactttattttgttattctgttttccttcattgccttcccaccatcttttcagtcccaactcaatggctaccttccacttcatttaagtattcctatacatgtttatctcctctactaggtgatgaacttcttgaggatgaggactctgtcttcttcatctgcatatgctcttagctccatacatgcagaagattcatatagatgtttagttagtgcatatatgcttttggagaagcccactttaatgtctctgggcctcagttgccttgtctgtttctgagaattactgttaggatcagataatatgatgaaaacgtatttacaaaatttgaattgttatacaaatataaggcaataactgcaagaaatgcttacagtgattgaattcagtatgttccttgagacttggaaacttctaggagatccctccaccctaaaaagttatagctcttattacaacattgagcaatttaatctgtaattttatgcacaaagtagaaaacgaaggtatatacaaagtggttttgtgaaattaaataacagagaaaagaagagtatttggtatcactgttgtttttggcagatgcataactcaaggaatggattagaaggtaacattaagttgtttgtatgagtggaaaattaatttgccctaggacttagttatatccagtgttagtttttactttattcatgaggtgagctctgatattggctgcttccctcagttattttgtgtattctgcatcatggctttgtaaaatataagaatgtttaaatattatatattattaatgcttgtgtcctatacacatttttaaggccaggcatggtggctcacatctgtaatgtcagcactttgggaggctgaagaaggaggatcacttgagaccaaggagtttgagacaaaggagtttgagaccagccccggcatcatagggagaccctccctctacaaaaaatttttaaaaattagccaggcatggtggtacatacctgtggtcctaactacttgggaggctgaggtggaaggatcgcttgagcctgtgaggttgaggctgcagtgagccatgatcatgccactgcactccagcctaggtgacagagcaagaccctgtctcaaaaaaaagatttaaaaaatacagtctttagtgtctattcattgcatttttattacatcctgacaaactgaaaagactaaaatcttttcctatttgaaatattctatttaaattcacataaaacttgttttctttttaaatactatggtattatattatagtttgtgatattgctgtaatgataccaaatcttatcttcctctctctttttataaaaaaatgaaatagtaacaaaaaggagtgatacagtatttaaaatagtctttattaaatttccttatatgaaaggaattttccttttacaagtattctgagcttggacagctatgattgagacatcattaaaatctccagaactgtctaattatactgtggcccctataaaaatttaatgaaaaattctatgttattactgtagaaactacttgaaaaacataaagggattttagaaaaattactgtgactcttgtctgaaatatgtctttaagattgtttaaggtaatttatttttaacgtatttattattcttatgtctatggtaaatccatgaaattttaaatgaggatttttgtttgtttgttttaaataataccaagttgacagtctttatattcttaggcattgtgctttaaacttacaggggtgaatttgggtataggcagatacatacacttacgtagtcaactttgaattttttacatattaatgaattatttatcccaaactgcctgccctctgccaccagccagctttcatattagacattataatattgctctcaatccatgaagtgggaattttttttcatatttcattaaatgtagagataatgtctactttacagtagagagaaaagtctattttacagagaaaaatgctttccaaagtcaagtgtcagtaatacttggatgaccactgcagtatgtttttcctctgacattgctaaccttatatcacttctgttggctaatagcatagcacccttaggcactcagtaaatcattattaatgacatgctcttgagtttaagagtccattttttaggaataggaggaagagcaaagtgccttggcaacctttgacttcaaatgccttttacatggctgatatcttacctcttttaaaaaaaaaaaaaaaagttcttgctctaaccacaaacctttaatttctggctattatagtgttttattgctctcctagctatttacttaatggtaacagtagtaataatggctatcttttaatggtaatgggagcgcttagtttttgaccacttactgagtgctaagctctgttgttgagctcttcactgacactattttatcctcactatactgtgcaaagtaggtactattatcccatttaacatatgggaaactgaacttttgagtggtaaaataacttggtgacagtcacacagccagcaagaagttaagtctggatttcagagactaggcccttaacccgttacatttgatcttacttagcatttatcatctgtatcacaacttttagcttgtatactgatgttgtctctgactgattaggagtgagggtggaaaggaggaaggtgtattttacctctctgacaagttctgagcaccttgggacaagagagtcccttgtaggcaatccttatttggaatccgcgcccccccaccccaacctcatattatttcgcaaagcataaagcacgtaaatactcaggttacgcatgttgagctgaatgagcttctcctttgtgcaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtcattataagtctgattgtgagttgtttcttagaatcctgagatagcatagagtagtgaaagggcatggcttttgacatctaggcatttaatctataggtgtaattatctgtatgtatttataaaattatgtagctcaaggttattcattctaacatttttataacagcaaatagaaaaaatcaaatgtctatcaataatagactggttttaaagtgatggtacatcagtacaatggaatactatgtattacaaaaaaaaatttaaaaagtttattgatatggaataatctttgagatgcactgttaaagtgaaaaaagccatgtgcaaaatagtgtgtgaactatgcagttgttgaaattatttaaaatggggtggggagg

SEQ ID NO: 426 - DNA, 49383 bp, Homo sapiens
gactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctggtgagacgagccgggagggcttgggcccctccccctccctttaactcacccctcccccacccagatacccccgaccctccccaggctcccaccaagctggggtgtgtgtgtgtgttgggggtggggtgtttccgcggaaatgctgcgtcctgggccctctgaggcaggggcgcgcgtaaagctggggggctcttgggcgtccctcgcggctccccaggcctgttgggcctcggagctgggacgggcgggtctcttgggacccgggccaagccgtgcatgatgtcattttgtctcccgcctaattgcgggatgggggtgggccggccggtgtcagctggcagggccttcgccggcgagggaggcgacccctgggagcgagagggagtcttcaagtcccagccagtgggagaccgagcctgggaggcacttgttgcagcctagttttgggtcaacttggtgggtgggctttgctccttaacattccggggagcacagagtcccccaagccctctcccctggactgagaagggtgctgagttgggggctcttttgtctctcccacctgggttccgcgccccagcttggttcggtttgagacctctcttcctgttcccacgaggagttttgggcagctggggttgaaggtgcgggggagagagagagtccctggggcaaaggcaggaactgcggtctccattttacttatttccccagagacttaagtggcagagctgagcccggagccaggtctgtggctccagatccctgtcttacacctgtgcgcctggggcctgagctccaagcttttcagcctgcctgggagacaggacagtggggtcctgacctcttccctgcctggatcgctgcagctcagataaccttcgttccctcttttttttttttttttttttttttgagaaggagtctcgctctgatgcccaggctggagtgcagtggcgcgatcttggctcactgcaacctccgcctcccaggttcaagcgattctcctgcctcagcttcccgagtagctgggacttcaggcacgtgtcaccacgtcgggctaattttttgtatgtttagtagagacagggtttcaccatgttagccaggatggtctcgatctcctgaccttgtgttccgcccgactcggcctcccaaagtgctgggattacaggcgtgagccaccttgcccggccaaacttcggtccctctttagacgatagcctcatctaaagatgaagccttccatccctctagatttttgccctttcaggctgaggatagggatctgagcacagggactgtgttcctcaggccccactttcccaggccaatgtccaggaagagttttctgttcaggcgcctatcagaccctgccctggttttttttttttttttttttgaggcagggtctccgtctgcagtccaggccggagtgctgtggtgctgtcatagctcactgtagccccaacctcccaggttcaagtgatcttcccaactcagcccgctgggactgcaggctgagtagctgggactatgggcacgggccgccacaactggctaatttatttaattatttaggagacagagccactctgtgttgcccaggctggagtgcagtggcacaatctcggctcactgcagcctctgcctcccgggttcaaggaattctgtctcagcctcccaagtacctgggactatgggcacacgccgccacgcctggctaattttttggatttttagtagagatgggtttcactgtgttgctcaggcaatccgcctgccttggcctcacagagtgctaggattacaggcgtgagccaccgcgtctggcgtgttttattttgtgtagagatggaagggggcgggagtggcctcgcgttgtgtctcacctcactatgttacccaggctggtctcgaactcctggcttccagggattctcccccacttggcctcccaaagtgtcgggattacaggtgtgagccaccttgcctggcgccatcctgattttttgttcaggaagagttattccaggagtgactgcctctagaccaccccaggtcctgggctacttctcccatgaggggctcagtggaggaacccctcctgtgtgaaggatggcagctccacagccctcagcccatttcctggccacttgctgtaactctcctctgccctagtgccccacttcccgctttgtctctgactcacccctgtcctggagcagagcccagcacgttgaagggcaaaaggtagggtatgttggaccacaatgtggttgccaccactaactggactctgctttttcagctgggattaggatatgaggacttgcaggtgtctggagttaggaaggttcagagcctggctctatgaacttggcaggtggcctcacccctctgagcctcaatttccgcatctgttaagggggataatgagaatgtgggtgaagttgatggccagcacatatggtaaagtatatcatctcacagaaatgccccagctgtctgagatgctgaccctatcaaacagcattggaggctgggtgtggtagctcatgcctgtaatcccagcactttgggaggccaagagttcaagaccagcttgaccaatatggtgaaactcctcgtctctaccaaaaatacaaaaattagccgggcgtggtggtaggcgcctgtaagcgcggctattcgggaggctgaggcaggagaattcacttgaacccaggaggcagaggttgctgtgagtcgagatcatgccactgcacttcagcctgggtgacaaagcgagactctatctcaaaataaacaaacaaacaaacaaacagcattggagcaccagggagtgtccatgcagacatcatttcatccttgaaagaatatttgctgaccttctgttagaagccaggcctttgtgctggatgctggagaagcaaagatggtttctgtcacgagctgtctgggggcagttgattttaaagccaacttcattctgttattagtatcttctggatttttgccttctatattgaagtggtggaggacccatgaactgggtcaggaatgaattccagatccttctgtattgctgactgtagacaccgtccctcctttcctatttctgaaaatttttttcttttgaaattgggtcttgcctggcctaaaaaatttaattagtatttcttattgactaataggcagcagctttgcacattttttcatttatttgtatattcagtcagtccctgggcaaacatttcttaagcccttttggtgataaaccctgggatgccaaggtggagctgacctttgtagatgatgtggaggagacaggcagttgcagtgtaagggcccgagacaggagggtttcccatgtgctatggaagtataggagtgactctaggaagcaacggtgagctttggagaacaaggagaaggtaatgtggatagcacagtaagccttctttcatttgtttcatttccaaacaagacttgccttgtttggaaacctgtaagctttttccagtttacaaatgtctgacctagcaacttacctgaccaacgtgacctgatgcaggtcctgtcgggtggagttggggaaagattactaactttcctcaagcacctgacatctctggaggtggatcctatgatttcttttttttctttttttttttttttttgagacggagtctccctctgttgcccaggctgcagtgcagtggcacgatcttgactcactgcaacctctgcctcctgggttcaagcaattctcctgcctcagtttcccgagtagctaggactacaggtacatgccaccatgcccagctaatttttgtgggtttttatttatttattttttttgagatggagtctcgtctgtcgcccaggctggagtgcagtggcacaatctctgatctctgctcactgcaacctccgcctcctgggttcaagcagtttttctgcctcatcctctcgagtagctgggattacaggcgcatgccaccacacccagctaatttttttgtatttttagtagagacatcatttcaccatgttgaccaggctggtctcgaactcctgaccttgtgatccacccacctcggcctcccaaagtgctgggattacaggtatgagtcaccgcgcccggctgatttccattttttttttttttttttttttttgtgagatggagtttcgctcttgttgcccaggctagagtgcaatggcttgatcttggctcaccgcaacctccgcctcccaggttcaagcgattctcctgcctcagcctcctgagtagctgggattacaggcatgcaccatcacacccggctaattttgtatttttagtagagacggggtttctccatgttggtcaggctagtctcgaactcccgacctcaggtgatctgcctgccttggccccaaagtgctgggattacaggtgtgagccaccacacctggcccgatttccatttttgtaactattaaactggataaatacgaggattttttggagcaacttggaagattgccttgtagagtaaaaacacccagaattcaaagcagctcgtactgttttttttttttcccctacagcggcgttagaagatattgtacactgggccgggcgcggtggctcacgcctgtaatcccagcccgttgggaggccaaggcgggtggatcacgaggtcaggagttcaagaccagcctggccaagatggtgaaaccctgtatctgctaaaaatacaaaaaaaattagccgggcgcggtggcaggcgtctgtaatctcagctactcaggaggctgaggcaggagaatcgcctgaacctggggggcagaggttacagtgagctgagatgtcgccacttcactctagcctgggtgacagagtgaaactccgtctcaaaaaaaaaaaatagatactgtacactgatttttctctccattaattatgcctgtgtgtaggcaaggattgaaaagggatttgcaaaaatggacataagccagacacggtggtgcacacctgtaatccaagttactttggaaggctgaggcaggaggatcccttgagcccaggagttcaagaccagtctgggtagcatactgagaccctgtcattacaaaaaaaaaaaaaatcaacacacgaaaaaacaacttggccagtcacagtggctcaggcccgtaataccagcactttgggaggccaaggtgggaggattgtttaaggccaggagttccagatgagcctaggcaaaatagtgagatgtttctacaaaaaaatacaaaatagccaggcatagtgtcatatgcaagttgttccaggtacttgggaggctgaggtgggagaattggattgcttgagcctaggagttggaggctgcagtgagctgtgattatgccactacattccagtctgggtaacagagccagactctgtccctaaaagaagaaaaacaacaaatggacatagagaatatattcagaattttttttccaaataactaatatctcttaaaatcttgatgcctgttaacttcatcaactttattccttaaaatatccatgcaggtttgttactgaaaggaaaaagcgatagtctgattttgaacataatattcttggtgaaatcttaactttctttttccttttctttttttgagacagtcttgctttgtcacccaggctggagtgcagtgacatgatctcggctcattgcaaccttcacctcccgggttcaagcaattcttctgcctcagcctcctgagtagctgagattacaggcatgcgccaccgcacccagctaatatttgtatttttagtagagatggggtttcactgtgtttgatcaggctggtcttgaactcctgacctcaagcaatccacccacctcggcctcccaaagtgctgggattacaggtttgagccactgtgcctggcctcttttttttttttttttacagcttttgaaatcactagggcattcctgaaaataaaaaagaagaaagtagctcttaaccctatttcattaaaaaatttaaaaagaggtgaggtcgggtgtggtggctcatgcctatagtcccaacactttgggaggccgtggtgggaggattgcttgagcccaggagttcaaaaccaccctgggcaatatggtgagaccccgtctctacaaaaaatacaaaagttagccgggcgtggtggcatacccctgtagtcacagctacttaggaggctggggcgggacgatcatttgagtccaggagttcaaggctgcagtgagctacgatcatgccacactgaattccagcccagtgacagagtgagaccctgtctcaataaaaataagtgaagcagaagtgcctatgtcttaaaaagaagaaaaagtaagagcctctctcccccagacctttccctagggtgggctggccgctgcctacacgttctccattatgtaaaacatatggacacaccatccttgacccttggcctgctttccccatagcgaggatctggatgagctgcactaccaggacacagattcagatgtgccggagcagagggatagcaagtgcaaggtcaaatggacccatgaggaggtgagtgccatggggaagagagggttgatggcagctgggggctgtccagaggaactgagcctggagtgtatttgatgtctcatcagatgggatgaagaggaggagccggtgaaggaagggatgggtcctctgattgtcctcatgcctcttctcagagcattctgggggattctcaattttgaggactcagtgggtgggaaggggatgtgtgtcctagacctcagggcccattgtgtctcctgagcagctgccatgttctatgtcatggacattgattgtgctttttgccttttgactgctaggaggtttggccaaatctgtaactccccccaccctttttttttttttttttttgagacagagtttcgctcttgtcacccaggctagagggcaatggcataatctcagctcactgcaacctctgcctcctgggttcaagcgattctcctgcctcaggtgcgattacaggcgtgagccaccacatccagctaatttttttttttttttgagacagtctcgctttgtcacccaggctggagtatagtggcatgatcttggctcactgcaacctctgcctcccaggttccaagcaattctcctgcctcagcctcccgagtagctgggattgcaggcatgcgccaccatgcccagctaattttttttttttgtatttttagtagatacgggggcttcaccatgctggccaggctggtctcgaactcctgacctcatgatctgcccgcctcggcctcccatagtgctgggattacaggcgtgagccactgcacccggccttaatttttgtattttttagtagagacggagtttcaccatgttggccaggctaatctcgaactcctgaccccaggtgatccacctgcctcggcctcccaaagtgctgggattacaggcatgagtaaccgcaccctgccaactcccactttctttttctaaaataattaactgtattgaaccttctgacatcaagccctgaattggtttccttctagctccatctttttattttataataaatgtgattgaaatataatttatatgtaatcatatgcaatcaaatgccctttttttaattcctttttgagacagggtttttgctctgtcacccaggctggagtgccgtgctagcatggctcactgtagcctcaactttctgggctcaagcaatcctcccccgtcagcctcctgagtagctggaaccacaggcatgcgccaccacgcctggctaatttttgtattttttgtagagacagggtctcgccatgttgcccaggctggtctcaaacttctaggctcaagcatttctcccacctcagccttccaaagtgctaggattataggtatgagccactgtccctggccaaatgcccctttttatggtgaacagtttgatcagttttttttctttttttttttttgagatggagtctctgtctcccaggctgaagtgcaatggcgtgatctccactcactgcaacttccgcctcctgggttcaagcgattctcctgcctgagcctcctgagtagctaggattacaggcacccgccatcatgcccagctaattcttgtatttttgtagagatggggtttcaccatgttggccaggctagtcttgaactcctgacctcaagcaatccacccaccttggcctcccaaagtgctgggattacaggcatgagccactacggtgagccggtttgatcacttttgacaaatgcatataccaatgtaagcaccaccctgattatcccaagaagttttctgtggtcctttgtggtcaggcttccccagctccaggaaattgctgatttgatttgttttgcctttttctttttgggggctttgtgtgtgtgtgtgtgtgtgtgtgttgtttttaactttaggttcaggggtatatgtgcaggtttattatataggtaaattgcatgtcgtgggagtttgatgtacaggttattttgttacctaggtaataagcgtggtacccaataggtagtttttttttttttaaggcagtctctctctgttgcccaggctgtagtgcagtggtgtgatctcagctcactgcaacctctgcctcctgggttcaagcgattctcctacctcagcctctcaagtagctgggattacaggcacgtgccaccacgcctggtaaatttttgtatttttagtagagacaaggtttctacttgtctctactaaaatgttcaccaggctgatcttgaactcctgacctcaggtgatcttcccacttcagcctcctgaagtgctgggattacaggcgtgagccactgcacccagccccaataggtagttttttgatcctcatcctcctcccaccctccaccctcctcccaccctccaccctcaagtaggccctggtctccttgttcccttcttcgtgtccatgtgtattcagtgtttggctcttacttatagatgagaatatgcggtatttggttttctgttcctgtgtttgcttaggataatatgttttgcctgttcttgaatcttctataaatgaaatcatacggttacattctttgcgtctggcttttgctcagcattgtgttgggtgattcagtaacttgtccttttctatcactggatagtagtccattgtatgggtataccacacagcgtttcacctgttgatggatgtttggactgtttgcagtttttggctatcgtgtatagcgctaccttgaagattcttgcataagtctttttgcaaatacatgtttccctttcttttgggaagataggtatggtcatggggtaggtgtatgtttagttttacagaaactgcctttttcttaatggattgtaccattttagacttctactggcctttttattttacctcagtttttcttagtgtcttcagttcttcagtgttttttgttttgttttgttttcaacccatagttaacatcatagatgtctttaattttaggattgggtttttttttttgtattgtattatttgtattgcttttgttttttgtttttaaatagagaagagggtcttgctatgttgcccaggctggtctcctgggctcaagcaatcttcctgccttggcctcccaaagtgttgggattacaggcagaagccaccatgactagcttgttttgttttttctaaaacttgctgtgtgagtggtaaactccttttaaatcatgaaagatgtttttccagatgcgtgctaagcaaaccttttctgctcatcctgttgtggaccagggactatatttggctcttgtgggcttagaagaataaacaagaccaagttcctaccccagagcagatttctctctggaatggagagataagaccgtgtgcaggtccctggaatgtgctgtggtcatccgcggcaccggtaggatcagtgtctgttggtgctcactgttgtagctctgggcacctgctaattgtaagatgagtggatggcaagtacctttagaaggagagattactgctgcctgaagaggttaaggaaacttatgtggagaaagtgacctttgagctaaggatgaggatttggaaatttagcagtgagggaagacctacagtgtgcaaaaagtgggtaagtcagatcaggaaaggggctataggtggagaaaagccagtacaggaggccagtttggtgggagggaagggtccttgaaggggagaaatggttgacggagatggccgcccggccacccctactgggaagtgaggagcccctctgcctggccagccgccccgactgggagggaggtgggggggtcagccccctgcctggccagccaccccgtccgggaggtgaggggcgcctctgcccggccgcccctactgggaagtgaggagcccctctgcccggccaccaccccgtctgggaggtgtacccaacagctcattgagaacgggccatgatgacaatggcagttttgtggaatagaaagaggggaaaggtggggaaaagattgagaaatcggatggttgccgtgtctgtgtagaaagaggtagacatgggagacttttcattttgttctgtactaagaaaaattcttctgccttgggatcctgttgatctatgatcttacccccaaccctgtgctctctgaaacgtgctgtgtccactcagggttaaatggattaagggcggtgcaagatgtgctttgttaaacagacgcttgaaggcagcatgctcgttaagagtcatcaccactccctaatctcaagtacccagggacacaaacactgcggaaggccgcagggtcctctgcctaggaaaaccagagacctttgtttacttgtttatctgctgaccttccctccactattgtcctgtgaccctgccaaatccccctctgcgagaaacacccaagaatgatcaataaaaaaataaataaagaaagaaagaaagaaagaaaaaaaaaaaaaaagaaaggatacactggggctgattcctcgagggccttgaatgttgggcttagaagctgtaggattgttcagctctcaatgcagagccaggttagcttggtttttggattgttttttctaactctgaactggacaaagatggaaggtttttaatgcagggagtgatgtgaatgtagccgggcttcaggggagttcatctgctgtgtgggggatcgataagagagatgggtggcctggcgcggtggctcacgcctgtaatcccagcactttgggaggctgagatgggtggatcacctgagattaggagttccagaccagcctggccaacatggctgaatcctgtctctactaaaaatacaaaaaattagctgggtgtggttgtgggcacctgtaatcccagcaatttgggaggctgaggcaggagaatcacttgaacccagaggcggaagttgcagtgagctgagatcgcaccattgcactccagcctggacaacaagagcaaaactccgtctcaaaaaaaaaaaaaaaaagaaaaaaacatatagagcacaggctggggctgagagaccagtgctgagggagtgggagagggcgctgtgccaggcaagcaagaggtggctgtggagagggcagtgcggggatggagctgaccacgttggggagtcccagggtgggtgggaagaatgtaagtttggaaatgatagtatccaggtcagttgtcagggagagtggtggtgccagagatggactggggaacacagaaggaagcaggtaagagcctggccagggcagggaggggacatggtataggtagggaagggtgtcctgggctggctcacccagagaatttatggtgactttgcccagcctgtgctggttctggccaagctgtagttgagggctttgatacctgtcgtgggccacgttgtgaccaatttttctgtctaggagcatgtatacatatatacacatataaatttgtatgtgtgacaaaaccacctcactttaaatttatccccttttcctcccccttaaatctaccccttaaccatctttaactttgtagttcagtggtgttaagtattttcagattgttttgcaaaagatctctaaaactttttcatctttgaaattggaaacgaggctgagtgtggtggtttatgcctgtaaaccgagtactgtgggaggccgaagcgggaggattgcctgagtgtaagagtcctagaccagcttggaaaacatagcaagaccctatcattaaaaacaaaacaaaaaatacccaccaacttggtgggtcacggtggctcaggcctgtaatcccagcactttgggaggccgaggcaggagattgcttgaggcagtctagaccagcctgaagaacatgtgagatcctgtctctacaacaaaaaaatgaaaattagccaggcctggtggtgtgtgtctgtggtcccacctacttgggaggctgaggtggaaggatcacttgagcccatgaggttgaggatgcggggtgggctgtgtttgcaccactgcactctagcttgggtgaccaagagagaccctatctcaaaaaaaaaaaaaggatggaaaactgaaactaattaaacatgaattcactctcctcccaccctccagcccttggcagctatctttctactctgtttctgtgattttgactattttatttatttattttattttttcaagacagagtcttgctctgttgcccatgctgcagtgcaatggcatgatcttagctcactgcaacctctacttcccgggttcaagtgaatcttctgctgcagcctcccgagtagctgggatcacaggcgcctgccaccacgctgggctaatttttgtattagtagagacgaactttcaccatgttggccaggctggtctcaaactcctgacctcaggtgatccacctgcctcggcctcctgaagtgttggggttaaaggcatgagccactgctccctgcctgattttgactattttagatgcttcctgtgagtggaatcctgagtatttgccctgtctggctatttgacttagcatagtgtcctcagctttcatccatgctgtagcatgtgtcagaattctctcgactgagtaatatccattgtttatatgcatgacattttctttcttttttcttttgtttgagatggagtctcactcttgctctgttgccgaggctggagtgcagtggcatgatctcggctcactgcaacctccgcctcccaggttcaagcaattcttcctcatcctcccgagtagctgggattacaggcacccaccaccacacctggctaatttttgtatttttaatagagatggggtttcgccatattggccaggctggtctcgaacccctgacctcgtgatctgcccaccacggcctcccaaagtgctgggattacaggtgtgagccactgcgcctggcttgacattttctttatatattaattgatttgactgaggaaaactttatatataattaactacaaccatttgtagtacaattcagtagaaccaccagcacagccgggctataggacatttccattgtccccaagacattccttgcccccctttgctgttcatccctttccaccactggcctcagacaaccactttttgtccctatagcttagtttacattttctagaacttcatgtgcatggaatcatacggcatgtaccctcctgtgtctggcttctttcacacatcatagtgacactgagattcatgttatcgcgtgaattggtagttcatttcgggaggctattttgatagatactagcctgtcttctaactactcttgtttttgcccagacctccagcttctagtgctgaatcactgtcagctctggcctgagttcagtaatgacctccttatgtccgctcggctcccttccagcccctttcccaccctgtagcaggcaaagagaactttacaaagttctcttcatagaacgtttgactgtgaccacccactcttcaaacacatcagtggttttgcatgatagatggttgaactgatgctgcgaatggtctggcccctatggttccctccaaaatcatcttggatctgttttgcttcctccattttagctattctgcatttccttggaacctgtcccttagtgtccctgagtaggcagtcaccacgtacctctccatatctcccagcagggggtggctttacttttgttcctgtgagccttccattggcagctggctccctcccatgagatcaggggcagctcttttgctgcctgctgctgcagctgtagtgcctggcaccttgtacgtattcacttcatgacggaatggatgaacgaggctgttcttttagattgggctctgtcacgggcagccctgaggttttctgcacgtatgtgtgctgagcccctgtctttctggtgttggcaggacgagcagctgagggccctggtgaggcagtttggacagcaggactggaagttcctggccagccacttccctgtgagtacagtcctgctgtggccctccctcggggcaagggctctgggagaacagtgtgcctgggacagactttgccaaggaggggaaaagggagttccttactcagcccctgaaaacaaaaccaaataaaacagggcaaatggacctttgtaggatctctcttcccaagctggcattcagggtacactgctgtaaacatcttccagctcctcagcatgcctggtggtcttcaggctctgagacatttgcagcatgtggtgcatatttgcatttcttcctgtaagtcaggagtgaacaggtgttcggtttctcaacagtgagactgaaactgaggggaagtgatgctttcagcaggcttcatggtgaggcccctgcagggctggcaggtgctaccacattcgagtatttagagcctcctgatggtgagggggttcccctcaggacctccttctcaggccctcccacccctgacccacaggtgtctgggagggagggggtgtggcaggagctgccatatgtcttactgcctgggctgctcagaaagcatgtcaccagatcctttcctgccccatttcctcatctccccctcttctgtgtaatctgaactcttcagggaataaaaatgctctcctagaaaaaagcaggggtccctgacgtacaaggaattaaagacttgtgatggtggccccttgtgttcggttggtagggagcggcttcccacaggggaccgagtttgccctctcgtgtagcaaagggaaaccgcccatgttccggcatgtgggcttgcagtgagtggtggctgcatggaacaggacacacctacccaaggtgtgcctagtcccaggccataggcccctgagcctagtacttaaccaggcccccagcccgaggtcccagaagttctcacagattggtttgttcttctgttcttttcccagaaccgcactgaccagcaatgccagtacaggtggctgagagttttgaatccagaccttgtcaaggggccatggaccaaagaggaagaccaaaaagtaactgctgggacagtgccttgcacacagtgggtcttcacccaccagtgtacctggggactgtgagattgccttgtgttggggttgggggtgtcaagctgagcattgggtgtgagttgtctaccagccagtctggacactcttatgctgccctggctccagccctgagattccaagtttcagagtgtctccaggcttcctcactcatggtctgagggctattgggctgattactcggcttctcttgttccacccatggaggggagcagtagcagtgcagcgttgtcatgagaattaagcaggtgatgcttgtagggggcttgcaggttctgtacatttgctctcagcaaatggcagctgctgctatccctgatttaatgatgattgcaccctgtgaccttcacagggcacagatgccttcttttgatcgccacagcagtcctgtgaggtgggcagaagttgttagtcccattttatagatggagagagcaaggctcagagaggttggggatgtccccaacctagaagaggcaataagtgccatgactgcctggggctaccttgggagttccctcatctcttctcctcgataccagcccagaggatgccattccactgaggcaggcatggcttatgagaaagagggagatgaagggaactaggcattttttttttttttttttttgagacggagtcttgctttgtcgctcaggttagagtgcagtggcgcgatctcagctcactgcatcctccgcctcccgggttcaagcgattctcgtgtcttagcctcttgattagctgggattacaggcacgtgctaccacacctggctaatttttttgtatttttaatagagatggggtttcaccatgttggtcaggctggtcttgaactcctgacctcgtgatctacccgcctcagcctcccaaagtgctggaattacagacgtgagccaccgtgcctggcctggaactaggcgtttttaaattaatttttttttgagacgagtcttactctgttgcactggctggagagtgttggctaatttttttgattgattgaggcgggggttcgctctgtcacccaggctggggtacagtgacataatcacggctcattgcagcctcgacctcccaggcccaagcaatcctcccacctcagcttctaaagtagctggtgccacatgtgccaccatgtctggctaatctttttgaaaaatttttgtagagagagtatctcactatgctgcccaggctggttgaacttctgggctcaaatgatcctcccacgtcagcctctcaaagtgctgggattgtaggtatgagccaccattcctgttctttttttttttttccttgttaatttttttgagactgagtcttgctctgtcgtccaggctggagtgcaatggcgtgatcttggcttactgcaaccttcgcctcctgggttccagcaattctctgcctcagcctcctgaggagctgggattacaggcgcctgccaccacgcccggctaatttttgtatttttagtagagacagggtttcaccatgttggcctgactggtcttgaactcctgaccttgtgatctacccacctcagcctcccaaagtgctgggattacaagcgtgagccactgtgcccggcctttttttttttttttttaatttgtagagacagggtcttcctatgttttccaggctggtcttgaactacagggctcaagctatcttctcgccttggcctcccaaagttctgggattacagtcatgagccatggctggcacttcgccttaaaattaatttttaagtaactcggcgtggtggtggggtgcctgtagttgggaggctgagttgggaggattgcttgagcccaggagttcgaggttacagtgagctacgatcacaccactgtactccagtctgggtgacagagtgagaccctgtctcttaaaaaaaaaaaaacacaaaagaaaacacctgggcgtggtggctcacacctgtaatcccagcattttgggagcctggggtgggtggatcacctgatgtcaggagtttgagaccagcctgaccaacatggcgaaaccccgtctctactaaaaatgcaaagatgagctgggtgtggtaacccatacctgtaatcccagctacttgggaggctgaggcaggagaatcacctgaagtggggaggcggaggttgcagtgagccgagatggcgccattgtactccagcctgggcagcaggagcgaaactctgtctcaaaaaaaaaaaaaaaagaatgaaataaaatttatttatttatttatttttgagatggagtttcgctcttgttgcccaggctggagtgcagtggcatgatctcagctcattgcaacctcctcctcctagggacaagcgattttcctgcctcagcctccggagcagctgagattacaggtgcatgctaccacgcctggctgatttttgcatttttagtagagacggggttttgccatgttggtcaggctggtcttgaactcctgacctcaggtgatccacctgcctcgacctcccaaagtgcttggattacaggtgtgagccaccgggcctggcctgagaccttgtctcttaagaataaaataaaatttagtttgaaaatacttttttggctgggtgtggccaggaatttgagaacagcctggccaacatggtgaaaccctgtctaccaaaaaatacaaaaattagccaggtgtcttggtgtgcctgtaatcccagctactcaggaggctgaggcgggagaatcgcttgaacccaggagacggaggttgcagtgagctgagatcgccccactgcaccccagcctgggcgacagagtgagacactgtctcaaaaaaatggcggtggctcacgcctataatcccagcactttgggaggccaagtcgggcggatcacctgaggtcgggagttcaagaccagccttatcaacatggagaaaccccgtctctactaaaaatacaaaattagccgggcatggtggtgcatgcctgtaatctcagctacttgggaggctgaggcaggagaatcacttgaacccggaaggcggaggttgtggtgagccaagatcgtgccattgcactccagcctgggcaacaagagcaaaacttcgtctcaaaaaaaataaataaaaaataaaaagtgaaaacataaaatctttaaaaaaaaaaatcaaagtgatatgtggttgctataaaaatttaaaccatacagaagtgaagtcaaatatttcttcaccaaaatctttgccaaaagaagcatccactcttcccagtttcttgtggcctgtgtgcacatgagaacgcgtgtgtctgttgtgtaggtggggcctggcctggctcttgtggctgcgtatgttgtggtttgtgtcctgagctaggaagcctgactgagggcaggtggggactcaggtctggctaggtcagcccgcgatgcctgctaccatggctcagcctgtgccctcccaatttccatggaagtgctggagggtcttgtggcagcctggggcctggctggtgtgggaaagtctgtttcccacctttagtttggactccgtgtgtgttgttcctcctcatccctctgctcttttctacttagcttattgggttgagccctggagagggaagcaggactctggcgcctttgtttacccccacttgatctctactctagaaagggtctctggtattcttggcctagatttattccaggcaataaatgagagggatgcggtcagatcctcaggtaggccctgtgggctacacaaagtcatcctgggtggcatcccctgcagctcgctcagtgttgcctgaggggatgtggtaggtggcacctctcagggccatggcaaggctcaggtggatgtgaagggctatggtgggggcgagagaggggccggtgcaagtggctacccagagacttttctctaaggtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggtaagctgtcttcttgggggttgggacaggttcccgggaggccaggcccgtgtttctgatggaggagggttcctgggtgggtattgtggtcctgtgctcttgttctgtaacacccagcctcggctccagggctcccagaggcatgcatagtcaggaggaagggtggttccccagggaaggccctgtcttctgtcagcttaaaagaacagatggtgataagggaggcctcagcaagaaatcgggaaccctggagtctagttctcatcctgttcccagctcactgtgtcttcttggttagcctcttctcttcgacttcagtttcttctaacacagaataggcttgagatgtgggatagatgggctttctttaagaagaaaatgatcaaaaatcaggtagtactataatctgctaaaaggtgttttttgtttttctttttcttaaaaggtttaataatgaaaaacatcagtctttgtcaccactctgttaaatgactctactaaaacagactcatctttttgagttctttatctctttaagtgatgtgccatttttcatattgatcctctgctatgggagattagctttcttaggctttcccactccccatatgtccctattgctccaataatgtatgatagttattaaaataataatgtttatggacgggcatggtggctcatgcctgtaatcctagcacgttgggtggctgaggtgggtggatcacttgaggtcaggagttcgagaccagcctggccaacacagtgaagcctcatctctactaaaaatacaaaaaattagcgggatgtgttggtgagcctgtaatcccagctacttgggaggctgaggcagaattgcttgaacccaggaggcagaggttgcagtgagccgagatcatatcactgcactccagcctgggcgacagagcgagactgtctccaaaaaaaaaaaaaaaaatttttttttcccctaaatactgaaagcattccatgatcttttctcctatttttcatctgttttgcttcattttctaggagacttcttatcttctctttttttgaaattattttccctaaaaattttactttctaagggctcctcccttttctggcactctttttttattttttatttattcttttttttgggagaccagagtctcgctctgtcatccaggctggagtgcagtggcgtgatccgggctcactgcaacctctgcctcccaggttgaaacgattctcctggttcagcctcccaagtagctgggactacaggtctgtgccaccatgcctggctaatttttgtatttttagtagagatggaatttcaccatgttggccaggctggtctcgaactcttgacctcctgcccacctcagcctcacaaagtgttgggattacaggcatgagccactatgcccagactctttaaaacagggttctcactctgtcacctaagctggagtgcaggggcataatcatggctcattgcagcttcaccctcctgaactcaagcaatccttctgcctcagccttccaaggacctgggactacaagctcatgccagcatacccagctagttttaaaattttttgtaggggcagggtctccctatgttgcccaggctggtcccaaagtgctgggattacaggcatgagccaccacacctggcctggcaccctattcttattttgtggtttcaatagcttacttctctgtcaatattatattttttttaagaccgaatttcgctcttatcacccaggctggagtgtagtggcatgatctcggctcactgcaacctctgcctcctgggttcaagtgattctcctgcctcagcctcctgagtagctgggattataggcgcccgccaccacacctgactaatttttgtatttttagtagagatggggttttgccatcttggccaggctagtcttgaactcctgacctcaggtgatctgcctgccttgggcctcccgaagtgctgagattacaggtgtgagccaccgcacctggccctaagctggatattgttcccctgttttccatcttatgaaaacttgtaaaaaatctcttactagtggctgtcttctacctgtttctctttgtccttgtgaatttttgccttgctttattttgaatccctttttttgtcatggcagtgtggtcctggcagggagagaaaatgccagatggtgtgttttccccaaagtctgaaatgatcccttttcaaagctcaaacctgaatgtgtcatctttctggggcttcccctgacacttgggttggaaactctggcttctttccccccatggcctgtttggctcacaggtgccaccagcctcaccttgatccactgtcacttgtgcttactcggtgttagctgctttgcctcctttcagtccctcgaaccctgagctcttctcagagctcctagtgctcctctgtcggcctgcagtgcactcccgcttgtgcctattgtgtagctaatgtgttctcatccttcagttctcagtgggggtgctatttcttcagagaagttttctctgttctcccagactgtggttggtctctggtgacctctgtgttgtgcccacacctgtctgcagagtagtgtgtaccccagttgtagctgaagataacattcatctcccctgctagatttaactgtcaatggcagccacttgtcttatttaccagatggatccccagtgcctacaataatgcctggcacacagtgggtgctttttatatgcgagcaaaagaaggagtctcactatagcttggggcaccccagactctggtcttggggagtgggagggctggggaggtgttttgggtcaggttccctggaagcggaacctgtgactcaagagtttcaggtacatgggatctcttggaaaggttctcacctgtgagggaaggagtggagaaaagaagggaaggggccaagcaagggatggggtcttggaaaatagagctttggcctgctataaggccaaggagtgtgtgtgttcacatgtatgcatgcgaggtatgtacatatgaggagggcgcatgtgtacatgggttggggaactcctggggcatcttcggttgtgccttccaagagctgttttttgtttttttttttttgtttgttttttgttttttgagacggagtcttgctctgtcgcccaggctggagtgcagtggcgtgacctcagctcactgcaacctccgcgtcccaggttcaagcgattctcctgcctcagcctcctgagtagctgggattacaggtatgcaccaccacgcctggctaatttttgtatttttggtagagacgggatttcaccatgttggccaggctggtgttgaactcctgaccttaggtgatctgcttccaagggctcttatgcagataaagtcatagtagaagccgtcggcagcatgcccggcagctgggggattggattcgctgtagggacagaggatctgggcaaagcaccaggagcaccccttaccctacacctttgcccagtgagcattgtgtccctgaaggcttagagtgcaaatgatccgaggatattctcttagactgggtgctcagttaagctgttactctctgttcacttttcaaggaaagagtattctgcttggcactccaaagaaggtggtgactactatgtgtcagcacagtacctttgtatttttagtagagatggggtttcactatgttggccaggctggtcttgaactcctgacctcaggtgatccacctgcctcagcctcccaaagtgctgggattacaggcgtgagccaccgcgcctgacctgccgcttgcttctcaccactatacttctatacacttttgtggtactatcccgtccttctgtattactctatgcctttattactacatgtttctctgctactctactctgtgctttatgctactgttctactgtagatgtgtctcctccctgaatcttcagtgagtgatggagtatgacgtagtcttctgaccttccagataaagaaaccaaggcttagggaggtgaacagttctgggccttctgccctctttggccacttatcagtctgtgggaggtgaacaggccttgcatctgaggtcagcgtgagactcagtggaaatgagcagacagtgttgcttatggcttctacacattcgaagtgggcagggaagggggtgagagttccaagcacatatcttcagttttataatttttaaaaaatttaaaattttttttttcatttttatttatttttgagatggagtctcactctgttgcccaggctgtagtgcagtggcgcaatctcggctcatcacaacctccacctcccgggtttaagcgattctcatgcctcagactcccaagtagctgggattacaggtgcctggcatcacgcccagcacctcccaaagtgccaggattacaggcgtgagccactgttcctggtcttatatatacattttttttttttttgaggtggaattttacttttgttcccaggctggagtgcaatggcatcatcttggctaaccacaacctctacctcctgggttcaagcgattctccttcctcagactcccaagtagctgggattacaggcatgtgccaccatgcctggctaattttgtatttttagtagagacagggtttctctgtgttggtcaggctggtctcgaactcccgatctcaggtgatctgctcgcctaggccgcccagagtgctgggatcacaggtgtggtgagccaccgcactcggcaatttttttttttttttaattaaaaaaaattttgttttttacctgaacctgacagtagctggtgccattttataatttttgccatagcctgaatgattcagttgcttatttcacagagcttcgtggaaatgctctgtaaattattagggctagagacttgtgagacttcatcttggaactgaaagagaccttagagttcatctagtggaagattcatttacaggagcaggaacttggcttagggaggttagtgatgtgcctgatggcaccccacccacagagctggggttcaaaggccccctgctgccccctgcaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccaggtgagacagctgctcagcctttggcttggtttgatttcacattcatctgacaccatctcattgaacaccttgtccacagctattggtcagtttctgccacagagtctaaaagtgggctctgtgcttctggggccttgtgagacttctgcacataactggcacttgtctgcctgcagatgaaggatagcagagcaagctgattatataaaactgtgaattagttaaggagatcctcagcctccatctctccttgctggtggccaccttcttacctgttgctcattttaattttttaaaactgaaagcatgtttgcaataaaaaaatcagaggtggctgggtgcgttggttcacacctgtaatcccagcaagttgagaggctgaagcgggcggattgctcaagcccaggagttggaggccagttcaggcaacatggtgaaaccttgtctctatctttttaattaaaaaaaattaaaaaatgtattgagttgtaatttacgtactctaataaacagttttgagttatgacaaagcatacagccatgtaaccactgtcacagtcaaggtatacaacagtcccatcaccccagaattccctcgtgctccttttcttagccttttttcggcccttagctccttgcactgtgatctgttttctgtctctataattttgacttttctagaaattaacaattaaaatcctatagtattacatttgcaggctgttttttttgagacagagttttgctctgatgcccaggctggagttgcagggtgtgatcttggctcactgtaacctctgcctcctgggatcaagcgatctcatgcctcagcaacctgagtagctgagattacaggcatgcaccaccacgcctgactaatttttgcatttttagtagagatggggtttcaccacgttggccaggctgggtttgaattcctagcctgaagagatccgcctgccttggcctcccaaagtgttgggattacagatgtgagccaccatgtctggcactacatttgcagtttttatttatttattttttgagatggagtctctgtcgctcaggctggagtgcagttatatgatagctcactgcaacctccgcctcccaggttaaagcgattctgctaactcagcatcccgagtagctgggattacaggtgcacaccaccatgcctggctaatttttgtattcttagagatgggggtctcaccatgttggtcaaactggtctcaaactcctgacttcaaatgatccacccacctgagcctcccaaagtgctggcattacagacgtgagccagcatgccccagctacatttgcagttttaaaaatgaaatcagtatatacttatgttaacatccactgtcctatataccagagcaaagtttttatttatattttttagctatatctctaaaggttatttttcaaaataaaaatttgggtagggcgtggtggctaacatctgtaatcccagcactttgggaggccaaggcttttggatctcttgagcccaggagtttaagaccagcttgggcaacatggtgaaaccccatttctataaaaaggaaaattagctgtgtgtgattttgtgcacctgtagtcccagctacttgggaggctgaggtggaaggattatttgagcctgggaggtggaagttgcagtgagttgagatcccgccactgcactccagcttttatttataaataaaataaaaatttgaaggccgggcacggtggctcacgcctgtaattgcagcattttgggaggccgaggcgggtggatcacgaggacaggagattgagaccatcctggctaacacggtgaaaccccgtctctactaaaagtacaaaaaattagctgggcgtggtggcgggtgcctgtagtcccagctacccaggaggctgaggcaggagaatggcgtgaacccgggaggcagagcttgcagtgagccgagatcacgccactgcactccagcctgggtgacagagtgagactctgtcacaaaaaaataaaactaaagaaaattaaataaataaataaaaatttgaagcaagcatgacaaaaaatagatttgatgatgccggctgtgtggtaggtaacaattgtcctttgttattttctaatcttttctgtcatggtgtgaactatttaataattttaaaaaatctttttccctcttcttactgggtagagataacttgttgacagttacaattcttccacaatgccctgctagagcgatatattatgtttttgcctctatttcttgaattttcaattttagagaatatctctcgattgcccaatatgaatgcacctatggggtaactttcaaagggcagagaaatgtatcaaatgaaaagtaaaacgacttctttttctggtttcaactccctgtgcatctcttaaccggaggagtctacttctgacaatttcttgtacatctaagtagtatgtgtttgatcttttacttctgattgaagaaaaggtctccgttccacaaagagaaacagcgggcatcagccgactcatagaagactttcagcataggacagagtgaacagatctctagtctcttaaaaactctactgtgctgaaagccagttattgacttggcttttgtcccctgacactttgagtgtctggagtgctggctgtgctgggctgggaccaagccccagaccatgaccctgagcacaggaggtcaatttttttttttttttggagacagagtcttgctcttgcccaggctggagtgcagtggtgccatctctgcttgctgcaacctccacctcccaagttcaagtggttctcctgcctcagcctcctgagtagctgggaaactgggattataggcattcgccaccatcctggcaaatttttgtatttttagtagagatggggttttgccattttggccaggctggtcttgaactcctgacctcaggtgatccacctgcctcagcctctcaaagtgctaggattgcaggcatgagccaccatgccgggcctgtgttgatttcagccttacccgtgtctctccaatgtggtctttctggtgtgctatttatttaactagtttcttactgatgtagataagggtattactggttttttgttattagagataaaactcttaacagtcacccttgtggccaaatgactgcttctttgtgcagttatttcttgagaaattcctagagatggacaaatatatttggtggtggggggaacccttttggctgagtatggtggctcattcctgtaatcccagcactttgtgaggccaagttgggaggattccttgaggccaggagtttgtgaccagtctgggcaacatagggagactgtctttacaaaaaaaaaaaaaagctggtgcggtggcacacacctgtagttccaactactttggagcctggggcaggaagttcacttgagcccagtatttcaacagagtgagactctgtctttgaaaaagcaaacaggccaggcgtcatggcttacacctgtaatctcagcactttgggaggctgaggtgggcgtggtgacacaggcttgtaatcccagctactcgggaggctgaggcacgataattgagaatccacttgaactggcgtggcggaggttgcagtgagccgagttcgcactgctgcactccagccttgggtgacagcaagactctgtcttaaaaagaaaagaaaaaaaacctcttaatacattttgttagattgctgccagaagaattttgcatgttaattcgtgtatgggaccactcccaacttctccactcactggtcagtgcttgctattataaaattgtttcctctgcttcagaagtaatgcgtgatcattgcaaaaacttaacaactttatagaattgggcaatgcagaaggttgagcctgctcatctcaacttttttttttttttgagacggagttttgctcttgttgcccaggctggagtgcagtggtatgatcttggctcaccgcaacctccgcctcccgggttcaagcgattctcctgcctcagcctgccgagtagctgggattacaagcatgtgccaccatgcctggctaattggggtttctccatgttggtcaggctggtctcaaactcctgacctcaggtgatctgcccaccttggcctcccaaaatactgggattacaggcgtgagccaccacaccaggcttaaaattagacgatgtcttactcttttacaactttctttttctatttaacatatcgttccatgttgttatgtgtattcagatctccaacattcctgaatttgccgtatcttatttaaccattatattgtcaaacatctgttactatttccatcaatgctataatgatcatcattgttcagtttctttgtacatttgctgaactgtgtggttgatttttttgtttttagatggggtctcactctgttgccaggctggagtgcagtggtgtgaccttggctcactgcaacctccgcctcccgggttgaagtgattctcctgcctcagcctcctgagtagctgggattacaggcatgcagcaccatgcccagctaatttttgtatttttagtagagatggggtttcaccatgttggccaggatggtctcgatttcttgacctcgtgatctccccgcctcagtctcccaaagtgctgggattacaggcgtgagccactgcgcccggccggttgattttatagatgtggaatgattgggtaaaatagtgtggacatttgaagttttcataagcattgccgaattgctgccaaagggattgtactgtttaatcctgctataggtggtatataggactgcttgtttccagccttattgtcaataccggctatggttatatgaaaaaaaatctttgccagttttaatgagcaacaaatgcattatcatgttcttattttgattgaattactttggagttgatcttttttttttcagctttattaaaatataattgacaaataaattgcatatattgaccaggggcggtggctcatgcctgtattcccagcactttgggaggctgaagtgggcggatcacttgaggctaggagtttgaggccagcctggccaatacggtgaaaccccatctctactaaaaatataaaaaattaaccgggtgtggtggtgcacgcctgtagtcccagctgctcaggaggctgaggcatgagaatcacctgaacctgggaggtggaggttgcagtgagctgagagtgtgcctctgcacgccagcctgggtaacagcaagactctgtctcaaaaaacaacaagggctgggcgcaatggctcacgcctgtaatcccagcactttgggaggctgaggcaggcggatcacgaggtcaggagatggagaccatcctggctagcatggtgaaaccccatctctactaaaaatacaaaaaagaacccaaaaaattaaccggtcatggtggcgggcacctgtagtcccagctactagggaggctgaggcaggagaatggcgtgaacctgggaggtggagcttgcagtgagccgagatcgcgccactgcatttcagcctgggcaacagagtgagactccatctcaaaaaaaaaaaaaaaaaattgcgtgtatttatggtgtgcaatgtgatgttttgattcattgttttggttttcatttcttttactattaatgagggtgagtaacaaattaccccttaatttgttaatttgttatttggcttggttgtctttttttttttttttttttatcttgttactggtttgtacattttatttgtatattaaggatgctactcctttatcatgtagtaactattttttcccagtttggtagctttttttctttattttataaaggtataatttacatacaataaaattcactttttgtttgttcgtttgttttatagagatggggtttgcccaggctggtctcgaactcctgggctcaagggatctgtctgccttggcctcccaaagtgttgggattacaggtgtgagccaccacgccccgcatattttttttttttttttttttttttttttttttttttttttttttgagacagagtctcgttctgtagcccaggctggagtgcagtggcgcagtctcggctcactgcaagctccatcttccgggttcacaccattctcctgcctcagcctctcaagtagctggaactacaggcgcctgccaccacacctggctaattttttgtatttttagtagagatggggtttcaccgtgttagccaggatggtctcgatcctcctgaccttgtgatccgcccgtctcggcctcccaatgtgctgggattacaggcgtgattttttttttttttttttttttaaatgagcagggtcttgctctgtaccccagactgtagtgcagtggcgtgatcatagctcactgcaaccttgaactcatgaactcaaggggtcctcttgcctgagcttttcagagttctgggattacaggtgtgagccgccacacccagccccctcccccctcccttttttttttattagagtcttgttgtgttgcccaggctggagtgcagtggtgtgatcatagcccattgcaaccttgaattcaggaactcaagggacccaattgcctcagcctcccaaagtgctagagttacaggcataagccactgtacctggtctttttattttttaatgtttattaagcattaaaaatttattttttaatttttttgagacagagttttgctcttgttacctaggctgtagtgcaatggtgcgatctcagctcactgcaacctctgcctcccaggttcaagcaattctcctgcctcagcctcccgagtagctaggattacaggtgcctgccaccacacctggctaattttgttttgttttgtttttagtagagacagggtttcaccatgttggccaggctgatctcgaactcttgacctcaggtgatccaccagcctcgacctcccaaagtgttgggattacaggcgtgagcctctgcacccaacctctgtgtattacttctttcatctgagccatttgagagttagttatgtagcatagattcctaagaataaggccatttgcttacataaccacaataaagttatattcaatccagggaatttaagcctaattcaggatctttatctacagtttatattccatttttccctgtccatgatgcagtctaagaccagacattgcatttagttgtcctatccctttagtcagcctttcttagtgtcatgatgttgacattttggaagtatatggtatggctaattattctgtagaatgtttctctatttgggttcatcacagtttccttcttagattcaggttgtgtggtttagctggaaactactatatagtctatatctcagcgaaatgcaaatggtgtattcttgtgtcttacagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccctgctgtgggttctagcctctctgaagccctggacttgatcgagtcggtatgttggtcacaacacttcacagtgagcacagaacacccccagcaggaagtgcttctctctcaggcccacatccttttgctcattccatcgccctgctaacagttactgacttgatgctgaatgcctagccctgacccaagggctggggacaccagggttgtcagcatgcagtccctatccttggggagctcccggtgtgtgcagcaggagtttgtggtggcatctgacctctatgtatggcacagggcggggtgggaaggctgcccagaggaggtggcactgaactgagtcctaaaggttgactggcaggtgacagcacaggacagcgtggtatttgtggcatcacacatggttgggtctccctgaagaggagcccaggaaatgccaagtcttggtgctggtcttggagtggtgagtgggttctggttactcagggtggggcagccattgagcccgtgttgtggttactgtgttggctgtgtggttgtgtcctttgaggagggcttcttggtgtgacaccccggctcctggctgcatcggccaggcctgctgtgtagagcgggttttgggaggtgaaagaccagaggcctggtcactagggtggggagttcagtatgggggtccgtgttcgcctttccacccaggtgtctcccatcctagaacatctaactgccagggtctgagcttaacatacagtctgcgtggtatcctgtgaggtgtgtcatttctgttttttaggtgaaactgaggctcagagaggtcaagtagtgtacccaaggttgcacagcaagtatacttggtggtcttgactgccatgctatgctcctgctactatcgcttggcaggcacagctcgcttgtattgagcacccactgattgccggagccagtgcttaatgagtaattacagtacctaacattggagtgcttgccgcgtgccaggcccatcacttgctacctaatgtgtaggctcttagttggtctttaacagcctgtgaggtgggtagtggactcatcaacagtgagagcaccccacgctcagagaggttaggagacttggccaggttcacacagccggtgacctccaggaacaggagttaaaccttgctgtccggctcagagctcaggctctttccacaatgaccttcagcgcctgttgggggagttactgcgtgtgtggaaatcccatcttccctcctctgctccgtccacttcagtggtccttgtaggatgtacttctggtctaccagacactgtcggtgctgggtcctccctgaattggggtgtgggcctgaggtcggtcctgccccccagctggcctccacccttaggagtgaactaccccagggaaccagaactcggctttagtgtctgggtccactcagaagccagaacccaaagaccaaagtggaagcctctgtgtccagaagccttttggtttgtgttgtgatttattgggtaaaggagggaaaacctgtagtgactcacgggcttgttctagaagctgagtgagtaactttgggaagaccgaatccccttagctcagcttccttggtatgaaagggaaagtaatgcttccctagcagaattgtggggattggaaataacttttgtgagctgccccaaggaggcatcaatgatgagtgacatcccattcactgctctatatttcgttctataaaaatatctgcaggctgggtactgtggttcatgtctgtaatcccagcactttgggaggctgaggtgagaggatcacgtgagcccaggaatttgagaccagcctgggtaacacagtgaaacacagtctctataaaaaatattttaaaaaattagctgaagccgggtgcagtggctcacacctgtcatcccagcacttttggaggccaaggtggtcagatcacctgaggtcaggagttcgagaccagcctggccaatatgggtgtggtggcacacgcctgtagtcccagctactcaggaggctgaggcaggagaattgcttgaacccggaaggcggaggttgcagtgagccgaggttgcaccactgcactacagcctgggcgacagagcaagtctctgtctcaaaaaaaagtaaaaaataaaaaattagccgagaatggtggtacatgtctgtagtcccaactactcgggaggctgaggcgggaggatcacttgaacccaggagttcaagcctgcagtgagctgtgattgtgctactgtactccagcgtaggcaacagagtgaaaccctgtctctttaaagaaaagaagaatctatgaaaatatagatgtatagtcatagaaaactttgaggaaatgcatgaaatattaatgattggtcctgggctgtgggatcatacttgacacttaaatatttcccgtaatgaatgagtcctcttgtattaagagcatagtaattgcaattcctaacctccctccctggacaggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccaggtgcgtggaccccactctggctgcttattgggtcggtacagacacctagtgttcagtgctggggcaagggtgagcaaaacgagacctggctctgccctcatgcagcttatgctctggtaggaagaccaggtaactaaaaaagactcagaaaatgtgataatcaggatgaaagagaaggcttatggtgctgcatatgtgtatctagtctgggcaagtccaggaagactgccaggaggagaaggaggatgctggtaactgggtaatgaaggagaggaagagaactgtcgtgtttgttcagtccacgtatggaacctatttcacagcagacttaccagcactggggagcaaagatgaagatgatgggttgtctccagcactggctggccctgcctggtcctgggaagacctgggatagccagtgctggggatgggcttgtaatgaattaaccagaatagagtgtgggaagtgccatgtgatagcaattgcgaagtcactgagaactcactgttctgggtgttgcccctgggtgctctgttagtaacacacagagcctcgggagccgggatgggtgccagggtctctctgagatagaggtcatggggggcacctggccttcctgcagagaggtgtctgggctgggtctccttgagcaccttgaccaaaggcacagaaaaggaaggacagagtggatgtgtggagtggtggggggtggcgcagggccttggtgggcctaggtataacttagggctttggctctcattaggtttgttcttcctgtgaggctgtgggagagagcgaggccctgaggtggcctggtgcaggaggccaccctgtcatcacgggtcaggatggctagtggcattttgagagagaccctgtgtcggtttgctccggctgcttaacagagtaccacaggctcggtggatttgacaagaaattcagcagtgttggtttctactgaggcctctctccttggcttgtagatgctggcggctcctgtgtcttcacgtggtcacctgtgtcctaatctattattttttcttgtaaaacctcttattttataatgttataaggacacccgttattggattagggcccactctaatgactttattttttgagagtcgctctgttgcccaggctggaggctggaggctggagtgcagtggcatgatcacagctcactgcaatctccaccttccaggttcaaggaattttcctgcctcaggctcctgagcagctgagattataggcatgagccaccatgcccggctattttttttgtatttttagtagagacagggtttctccaggttggccagactggtctcgaactcttgacctcaagtgatccacctgcctcggcctcccaaagtgctgggattacaggcgtgagccaccgcgcctggcctaactaaccactttaaaggccctatctccaagtattaatacagtcccattctgaggtgctgagagttgggacttcaggatgtaaatttgggggagacacaggtcagcctgtaacatgccgcaagtgagggctgctggctggagaaggaaggcagcgggtccctcagctactatttgggaagctcaggatgatggagcgtggtcgctctactccagagaccccatttagggtggtgaccctgagggttgcagatggctctctattatagcaccttcagggcagggagggaagagagcggggtgcttcaaaggatggatgttggcttagatctagatttcattctcacttctagcactcagtgcaagactcaaaacctctctaagcgttggttttcttatctgtaaaagggggatagtaatagtgcctatgtctcaggatttgtggtaactaattgaaattatttgtgtgaagtgcttagcactggcaagagaaggtgccctctaaatgataaccccaccgccaccagcacactacaactgtcacatgccttttgccttcacaggtcagttcagagctagttttatttcttctgagaaggagccactctcccacagttggcttcctgtgccttaactgcgtcgtcagcactcgagtagagatggcaaaagctaggattagggtgacggaagcccagaggtctgtgtgaacctgcttggtgggctcctggcatcgatctgtcccagtccttgttctcgggtgtctgatgggtcaagaggggacctcagtatcagagcagacgttttgggggagaggctcaaggatctctccccatgatcccctgaggtctcagggatactcatgcaggtcatcattttgtcttgttccctctctcttctttggcagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtgagtgctgcagtgcccccaaccttcgccgtcctctccctcagcaacaccagaccatgggccttgggaccactggtggaacagtggggagggggcacccttggaataacactgaagactgttttaagaaagccctctcctttctggccaccacgatttatcatttttatcgatatagttttgggctccacctttgcttttcctcatttgtattttttaatttgatagtttccttttttgtgatcctcctgcctcagcctcctgagtagctgggactccaggtgcatgccaccatgctcagctaattaaaaaaatatttatttatttatttatttatttatttatttatttatttattttgagatggagtcttgctctgttgcccaggctggagtgcaatggcgcgatcttggctcactgcaagctccgcctcccaggttcatgccattctcctgcctcagcctcccgagtagctaggactacaggcatccgccaccgcgctcagctaattttttgtatttttagtagagacaggatttcaccgtattagccaggatggtgtcgatctcctgacctcgtgatcctcctgcctcagcctcccaaaatgctgggattacaggcgtgagccaccacacccggctaaaatttttttaagaggtgaggtcttgctactttatctgggctggtcttgaactggccttaaagtgatcttcctgccacagcctcccaaaacgctgggattacaggcgtgagctactgcacctggccctcatttgataattttctgtctcaggaatggagagtccaaattagcctgaaaaacataatctcttccgcttcctaaggtttcaggtgcaaattcgttgtgtttgagcagccttatgtgcagggcgaaagtgcccatccctctatcaagagtggagactgcattcctgtcctctgagcttacggagcatgacattttctgtctggaagcctgtacaggttgctcgccagcctgcttttacaatggaagtgcttttacaataagtttacttccttgggtcatcatgattctaaattccaggtagagagagttgcttaactattcctctgcttgatacatttgctggaggaggaaatcgctattttgtgattcagaaatcagctcaggaattttagccctgatagtgatacataatttcgggaaaagatttgtgaatcccttagtcagaaatcagtctccaaagtccggctcagtggctcacacttgtaatcccagcgcttgggaggccaaggtgggaggatcacttgagactaggggtttaagaccagtctgggcaatatagggagaccctgtctgtacacaaaaaaaaaaaaagttttttttttttttgagatggagtcttgctttatcacccaggctggagtgcagtggtgcaatctcggctcactgcaacctccgcctcccgggttcaagcagttctcctgcctcagcctcctgagtagctgggattacaggcacgcgccaccacacccagctaatttttgtatttttagtagaaacgaggtttcaccgtgttggtcaggctggtctcaaactcctgaccttgtgatccactcgcctcggcttcccaaagtgctgggattatatgtgtgagccactgctcccagccaaaaaaaatttttttaattagctgggcgtggccgtgtgtgcctgtagtcccagctactcgggaggctgaagtgggaggattgcttgagcccaggagtttgaagctgcagtgagctatgattggctactgcactccagcctaggtgacaaagcgtgactctctttctagttttttttttttttaaaaaaaaaagagaaaaaagaaatcagtctctaaagagttgatctaaagcataacttagataggtttcgtgagaaatgattgtccgttcaaaccagaatcttggacttcgcatctaagcccttaaacagagatgctgtcactacaaaaggcattgatacttctctctctccctttctttcttatccatgtggcctcatttgctgcctccttccaattccttttttccataggaagaagcatctccagtgctcttcattcctctttagatccatatttccatctggttccttctgaaggccatcctttaaccatgtagtgtgggcttgctggtgatgagttctaatttttatatttttttgctaatttttctatttttttgtagagatggggtttcgccatattggccaggctggtctcgaactcctgactcaaatggcctgcctcggcctcccaaagtgctgggattacaggcgtgagctgtaatccagctgttattcctttgtagagagtctctttagttatccctcaaatttgacaggctgtatggtggtgtggtatttctctatttttttcccccccggctttcatatcagactaaagattcaaaccttgagctgaggaagtgtttatttctttagtttttctttccctgtctgccccttctcctaccttaggaattccttcatatataggctggattggtctctgtgtctttttcgtcttcatacgcctcttcaccatcttaagccatttccttaatcttcggagaacatgatgggattgttttctgattcaccagtttggttgtctgtggtttccaacttgctgaattctctgatttacagagctgcattttttatctccaagcaatcttttgaattcccttttcaagtcagcctccctgcctccctgagttttctttttgagacagtcttgctctgtccccaaggttgaatacagtggtgtgatcatggcccactgcaacttctacctcccaggatcaagtgatcctcccacctcagccttctaactagctgagaacacaggtgtgcaccaccatgcttggctaatttttttgtttttttgagagacagggtctcactgtgttgcccaggctagtcttgaactctgggactcaagcaatccttccgcctcagcctcctaaagtgctggcattacaggggtgagccacaaggcccggcctctccctgagttttctaatgtgtgtatatacactcttttttttcttttttccgagacaaggtctctcttagtcacccgggttggagtgcagtggtgcaatcatggctcactgcagccttgaattctgggctcaagtggtcctcctaccatagcctctggagtagttgggactacaagcaccaccatggctggctgatttttttatttttagtagtgatggagtctgtgttacccagactgttctttaactcctggcctcaagtgatcctctcctgtcagcctaacactaatcccagagtgttaggattacaggcgtgaaccactgcctttggccatgtgtgtgctcttagtccttgttgatgccacgaattagagaggttctggaattttctcatgttcctcagaaactccatgtcccatggagatgcttgagtggctcagattcacctctgtgaattgtggtttgaactgtaagatgtgtacatttgacttgtgcttatctgtcttcactcttccttacagagggggatctctgtgtgtcccagatgggggataacaagggtttgggaagagactgtggatccctgcctaatctctaggtcctgaggaaggaagaaaagaatggtctgcatttgttctagttttttatctccccatggagtggctggccagctgcgggaagtggaggcggcgaggccccaggctgctgtttctaggagttggcctcatcacccaggtccctggctacctggggtgtttctctcatcctctgagtgccctggttatgccatgagagtcagccatggtggtatctccaggtgactaaggtcacataccagcacacaagggttcgtgtttgtggaacctggtagcttccttcagagctgacatttgcccacagccagcctggcccagccccataccaccagccctggcgctctggggcgtgaggtgccttttctgcccccctgctctagggcaggtggaaatcacccatggtgggtctacatctgatagaagcatcttatagttctgcttctggaccagaccatcctgggtttttctctgttctgctgaagggttccctccacgtgtccatcacctcggtgaactcttgggagacctgggaagatgctggcctcacctctcgcccctcctttccctcattgtgctgccaccatccttctcacacaggctctccagggagagctgggcaggatgggatcttcctgggttcccaccttgctccgtgccccctctcactgttcctgaagtgtggccacggactgccttgttttctggaaagtcccaagtctggaccatgactgagcagcattctcggctatctgccacctgtctggggctcctggcccctcttagactcccctctcccttctgtttcccccgagcccctgacttggacctgcagggtggggagagggatgggacgagaacctgtgctggggccaaaggtcgcactgggggaaggtggagccagggcagcagagtgcctggcgtcggcccctatcctgtcactagttcccccgttctggcccctggcaggtttgtaaccccagatcagaagtactccatggacaacactccccacacgccaaccccgttcaagaacgccctggagaagtacggacccctgaagcccctggtacgtggtgtggtcgctgccgtggatctctgcacagtgggatcccttcggttcatccaaccatgttcagtccacaggacccttccctctgaggtctcatttgattctttctcctgagaagatgcagagatcctgataatataaatggggaagctgaggctgctctttgtcacttcctccgactgctcctgagcacctgagtttgcaagcacgcgccggctggtgctagagacatggtggtatcccgtgacactcagcctcaggatgggggagactgatgtgaaatacaaataacttaaacactttcaggcaaagataagcactgggcctagttcagagaagtggcaaattgctactctggcctgtctctgaccaactcccagttctctacagagcacgggaaagcccctcggggacgtctttcctgcagtgtgcaggctgcccttctcccctgctcttcccagttgatgggatggttgtgttttctctatgaaaaaaggagttggcaccttgggctttctgaaacacacaggtgttttagaaatcagtggagggtgagagaaaggcatggttgtggaggcactggactgtgaacaaggtctgcagcgggtccccctgctgtctctctccactgcatggagcctcctatgaagcccaaggtggctgggggctgaggctcccttgggcctgccatggaactgattctgagtcaagcagactttccacggaccatgctacatgagccgaggtgaggcactagttagtgctcctttcctgttgcagtggagatttggctcctctgtactaaaatatctgcatgctctccaaacaggtgtgagggcaaatcacatgaccttggcagctgtaattaaagtttgtgggggcttttcggatgacttatgaggagtggctgtgattcgcacctttcactcttagtagcactcgccctcccctgttctctgttgcctgaagctggagaggtccttggaaccccgaggcctgagaaagggaaatgggtttgagagcccccattagtgtggaacaaagggttgagtgagcctgggctttgagctgtcggggtcctaattcagcagctgtgtgactgtgtgccaggctgttgatctctgagcttctgtttctacctgcttaaaatgacggttactgcacagggctgtgtgagggttacagtgcgtctctgggctgctcccagccatggcaggcccctgggaatcaaggtcatcagctgcttgtccaaggcagcagttagtggttgtgaatggtgcgtgtgagatctgcatcctggcgtcaggcctccttcctgccttacccaggacagcccagttgcagctgggttggtcccacagtcccacacacacacagcccgagtgtggtgcctcacgtgggctgccccgtgcctacccacagccacagaccccgcacctggaggaggacttgaaggaggtgctgcgttctgaggctggcatcgaactcatcatcgaggacgacatcaggcccgagaagcagaagaggaagcctggggtgagtagggtaggggtgggagagcctgggcagggggaattggagccgtggcatgggggaggcgtctggggacaggttgtagaaagtgaggcgctggggagaatgggggcgtagcatatcccctttgccccctttcgcacggtggttgttgaggaaactgacaagataaggacagtgtctctgggaccctcctctgctctgctttgaaggattcacttacttatccagcattgtgttcggaccctgctcaagttgggctgggctggatgtggtggatggagcagcaattacgacccagactggatctccccttagtgttcagggggcagagacagatgctagacagacacaccatgactgaattcacagggtaccaagggccgcagaaagggaggttccaaaggaatcttttgggtggaggcgaggcggtcgggatgagccagccaggccaggcagtgcctggctgagtgtcaagctgcatgagctgggggtgggggagtgggttcaggtgaggtggagtctgcaggggctcctgggcaggggggcagggaagggactgtcccaagcctccgttctatgccagcctccctcccactgcgtcgttagctttcatgacagtgcgcgatcccttcgagtctcctagtgctcctttttcccagactgctctcctcaagggagagctgggaacggtgggatgtacagggtgttaggtaaggaggggaggtgggcggtcagcctgggcgggacttgcccgagctggcaccccatgtgcacgtggagagaacttggcctctggcctccagggtcctccctggcctctccttggtggggatggttgtgagccatggcagcccctgctgagtgcactgttgggtagagtggggatgtgactctcagagccgctccctggtatcggagcaggccctggacctgcttctgtgaggtgcacggttaggaatggggcgttccttgattgtattaggcattgtagaggggcttgtcctgaggggtttgtgttcccatattactggcctgtgggtgctattttaggtgttactggggtgattctctgctgggcctgtttgaggggctgtgtctggtccattcggggtgagaacaggtcacttcgtggtggaggttcatgctgtgttcctgctcactgtcgcagcacctggcaggatagggtctaccttgggtacagagtctaatggggccatggggcctaactttcccagccaccccattcttctgacagcagattcccactagctgggccttgctccaagtctgcactgcagcagggcctggttttgtgaccatccatggccatgaccatccaggtgctgaccatggggaatccagacactcaccctaacccccttctatctgccaacccctagctgcggcggagccccatcaagaaagtccggaagtctctggctcttgacattgtggatgaggatgtgaagctgatgatgtccacactgcccaagtctctatccttggtaaggcttctgctccttggaactgttgagttttggagaggaccctcaaggtggagttagtgtagtgactctccaactgggcttctggaaccctgggctctgcagggaggggctatcagggagggtgggtccgggcacccactcatggcttcagtcagcagctctgcttgtctctcacagaaggttttgtttggcagagttgcgcggctaggacatgttttaaaaacatgcatctgggtctcctgcgctctcccagagagggtcagtgatgtgtctttttttttctttttttttttttgaattggaatttcgctcttgttgcccaggctggagtgcaatggtgccatctcggctcactgcaacctccgtctcccgagttcaagttgttctcctgcctcagcctcccaagtagctgggattacaggcatgcatcaccacgcccggctaattttgtatctttagtagagacggggtttctccatgttggtcaggctggtctcgaactccccacctcaggtgatctgcctgcctcggcctcccagagtgctgggattacaggcgtgagtcaccgtgcccagcctagtaatgtgtcttaaggtatagccaggcacttgggcacattagtcctgggatgggtgctatacagcccccaggccagtggacttgctgtgccgggtgctacagtgaggtcgacctcagaaagggggttgttgcctgtgcagagcctgggtccccagaagccagggtgtgctgctgatccctctctgctcacaatggggtgagttggcttgccctggctcagagtggggaggcggtgagaggcatggcggcgtcatgaacaaaggttaagggttgcctgatcttccaagtagactgctgccctcacggtccttgcagagaaaccttgtcctggctaggggtctctgacaggctggggacctgcagccaggttactgcaaagaaaaaaacatcaccgcagggagtgaagagcacagattgagtcaggtgggcctgggtttgagttatgacaccatcactgctctctgggatctttcaggttccctgagccccagttaaaagcctataaaaggggtgccaagcctaagtcaggagggcacagtgccaagcagagcagagagactggaagggcgtgggaggggctttgtgcaactccgctgtgcttggggttgaagctgcgtctttatgatgcttgtggatgtttctggtcccaggaaaactaggaacagccttggctcctcctgaggctttatgtgacaaagccaacgttattgagtatgttattactggataatgctcagtgatactccacatttattgattatgttattatggcctgggggctgcacggcacccatcccagggctgatgtgcccccacgtacttgactgtgcctccagacacaccactgaatcaggctctgaaacgcacacacgtttctttacttgattacttgattttttttttttaagtaagaaagttctttagaacaagattaagttctttgcttaatttttttttgagacggagtctggctctgtctcccaggctggaatgcagtggtgcaatctcggctcactgcaagctccacctcctcccaggttcgcaccattcttctgcctcagcctcccaagtagctgggacaacaggcgcccaccaccacacccagctaatttttgtgtttttagtagagacggggtttcaccctgttgaccaggatggtctcgatctcttgacctcgtgatccgcctgcctcggcctcccaaagtgctgggattacaggcgtgagccaccgctcctggccctttgcttaatcttttaagtataaagtaagcttaagctcatgtaaactccctatctgaaagcagaaactgaggcttggaaaagtgtgtatcctctttcaggtctcagcagccaggtggtggtgctggggtgggattgcgggtttttttcttccctctcacagcttctcgcaaaatggtgactccttgacttggttttggtttcagccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctgtgagtgctgtggccatctctgggggtcctgcagtgcccgccttcttagctcagggctgagtgctggccatccctgggggtcctgcagtgcccgccttcttagctcagggcctttgcataggctgttcctctgcctgggtgcttttcctgctacttcccgtggctgcatttgcttaacttactcttctgatttcagtctcaatgctgcttccttaggggtaagccttctctgaccctacattctgtagagatacccccattctgccattctctcttttgtggcctgggtttcacttgtaactaagtcattatccctgtatttggtttgcttagtacatgtctgtcctcaagcaggggctggcttcaggctgctgacccgtctcactgctccttctcacccgcctcctggctgtggcttctcctcgaggctggtgctgcacggggcgggcagtgcatggccatgtctccttgtccagcgtcctacttacagttgaggaagcccacagccaggaagtgacttgtccagggtcacagggaatgtggagagagaataagaaggctctggcttctaggggagggaggcttataactctacccttccctggccaggatcaccagggtctgttgggaacacatagtccctgcctggatggtaaccctcttgcctcctcccagatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctctttgtgctggtctgga

SEQ ID NO: 427 - DNA, 19185 bp, Homo sapiens
gacccggcagcgacgcgggcggggacgcggtgcatcgctactgcgcccggcggacagcgacttgctgctcaaaaagaataagaaccagggtttttgtttgttttttttttttttaattaaggtaaaaataacgcacttttttttttgcggaacctgaaaaattcaagaagttgaaaaacgcttttcacgtcacctggagagatgcacaggtaacattttgatacatttccttccagtcttttctctagatgcatgtcgttttctttttaaaaatttattatataaaactggcatcagactgtatagactgtatatctggcatctcctgctgttttacctggcatcaagtagtgagaattttgccatatcggtaagtatcattgccaacacgctttttaatgattgtgtagcattccagctatgaatgaacactagcgtatgtaacctattgttacacacttaagttatttttaaaatcagcattacagttgtaaatctatttgatggtgctaatgacatttttaaagttctagtaatcccacaacccatagataaacactcataacatcttggtgtgtcactttctgggcttttccatgcatatagccataaatgtatgtgtttgcacttacagaaataacatcatgtatatacataagtgtgaatccctgaagcctccctctcctgcagcaaaacattaaaatgccaagctcttaaaacaatgaatgtatagctgtgtttttaaaaatctcttagggcagcactaaggggaactccagcattggcagaggggaaggctgtgacccagggggacaggctgaggacctggggctggatgaagctgtgggtgagtgtagacaaagaagaaaagaggaccaaggacagtgccctgggtcctccaaggttaagggctcaagaaagaggccaggtgcagtggctcacgtctgtaatcccagcactttaggaggccgaagcaggcgggaccacttgagatcaggagttcaagaccagcctggccaatatagtgaaactccgtctctactaaaaatacaaaaaattagccaagtgtggtggcactcacctgtagtcccagctattcgggaggctgaggcaggagaatcgcttgagcctgggaggcagaggttgcagggagccaagatcatgccactgcactccagcctgggcaaaagagtgagactccatctcaaaaaaaaagaaagaaagaaagaaagaaccaaatagagactcttgaagtggaggagcccctgaagcaggagaaaaaccaggctactgtggcattctggaagccaaaggaagaaagtgtaactcactgctgttttagtgcaaatttctgttttcgtatgtttcttggccatttgaatcctgtgaattttctagtcatatcctttgaccatgtgtttgtctttttcttgacttttaggagctctttacatgctctgaagaaaagatcttgttaagtatgttgcaaatgttttctccctgtctgccacttgtctaagttagtttagggaatcttttggatatgagaagtttttaatcttcaacctgtcaattttttccttattgcttcggggttttgtgtcttacttagagaggacttccctatccctgagatataaaagatattcttttaatctcaaggtccaaaagaacacgtgggagacttttccagagcactgcttggcccaagaggagtgtgtggtcactgggcaaaaatgaatctaagattacctggatgagaactccttgccatgcatcttttctttctttcctctctttcatccttttccttgtttctttccttccttccttcccttctttctttctctttctctcttttccttcctttccttctttctttccttccttccttcccttctttctttctctttctctcttttccttcctttccttctttctttccttccttcctttctcttcctttcctttcctttcctgtggcccctccttagtgccatacaaagggcattggcacaattacttctaggacagaaaagccacgcccatcatatgctgatgtcatagccatttccagatacctcgtctaccctttgcctgtagcagtgcacggggcccatttccatcccctctcaagtgaccatttcccccagcaatccatctgaggccccgggcttccccacctctttctgtaagtcccagctttctgcttttaggactgtttgggaaatccataactcaccttctcttcttttggtccagcctgcccagagctgtccttcaggcccctcagcaagctttccattctccttttgtttatttgagacagggtctagctctgtcacccaggacggagtacagttgcacgatcatagttcattgcagcctcagtctcctcagtagctaggactacaggcatgaggcaccatgcctggctaatttttaatttttttttttgagacggagtctcactgtgttgcccaggctgggagtgcagtggcgtgatctcagctcactgcaacctcctcctccctggttcaagcaattctcctgcttcagcctcctgagtagctgggatcacaggtgtacaccaccatacctggcttagttttgtatttttagtacagacagggtttcaccatgttggccaggctagtctcaaactcctgacctcaagtgatctgcctaccttggcctcccaaagtactaggattgcagccgtgagccacctcacccggccaaaaaataataataaataataaaaataaagagaacaacattgggcgcggtggctcatgcctgtaatcccagcactttgggaggccgaggtgggcagattacgaggtcaggagatcgagatcatcctggctaacacggtggaaccccgtctctattaaaaatacaaaaaattagccgggcatggtggcgggcgcctgtagtccgagctactcaggaggctgaggcaggagagtggcgtgaacccgggaggtggagcttgcagtgagcggagatcgcgccactgcactccagcctgggcgacagagcaagactctgtctcaaaaaaaaaaaaaattagctaggcatagtgccttgcgcctgtagtcctagctcctagggaggctggggtgggccggaggatcacctgagcccaggagcatgaggctgcaatgaactatgattgcaccactgcattacagcttgggtaacaaactttgttttgaaagaaaggaggaaaaagaaagaaggaaagaaggaaggaaagaaaaggcagagattgcagtgagccgagattacggcactgtactctaacctgggtgacagagtgagactctgtctcaaaaaaaaaaaaggttttattaagatatatttcaagaagcatacaattcacccatttaaagtgtacagttcacagatgtgctcaactgtcaccacagtccattttggaattttttttttttttttttttgagaccaagtctcactctgtcgcccaggctggagtgcagtggctcaatctcggctcacttcaacttcaacctccgcctcccaggttcaagaaactctgtctcaaaaaaaaaaaaaaaagatttgcttaaaagttaacatctcgggctgggcacggtggctcacgcctgtaatcccagcattttgggaggccgaggcgggtggatcacgaggtcacccaggctagagtgcaatggtgcaatgtcagctcactgcaacctctgcctcgtaggttcagtcatttctcctgctcagcctcccaagtagctaggattataggcgccaactactatacctggctaatttttgtatttttagtagagacagggtttcaccatattggccaggctggtctcaaactcctgacctcaggtgatccacctgcctgggcctcccaaagtgctgggattacaggcgtgagccaccgcacctggcctaatttttgtattttttgtagagacagagtttcaccatgttgcccaggctggtctcgaactcctgagctcaagcgagtcttcctccttagcctcccaaagtgctgggattataggcatgagccaccacccacacttcttttactctaggaaacttgttcagaagtccatttgctatgatctcaacatgtagtctttcaataatgagcccctaccaagcaggcatccccacctgactgcccgttctccttaaaggttgcatgtattgcacagtgcaaaggaatcacctcccctattgaagacaataactcaacgaacatacatctgtgtgtacttttatcatctccttaagagaaatgctgagaagtgggatattagggtcaggggccaactttggtcttgaaccaaagttctgggagcaaggttctgggagcctgggagagaggtaaatgatttagtccttgtccttcaatagtccagtcagcttgagatgagattcaagaaagggaaaaggagatttcaatacttaatgctactgggtgtggtggctcatgcctgtaatcccagcacttttggagactgaggctggtggatcgcttaagcccaggagttcaagaccagcctggggaacatgacaaaacccagtctctccaaaaaatacaaaaatgtgccaagcatagtgggatgcgcctgtagtcacagctacttgggaggctgaggtgggaggattgcttgaactcaggagacagatgttgcagtgagccgagatttaacactgccctccagcctgggtgacggagagacttggactcaaaacaaaaacagaaaacaaactaaatgctgtgcctcccatcagttcctccctaggaattcatcttgtagatagcacacagacacataagggcatacttactgcatcgttgtaaaagctaatatcctaaatgttcagcattaggggcttgagtaaatatatattgttatggtactaatatggatccatctccaagtaagaagaagaaaggtatagaacagtggtttttatttttatttatttatttatttttgagacagaatctcactttgtcacccaggctggagtgcagtggcacgatcttggctcactgcaacctccgcctcctggattcaggtgattctcctgcctcagactcccaagtagctgggattacaggcacatgccaccatgcctggctaatttttgtatttttagtagagacagggtttcaccatgttgcccaggctgatcttgaactcctgacttcaggtgatccacctaccttggcctcccaaagtactgggattacaggtgtgagccagcatgccagcctagaacaatgttcatatgctgtttgtatattctttaaaatacagacggatttacgcttgtaaagatatagacctgcagccactaaccctaagtggccattgaactattaatttatttattttatgtttagaatcaaagtctcactctgttgcccaggctggagtgcagtggtggaattatggctcactgcagactcaaactcctgggctcaagctatcctcctacctcagcctccagagtcacttggattttttgtttgtttgtctgtttttgagacggagtcttgctcttttcgcccaggctggagtgcaatggcatgatctaggctcactgcaacctccgcctcccaggttcaagcgattctcctgcctcagcctcccgagtagctgggatttcaggtcggtgccaccaggccaaactaatgtatgtatttttagtagagacaggttttcaccatgtcggccaggctggtctcaaactcctgaccttgtgatccacctgcctcggcctcccaaagtgctgggattacaggtgtgagccaccgtgcccagcgagtcacttggattataggcaggggccaccacaccgggctaagtttttaaaaaatgttttgtagagacaaggtttcaccatattgcccaggctggtcttgaattactagcctcaggcaattgtcctgcagcaggctctggagttgctgggattataggtgtgagccacagtgccagcactattgagccctttaaatgttgcaagtacaaattgagatgtgctgggggtgtaaaatgcatactagtttgaagacttgatatccaaaaatgtaaaatatctcattaatttatattgataacatgtcgaataatattttgaatacattacattgaataaaatattacagtaatttcatgtttcttttttactgttttaaatgtggctactagaatattttaaattatgtatgtgggccaggcgcagtggctcacgcctgtaatcctagcactttgggaggccgaggtgggtggatcacctgaggtcaggagttcgagaccagcctggccaatatggcaaaaccctgtctctactgaaaatacaaaattggccaggaatggtggcgggcacctgtaatcccaggtactcgagaggctgaggcaggaaaatcgcttgaacccaggaggcagaggttgcagtgagccgagatcatgccactgcactccagcctgggcgacagggcgagactccatctcaaacaaacaaacaaaaaaacccagaacccctctgtggtcttgcccacctcccccctcactggcccagaggtgacctgactgtgggatttctgtttttttttttttggttttagagaattttattttattttattttatttttttattttattattattatactttaagttttagggtacatgtgcacaatgtgcaggttagttacatatgtatacatgtgccatgctggtgtgctacacccattaactcgtcatttagcattaggtatatctcctaatgctatccctcccccctccccccaccccacaacagtccccagagtgtgatgttccccttcctgtgtccatgtgttctcattgttcaattcccacctatgagtagaatatgcggtgtttggttttttgttcttgcgatagtttactgagaatgattatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacatgtgcatgtgtctttatagcagcatgatttataatcctttgggtatatacccagtaatgggatggctgggtcaaatggtatttctagttctagatccctgaggaatcgccacactgacttccacaagggttgaactagtttacagtcccaccagcggtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttgactgtgggatttcaagggattcaatagtataatgcctgccctgccacatacaccctgtgcagatgtatattggctgggtggggggtgggggggatacctgttgtgtttattttgaaaatgcaaatctcggggcagttttttttttctggtttttgggctgggtggctttacaaggacacttcccccttccctcctggcactaagggcagtcacatcctcactggaagtagtggctggaggtccagggcataacccctgacccagggaggatgaaccggaaattcagtcttgcagagccctctgcacagcacaggagctgggcaaaatttggagaaaaggaaaggtcacgttcccaccttggccacccctctcaggtggggctggggtcttcccctacccttcagatgcattggcccacccagccccccatcaccaggccctcccttttgccacccccatccaatgcaccttgggtctgggtggctgggactgcacgagaaggggtactcctgccttgctgagctgcagcccgccccccgcaccaccacccgcccagccagaggccacttctaacctggggagacaggatgcgaaagctgctcactacccaccggcttttgggtgcagccttcaggcctcttgttccaggaggcctggaaaacgagcggggctggaaggcatttagataattggaagatgggccgggcacagtggctcgtgcgtgtaatcccagcactttgggaggcctaggtgggtggatcacgaggtcaggagttcgagaccagcctggccaatatggtgaaacccccgtctctactaaaaatacaaacattagctgggcgtggtggcgcgctcctgtagtctcagctactcgggaggctgaggcagaagaatcgctggaacccgggtggcggaggttgtagtgagcagagatggccactgcactccagccgggttgacagagggagactccatcccaaaaaaaacaaaacaaaacaaaaagaaagataattggaagctgctccgcttaaaacgaatgacaaattcagcctccctggtctggtcatcaaagaaacaccaattaaataatatggtgccattggcaccaagttagccaaatcatcaatgggcgtgatacttaattcgcctctctggttgctgacaccctcctcgacccccagccgcggaaatccattcctagttccaccgtttagagcctctcctggggctgccgcgaaaattgggccggttggggtaacatctaacctggggtcccgcgaaagagcccatcagttccgcttgggggccccactgccctcccacctcctacgctgggcgcttctcctgcgaatgacgttttgctgctgctcagcgcagccagtcgcggaggcggggaggctgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcaggtaggacaccccaaggaggctgcatatgggggtgagaggctaggtctggagtcctgggcctcctggagaactgggcatggtagtcgaatccaggaggtggagtccggggaggcatcctgagcagtggagaggtacgcccttgttccctcctaggggcccaggacatgggaagtgagacctgggctgtgccccccacacctccaggtgacctgctctcagtctgcacaagcctctccaaatcttctttcccctcactccctcctccctcattgtgcctccaccacgctgcctccgtaatctctgcccggatagccaccattttgccccaggatgggaatctcaagcctggagagggaacttaagggtggcagagccgtggagcactcacacatccatgcccctgctccctccaccccagttctgcccccagaattaagacaattaattaaacactgatcctgctccctaagtctgcaaggggagagctgggttgttccagtaggagaacctggtcttggtccatccttcaggaagggtcctggaaaggtgggggtctgacagtttaggggaaggctctctggggcggctctgctagaccaccaacccttaggctggcctccagccaggcagccttgctcacaccctgggctcaccttgccctgctcctgagaggacctttcctaaaccagtcaacgaagagaagacgctttagggcctctgtagaatgaaccttccttgacctgagaagagggggccctcagggccattgctttcccggtgtagtgtttcgctcagttcttttctcagcaagggagtgggaacgtgggctagccaggccttgagccccacgtttacctttctcctttcccgggtccctgttcccttcccagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtgaggcccaggggagcctggggagatctgcctgtgtcaggagagtttgtgggggctgcctgggcctcccaatttccctgccgatcaaactaacatcctccccacaacctggtgggcccaggagcctctcccccaccctccacagaaatgggaggaagacacacctcttgtggggctcaccacacccaacgcggactggctgagtggatgagagggtggggccctctacggagatgagatcttacctatgtaaaaccacgctccagagttcctaaaccacaaccctacctgggaagcacccagggctgagagttggtctttaaaacattcttagcctataacctcttctttaaaaatctgttgtctcttctagaacaaattattttaaaccagttcaagaaaaatgcttagtgagcattgtggtttaaagacgcatatgaaggaatttccatagtaaacagggagtggagccctgtaccgtctgggggacgatgtgtcagctctcagggtccatggttgggtttttgtttcattttctaatgtgtcaaagtccaaactagaaactgttttttttttttttttttttttcatattgggacatggtgggggaaagaatacagaaagtgccactactttcaaaccaaggtgctctgtcccctcaggtctctgcatggattcccccagccctatggacccccacatggcggagcagacgtgagtagagaagggaatgtgtacttccaagcattcagcacctgtctttaagaatcctagttctaccataaattcacccgggaggcctgggaaagcagacagaccatggggtggcttcaggatccccatggccggggggctcactgactttctcaggccttggcattctgctccctgtctcagagaaggatctgctctcatgggagccaaccgagtgtgggctcagggccagggatagtggggacagtggccactgggagagcagatactagactacagcccatgtcttgcaggaatacaagcccagcgtatgtcccgtttttctttcttgcctatacccatttttttctgtgaaatattacaatttaaaaatatgatccaactaattcaaaactttaactcactctaggccaaacaaaacacagttgcctgcagattgatttggctcttggccgatcagcaacctctgacttcgatgacactttaccctctggccagccctggtctaggccctttctgcaagggaatggagagagagttggtgggctctggcctggacagaccatccccttggctgtgggcatgggtggtgtcttccagagcacagctgttcccatccagttgttaaagcccaagcagcggggcagctgccagccattagtagggacagctgggcatctctggcctgtgctggggactgtggctttgggtttaggatagtgacttgtcttacctcccattgcctttgatcagactgggttgggctgcagattggttcacaaacaggaaatggggagaggattgggtggggttgggggactgcaggttggttttggtggcagcacagagcaatcttgccctacccccaaggcccatgtgcaagccaatgaaattggtcatccctgatgccaggttggctgggcacagcagccccccgggggggcatccccctcatactttatccctgagtggttccctgccctgcacctgctctgacagttatacagagtttctcagaagctgtgtgtgtgtgtgtgtgtgtgtgtgtgtgtgtgtgtgtgtgcgcgcgcgcgcgtagatgcacaaaagctccgcgtggcaggtggtctcctgtaacacggctgagggggcggggcctcagagggaacatgtgttggaattccttgcctgctggcctcttctaaggcaggaggagggggtgggacagaggctggtcctggaaaattccataggagggaggagaggatgtgagcctgcacgtttgtcactgggggtctactgtatcagactggagctgactgggggagccctaaagcaggccccagtcctcagaggaccgggagccaggccagctcctcacaggggagaggaagcctagccttgctgttgtccaggccctggagacacccacattgctgggtgcccctggcctatcataggatggatggatgcctttcctggcagccatatggccccgctgaggtgatttgcatacaggtggaaggcctggtgcaggctggcgagactgttgccttggtgacgcctccctgaccctgacctgccccagctgtctctatcactgccattctctgggctttctttcattcagggcagcctttaaaattccaagctgcctcttatcttccccctccccaatacctgggccccctgatggtgggcgttcttcccaccccaccccttccactgccttgagccttggcccttgtctttgcccttactcccccctggactgggggcctggtgctggggtgggtgatgggtgcggagggagcatgggttgcatgggacccttctctgtcctaggtttgaacaggccatccaggcagccagccggatcattcgaaagtaagtgttcctgggcctcttccatctaccacaagctttcccttaggacagggctccagaagggcatgctgcatgctcttggtccctgccctgcctctcccagctctcacctgtccccatttcctcctgtagcgagcagtttgccatcagacgcttccagtctatgccggtgagtgtcttcgaggcctgactgaggcttaggcatgctagccaggcatggggtagatgagcaggatgcattcagggatcacctcccagctgggtgtccccaggcaggctgtaggagatggggtttcagaggtaggtaggtaagtgggaggagctggaggagaggtggagaaggtagggcctgggctcgtgccggaggaatgcagccttcattcctctgcctgccgccctgcctggctctctaggtgaggctgctgggccacagccccgtgcttcggaacatcaccaactcccaggcgcccgacggccggaggaagagcgaggcgggcagtggagctgccagcagctctggggaagacaaggagaatgtgcgcttctggaaggccggggtgggagctctccgggaagaggagggggcatgctggggtggttccctggcatgtgaggaccctcctctcccatcttggctgcaggatggatttgtcttcaagatgccatggaagcccacacatcccagctccacccatgctctggcagagtgggccagccgcagggaagcctttgcccagagacccagctcggcccccgacctgatggtacatccagagagcggatccctgggaggggcctggggaggcagcctcggagaagaggagggtggccctgaacccccaggcactgggaacttttcctcaggaggatgggggcgggaactatctccacctctaagtctgtgtctgtctgtcatgtggacagtgtctcagtcctgaccggaagatggaagtggaggagctcagccccctggccctaggtcgcttctctctgacccctgcagagggggatactgaggaagatgatggatttgtggacatcctagagagtgacttaaaggtaaacagccttgtcccaccaggcccctaccttcctatccctgggttcgcccaaaagaagagagctctgagcccttgtggcaggaccatgatgtcattccagtgtcagaagaagaatctgaggtaactgagtcacagcctaacctctggccaatgagagaagaacaggtggctggtgccacagtggagggcggtttgggaggtaggggagcttctcaccccaacctggagtttgccagggaaacagggaaggctgtgctggaggattccgggactggaggggtttggcctatgcctgtgggttgtgaccctgtccttgctaatctggcctcaggatgatgatgcagttcccccaggcatggagagtctcattagtgccccactggtcaagaccttggaaaaggaagaggaaaaggtgggcctctggggtggccccctccgaatttggaggcatggggtccatcctactctccagtggatttgagggatgggacggggcctgggcaccctgatccctaacctgctgtccctgccaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctgtgagtgccttcctcctggggttcactttggcatgcacctgggcagccacccccttggctaagtttgtggcagagggcaggtggcagcctgggcatggcagagaaagggggtaccagccagccagagcactggggggcagccccaccctgaccctggcctccatctgactcactttccagaaagcccgcgtcctccgctcaaaatcactgtgtcacgatgagatcgagaacctcctggacagtgaccaccgagagctgattggagattactctaaggtacctgcagcagcgaagggggtaccttgggggcttgacctcttactgactaggggtcctctagcccaggggctgcttgggttcctccctttctccccggagccccccttttctttgtcctttgtatcttttcatcctttgttctcacatagactcctccctctggccctccttgtctcctgactccacctcaagtcagtccaggcatctgttgagtctccgtcttatttccaagctcatacctagcttggaaccccctcatgcctcaccttcgggcttggcagagggtagggagcagagtgtggagttcatctcttccacttccctttttcatttctctttccccttggaaggttgttccctgggtgtcagacccaagaggtgcctctcagttgccatgggaaccagaactgaatttgaaggccaaagcaggtgtggcctctgattttgggaatgaaacttcattctttgaggctcctggtcttaccaatttaactttctcccctctccctcatcccttccgttcccttcaggccttcctcctacagacagtagacggaaagcaccaagacctcaagtacatctcaccagaaacggtaaacagcgttgcgtcattttctaggcagatttgggactgtagctccattgttgaccttccctggggacaggctagggccacctgccagctgccagcctgacctgccggaaccaacccccatgacctcctacagatggtggccctattgacgggcaagttcagcaacatcgtggataagtttgtgattgtagactgcagatacccctatgaatatgaaggcgggcacatcaaggtaagatggggcaatggggagaggccctgaagatcccacctggtttaggtccttgctttgccaagagggtgaatgggtggaggacgggtgccccctctcatggggagggttcctactaagagaaggacagcgactgcacggggagggccctgactcctggacccggggctgtgcctgacctctggctcctctgacagactgcggtgaacttgcccctggaacgcgacgccgagagcttcctactgaagagccccatcgcgccctgtagcctggacaagagagtcatcctcattttccactgtgaattctcatctgagcgtgggccccgcatgtgagtcccagctccgcccagccagctagtgtctgccctggccttccctgcccaggctcacaggtgctggcaccattgagatggccaggggtgcaagtccaggtcctcctctgtcccatctgatggcctagagctgacctcagccccacttcactgtgcatggtacccgcctcccatctccctcactgtcctgcctatcaagcctcatgtccaccccacatccattactgccaccctcagaaaatttagttccaagtctctagcggtgtcttttctcgaaatctaagggccgcgtgtcagtccccagtacacggaccctccccatgttcagtgctgttaggtctccattagaacctcttccattggcatccacagcacctgggcctccctggctgagctccttctgtcgctattcctgttctgcctggccatctgtcctcccacccctgcctcctcctgggttgccactggtccatatgactgctagtggctccccagcctggcctcacccatgtggtgggaatctgcacccagacgccccttacagagtcgcatccctgcggccctcccaacttctccaggcatcccagcatatggcacccacctccacctgggcaccgggcctgggcactggcttcagtcttgggtcctcctcctcccttctccccaccactgatcctcaccaggtcttgtccaggagtggcccgaatggatcccttgaatttggcccacttgtctcctctcctgcttctcctttcctggtccaggcacagatatctctaacaaagattgtgcaactgccttctagaaacggagagttcatccccttgattttacctccttccttccgcctccccaccctcttctgtagccagagtgacctaaaagtgttcttgtggttacattcctgtgctctaaagctttctgtggctccccaaggccctcaaaggaggggacgtgggggataggtcccatgatgtacaagccactgcatgccccactctgaccacaccctgcccatgacgccccaggtgccgtttcatcagggaacgagaccgtgctgtcaacgactaccccagcctctactaccctgagatgtatatcctgaaaggcggctacaaggagttcttccctcagcacccggtagcgtgggtggggaaggccacagtctctgtgtgagggttggcttggccaggctggagccatgggatggggggtgggagggttgggtccctgccaaacttacccattccactgcattgacccctcctgtcctgccctagaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa
